United States Patent 9,487,797 (GENOMIC PLANT SEQUENCES AND USES THEREOF) - sequence listing, part 19

SEQ ID NO: 45533 - DNA, 506 bp, Oryza sativa
ctaggcgatttattacccaaggttgacaaagaacagatatcaagtaaacatggcacaagcgagcagataggtaatacccagatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacggattctacacgctggcacgcaaaatgaggaaaaactctaataaaaaccaaggaaacagtacataaaaactaaacaaacatgtagagctcaattttagatgaattttgcaagttgaacggctcaattcggagttcgaatgaattagatatgaattttagaagttttgagccatttaaatgaatttctagaattattaacgaattatgacgcaaatattatttatttttccaaaggaaaagagggttgctgacatcatcaaaggggagg

SEQ ID NO: 45534 - DNA, 619 bp, Oryza sativa
caaaccgcttgtctctccagaagaaagcacgtcaaccacaccctgcaatcattaaataacactatgatcaaataaccagtatgttgaatcatagatgggagacaatgtcaatagttgtggaaatatgttataccatttacctggtatagctcagcccgaatctttttttggttctcaggttttgagtaccaatcgagcctcatagactcgattttgatgtacatggcaacaacccattgttggaaaagtcgtcctccaaacaaaatgatgtttagaagtccccttctaaactgcagcctgaagcaatagtactccctcgctgtgacaaacttgtcctttttccctttgccagatttactactatcgtcattatcatcttcattgtctagataattgtcaacaacctcgttctctgcgtccaaacttacatattaatatacataaacaatgcataaggacataaagtttagaaattattcgataaaagccacgagtgtacgtacccggaagatcatcaaaagtgctttcttcgttggtacgtacatcacctaaagttgatgtctcacaatgttcatccatttccacatcacacggaatctggttgggatcgttgtatggc

SEQ ID NO: 45535 - DNA, 621 bp, Oryza sativa
atgcacgttggtaatctgacgcgtggtggacaagaatgaccggtctgacactggtcgcgtcagcaacgagcaccacgatcccacgttgcgcccgtctccgccgggagtggaggtaggtgtgggctgtcccatcgaagtgtgattcgacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgtgcggtctcccggtgaggagccccgcgctccgtcatctggcgcgccaggtagggggctcagcgtgtgtcttctgagctcttgcgctctttcgtgtgcaccaagcctttcctgttcagcctca

SEQ ID NO: 45536 - DNA, 1501 bp, Oryza sativa; identical to SEQ ID NO: 28683

SEQ ID NO: 45537 - DNA, 1501 bp, Oryza sativa
ccctactcctgtgtttttgtggatttgtgtatgaatgagctacaaagtgtgagccaaactctcccttgttctaggctctcaatctcgccagaatcaaccctctactctgtgggcaaggtcctccttttatacttcaaggggataccacacgcacccttccctttccaaactggactttccttctctttacgaacggagattgatatggttgccgtccgaatcacacttcgatgggacagcccacacctacctccactcccggcggagacgggcgcaacgtgggatcgtggctgctcgttgctgacgcgaccagtgtcagaccggtcattcttgtccaccacgcgtcagattaacaacgtgcatgtttgcccttcttcgtgtaacaccttgcctgtaatggttaggatgaagcctggtattcatctaaccagggctaacgtgccatctctaagaggtaacacgctagctccggctggagacgtgtgcctagaggcactcgtcttgacgggacggggcgaggcgtgcgtcaaaccgccagtcgccacctaaccgttgatctgaccggtctgtgactggtcacagaccggataaaagagcgcgctgtattgcgctgcatgcagcgtgacacgcttgaccagaccgcaataaatgctgttaggtgagcacagctgtgctcacttatcccatatatgtggcgcagacttccttaaggggtcggggtgcctcggccctcggggtcggggcaagcgcaacccgaccccccctcggggggaatcaggaggagggcggacacctcaccctcgggcccgacgtccccgaaggtgccaggccacgtgggcgattgtgtctgcctcaagcctctggccatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacatcacttgagcagcgcgcgaatctgggtgagcagatttgtctcgctcggagatacggtaacgccgcttcggttggcgagcgtaattaacgcgcgcacgatacaatccgtttcgattgccacaaccgcatatccacttcatgcgccgtaagcgggcgaatgggattagtggaagcgtgggcacaggaaacgagggagcgggatagcgagatacgagggagcgaggtagtgggcgcgagaaacgaggagccaggcccagcgatggcaagggtataaaagcatcgagaaaaggatttgctcccttcctttcgccattgttcctcttgcctttgccgcctgagctctaactctttctctgctacgccctactttcgccacacgcgctcgttcccaatcatctcttcctccaccgcca

SEQ ID NO: 45538 - DNA, 1501 bp, Oryza sativa
taaacaagcataactcactcatcttaactcggaattgaatgaaacttgaacctaaattcatctaaaatcaagatctatctggtgataacattttctcaatatgctttgtactgtttgaattttggtgaatttatttgaattctaattgagttcaaatccgatctttcgcacgtaaatttagattccgagggaattgttgagtcgattgaggagcagggatagcaagactgcgatcaaggcaagtcatcactaatctttgagcatgttgaacctattgcgaaaattatgttgatttaataaaattacatgctatacatatgtgaatatgaatgccctacttgttaaatatgccatgccttgatattgattatctgtatgaccattgtaaaccctgctaacgtgtgtacttagtcgatattgaacaaatgcttagtcatgctaattagaatcatgcattctcatatttatcaagtgctatatgcttgggcaactaccttaaggaaggtagttgagatgcggcatgtggaggcatgggcaccacattgccatgacaaggataacatgaattgtgaaaagagaaacaaaactaaacactgttttcgaccggggcggctggggtacttgggtggtgtccagaaaaggctagtgccgtccctggtcagttaaggaccgagccgtaaagttaagcatgaaacgaccctcgtacaaccgtacttctcgtatgggtatagacctagcggagtacgtagccgagcgaaggcagtatccctgcatagtggttattcttggtgtgtgggagtcagggcctacgatgggacagccattggtggggccgcgaggggcgagtgcctatagtggtgccgccatcggtaggactgccatgtgtaaatttaatttaactaaaacttaatgcatgtgtgagtcttcccttcccgggagcgccagaactcctctcactgctagaaactcatgacacctagagtgcatgaggatgcaagttcatggagtgcatgaggatgcaagttcatggagcgggtactgccaacgtgaggttattgaaaggttttgccttggcaagtctcattcgttgggacgtaggctcatgtgttgggcaagtcgcggagtacgggtaaagtgtacatccactgcagtgtgagtaaaaccaatctattcgaatagccgtgctcgcggatattgagcatcaggacatgtattacacttggctagactctaaattcttaaattgaatgagatgggatatgcatgatgattttatactggtggatcatcttctcgagagacgagaaggagtaaaccccagaaaaccattacagccagtaacgggaagccatctttgggaagacaatggatggtgaaaagaaccgttgctgtgtaataaatactggaattaaaactggactagtctatgctagataataagcttgtgaaaagaattgtgaaactagctttatgcaaataaaccaacggccatactttgaat

SEQ ID NO: 45539 - DNA, 233 bp, Oryza sativa
tagacttaaaagattcgtctcgcgagttagtccaagctcatgaaatgaattttgtaattagtgtatatttaatactctaaattaatgttcaaatatccgatatgacagggatttaaaataagtctccggaaaccaaacagccctaaagttacgaattttctgaagtctcatcaccgaaccacccgaaacgcaacccctctctggagatcaccagatctactcgtccccaatgg

SEQ ID NO: 45540 - DNA, 1501 bp, Oryza sativa
taacgtactaacatcctcctgtgatttgttcaactgatgattcatttgttgaacacttgactctgtgattcgttgcctcattactttgatacttagatacagttgcatacttggatttgaacgctggtttgataatctgaatttttattgcaaactttttgggtttggtgtattggctcgcgagctgaacgagctagctcaagctagccgagctgatccagtcttctagctcgttagaataacgagctggcttggcttgttatcctagcaagccagaccgagccgagccggctcatatccacccctatgtgggcttggtcgagatcggctcgttttagcccctgacgatagtaaaacaagggatcggtcggcggctcgcgaagcgaaagaaggaggaggcagttttcaattttcacacgactgcagcgccccaccctttcctactctttttatttccccacttgtcttcccccgtgcggcgccacacctcttctcatcttctcctcctatcaactccctctctctccaccgctccgcttgcctcggatcgcgctcgcgctcgcgcggagcagcgcccccaacgacgggcatggccggtgacagcggcaacagcgacggcggtagcaaccgggatgaggaggtccagatacagatcgcaggtcaatcaaatctttcccccccttcctctgtcgaaagcctcactgtttagctatgtccgattttcttcgttgagggagtgggggtgaggaggttagagtcgtcttgcgatgggcggcggtaaacgcagatgaaatgaactcgttcgttctctcgggcttatttggtgttcgatggtgtggggaagtaagcccgcgaggtgttcgatgaattgccttctcgtgcgtggcgtgttggatatggccatatgcccatatgggatttgttttttgtttatagaccatattaacttttcagactatcgtgacatcatcgagtggcagagtaggcatgtgagtttaattggcaaacccctgttgttcgcgtacatgagctggataagtggttgatgatagcaccagctatagtaatgcactgcatttaacaaaagtaaaatctttatattagtttttttatattagtgcaggatttccctgagattccaagtaactcgctttcatttgatagtttcaccaatggacaatactgtaaggatggagctatagtcttgtgttgctcgactttctctcaataaatttagagcttttggggtttatatggccaattgttggggggaaaaaaaggagaggagggtttcacttcactatgggaactttggtagtctattttgaataggaaaagaaagtttcagttggccgtgctatgcttaacacatgaagtttgggctaacctgttgatactgcctaccttctgtaacttgcagattcatccaaagctgcaacttcgtcaactcatgaagtacctatacagaactctcctgtcaagagttggcaatggtggctga

SEQ ID NO: 45541 - DNA, 436 bp, Oryza sativa
gatctagtttttgctagattgaggtggttggcgactctaggatcaccgcaaagcattaggtgctgcgatcgtggttgtcaacttgtcacaaaaagttgccaacacgattttttgacacctctttatagatttatcctgaaaaccttccgttttgcccacgagacgggtagttacctagaaatcggctttgctagccggtttagttatcaaaacccatcttggtctagtttttgctagattgaggtggttgatgactctaggatcaccgcaaggcattagcattaggtgctgcgatcgtggttgtcaacttgtcacaaaaagttgccaccacccactagagacaaaagaaacaccaaccaaacaattgagcaagaacaacatcatgcgaggtgatttggagattgacaaaaaaaaattaaggaagagcaaagggaga

SEQ ID NO: 45542 - DNA, 198 bp, Oryza sativa
gtaattatccaactaaaatgcgactgaatggtgggctgtgggtgcatggttttgctagtcgcacccaggcaattaaggaccggttcgcgggatgccttggaagaacttatcgtacttaccacaagccagcgtgggcaacggctgggcttgtagtgtagctttcctctagtcgacgcatccaggcaagggtgggcgtga

SEQ ID NO: 45543 - DNA, 312 bp, Oryza sativa
tatattctgatttttgacacatgaaaatgaaattaattctgcaatgaaagttagcttacaagttgcaatctcactactttgtctcatagcaaggcgactcttatctttgtgggcagattagagcattaaaatatggatctgcaccagtacagataaactttcccagtaatggatccaggtgaaaactgcaaaatattttatagatgtttgatgtgccaattggcaattatgtgttgtcaagtttactaagaagtggcaaatatgtgtttatgtgtacttatggcactgtgtttaaatttacttgtaaccagg

SEQ ID NO: 45544 - DNA, 489 bp, Oryza sativa
caaaaagagttgacatggcttctctcaaaacaagctttggtgcctcaattccaaaatttcaacaaaatattttttgcacaactattgtatttggatcagctgtccagttccatgtatttgtttagaaaacaaaaaagatagtgatcatatgatgctatgaattgaattagtgatttgactgttccttttttattagagggtaagttgacgaagtattcttaaagtggtctgatggatccctgcctattcttgaatgaatatttaattatatgctgtcatttctcatttagttactttcaactaatactacgtgcacattcactttttcttctagtctagtattccacgcggcaaagcaacgtgtactttctagtcaaccaaggcctagtttagctgaggaaaattgttaggtttggttctcacattgaatatacggacacacatttaaagtattaaacgtagttcaataacaaaacaaattatatattt

SEQ ID NO: 45545 - DNA, 1335 bp, Oryza sativa
aaacttttatatatgtgtttttagttacttaaaagccaatgctgaaaaagaaactacgttgaaaatatctcaaaatcaatctcaaaattaagtttgaaaatttaaattttggcttattctttggttgtttaggctatccgatgggagccgtataagaaatctatgtaaaaaaactcgcatgctaacttgatatgattttctagagaaatatatatctaagcgaattctcacagtgaattcactactagaatagtgaatgtcaacgaccaaaaactaacgacggctgcataatcttggtcgttgatactgctttgggccgatttctggtatccgacgacgctagttttttgtggtcgctaatgtgtagtgggctgcggtcgttgttgttatttactcaggttggatgggcaattgcaaatggtcgttattactcagcgacctgtgtcctcagctctccggccactgcagccgccgccgcactcggcttcggccaccgccgccgccgctgccctcggcttcggccaccgccttcgattcgctccacagctgcaagcctgcagctgctgcccatgctccctataactttgctctttgctgctctttgccatacaaaggaggtagcggcacagcgggaggaagaatccccatcattggcataggaacagtctatcagatcccctccaatccgctgctcccttccaaatccgaaatcccctcttttccccaaacatatttcgccccaaatcaatatgaatcaacagtttttgattccaaatccgagatcccctctgctacccccacatatttcgccccaaatcagtataaatcatgaggttgagagatgagagaagtgttgattcaccgccatgtctcgtagccgcagtttatcaccggaggtgacaactaggggctgcatcgaatggcctacatggtctcctcagggctcccaaatgtcaatccttcccaccaatgaacatcttgatgccaagctccaccatgagtacatctctccacctgatctgcccagccactctgttatttgttccagttcacttgggactcatcaatcgacgaaaatagtcacaacaggtattcttcaatctcctaatgtaaacatttgcatatgatttgtgaaacatattgaattatgtgctaggttaaatgttaaatcttgccaggttaaagtgttggttgtattgtccacttcgaaactaataaaagctgcaaagtttgctaggtggatactgattatttctatgctgccctcaacctgaaatgtttgatatggtcctgacaatttattgttgtggtagctatggcactttcattagcatt

SEQ ID NO: 45546 - DNA, 1501 bp, Oryza sativa
atgttaacaccaaatttagtatagtttatggatttgtcgctatcctgcgtatctttgttcttgggttaagaggtttagacaaccaatccaacactgtcgtctagttataaaaatgtactctttagtataaggtcataaccgatccaacaccatcgggtgtatattcggcatagttcatcaaggcattaggtgttagaggatcgaccgttcaaactagttatcatagtagaagaaaacaaccattatatttctttcaaaaaagacaataaaatatatgccgtgaaatatattgtactaaaatagtgtatattgtaaatgaattttaaggtaaaaaagaacagagaaaatgtattgtccgattatgacaaaaatgagtatagttacaaagtttactccttcgtacaaggtcataaccgatctaacgccatcgggtatatcggcatagttcaagaagccattaggtgttagaggattgactgttccaacaagattattacaatagaagaagacaaccattatatatagtgcataaaactttgaataaacacaataaaatatattgtactaaaataatatatattgtaaatgaattttgagttaaaaagaacagagaaaatgtgttgtgagattatgaaaaaaatgagtctaaaaaaattattagtacaatttcacatcagggacattaaagaaaataagttgtggctttttaaaaaaatttcagatgaatggaaaaaattatggcgggtgattacataccttttttattttttttggcgctcaaaggaggagttttaggcatatgtccatgtacatatctcctcctccattcataatagacccaatatcttctcccctctcacatcccctccctcactagattgagagaaccacggatggagcgctaatcattggtgccgatcggctgatcctctacttctccagcgcggcaccgtgccgcgtggcctcatcgcgctactgatccggtggttcccgtccgagtgcttcttcaatcaaaccctagaaagttctactacaggtcactacttctccctttgcattgaaatcatgtcgtttctgatctggtgcctgtcctctatccttaatcaatccatgatgtttggattctatccttaatcaatctgttgcatgtccgcatttgttagacatttctgaattgttgttttttgaatcaaacatattttatagcgctgggctgtcactttttttgtgtatgaattatttcatctatagtcaactaaaaacagaatgcagtgcaattaatcatattgccaaataataatttatatgatatctatctagtcttgacattttacctaacagtgtatcgtaactctcctttgacattaattatatatacagggtcatataaaacttaatatcaactagcaattagaggggatggctccaagcaaggcacggatgggccttgtggacgatcggctaaatcacgagtacttagagggtgtagagaagttcatag

SEQ ID NO: 45547 - DNA, 1501 bp, Oryza sativa
gataaccaaattcgtcaatgtaatcgaatatgaaccaagaagcttgagtaaacctgaataggaaaaaaaaatgttagtcccattcgaaaaaaaaaagtagtgtggtttttcatacatgcaagacaaagtaattgacatttttggtttggataatggctgcgggaaacgggagggtttgctggggttttggacacgggggagaaaacgttttaagaatggagagacgtattctatgagaaaccgccttcttagtcaggaagcggatttacactcagtaaaagcaatataaaaacgacatctcacattctcaccacgtcgtcctgtatccatgtcgatgtttgacctccaagcacagaaatgttggaggaattgtcacccctttccattcaatttatacagtggtttcggtgaactacctggtcggatttattttctaaagaatacccacgtctcaaaataataatccatgtgtatgcaaaacaatctcaggaagttacagcgtaataccattataccactatattatcttgccgcacataaatgcggtaattccgagtcaacagttaactgctggttcagcacaaataaaaaccaaaccaaagaagaacagcgaaaaataatatctgcaattaaatgagtccaaaaaggaaggaaaaaaaattaaatgatcttcccacatcaaaatgcaacgggccgctactatttatgtacattcccgcatttcttccgatgatgccactgcagctagtgttactgatcagcagctctacatgtttttactaattaacaagaaaccgtattgatctttgcagggaggcatcccagtcttctaccagccggagccccgatgagcttgaagagtctccacggatttgccggagttgagtagtagatgtcgacggggccattggtgcagttgatgcttgagtcgacgaccctggtgtgacggcgaccacggtggcggtcaaggtagacgacgatgatgctgatgtcgtcgtggaaacggcgcctcacttctctatcgtcttcagatggaagttgacctccctcttcctcgtggcttccttcaaagcggcctttaccactctgtttgctacatcctacatgaatattcagaggaacttggtgttatctcattgtgtgattcctcgttcattcatggggaataaactcccgatgatggcatgatcgaatgctgtagatgttgtctgaacttaccgttcttggattcttgaagacaatctgcaccgcagcgtcatcgctaagatgctcctagggaccatctgaagcaaatatcaggaacatatcatttggtttcagcttgcgaacttgaattgatggttctgcactaagagctagctgctttagaggaatagggggaccaatgctacgaaacacgggatccatgctatactcttgttccttcaagtaaacatcaccaatggttctcgatacctgacagtagaagagtaaaattttagcccatgtctctagtatttga

SEQ ID NO: 45548 - DNA, 198 bp, Oryza sativa
tcagtttgtcagaatcttgtctaaaattcccagttaagttccaggattatatttaatcagcaaagaatgtgatacaaactaatcagttctacctaatctttttgtatttgagtgttacctaaattcagaagttgttgttagtgctaaagctaaactcatagatcaatttttccccctctatgattgggaaattattct

SEQ ID NO: 45549 - DNA, 272 bp, Oryza sativa
gattccggcctccgtacggtccataacagtttgtccggaatgggattctggcccacccttcgtaaggtctggacgggattacggcctgcgtgcggtccacataagttgctccgttatcaaaactagtaatatgcccgtgctaaacgctacggtgtatgtctttaataatttttagaatttcatgttagaaaaagtttatatgatctatgcatttgaactttaattcaattcatatcctacataaaatatatttcatgtaaagtgcagtacta

SEQ ID NO: 45550 - DNA, 774 bp, Oryza sativa
tgggaagaagagtataaagtaatatagcaatacaatttagaagtaaaattcgaaattaaaaattaatgaatattgaaagatgagtttaagtccacatagaaatataattagaaataataaaaattcagaattaaaaaaatattattggaagaagagcctagagtcaactccctacgtcccaaaataaatcaacttctacaattcaaactttgtccgaaaataaatctacctctaccttcttatctactctcggttcacaaatcaaaaaattttattcctttaataccccttacctacctacccaccaatactaatttactaatattaaggggtagtttggacatttatcctctcctttagtgatgcattgggatgctagaatttgtctctttgtggaaaagagggagtatatagaaatacaatttacagataacaaaaattcagaattaaaacaaagaaatattgaaagacgaatctagagtccatataggaatataatttacaaataactaaaatttaatattaaaaataattaataactaacatgtatgtaaaatacaatataaatattacacattagtagtttcgtaaagttagtacaaaatttaaaattatgttgtcattttaatatatttgaataatacattgagaaaacatgtatgttattctatgagagaaaataccatgcgttagtattaaaataagagggataccaatcacatagtgaaaaaaagtgaatgggatcaactaaaactatttctgtagggtatctaa

SEQ ID NO: 45551 - DNA, 300 bp, Oryza sativa
acccctcggggagacagagggaggggtggccacatcttcctcgggcccgacccccccgagggggtcaggccacgtgggtgaccgcggctacccaagcctctagtcacgatacccccggccccatgtcaccgacagtagcccccggcgttacgccagggcgatcgcccccctcgagggaagcgctcgggcgtgacgccactctttaggcctggtgacaggtggggccggtctctacaggtgggcaggaacccagcggtcgcaagtcgcgcgcatcggcaagggaaaatcgaccgataataa

SEQ ID NO: 45552 - DNA, 1115 bp, Oryza sativa
tgtggttttggcgccacgtgtgtgggttaggtgagcacagcggggctcacctaaccgcatttaaagcaggttggacgagcgcgccacgccgcatttaatgcagcgcagcgctcgcttacccggtccgtgaccggtcgcagtggtgaccggtcacagaccggtcggatcgcgggttaggtggcaacaggcggcctgtcacacgcctcgccccgtcccgtcggaatgatgagagcctccaggcactcgtccctagccggagccggcgtgctaactcctggagttggcacgtcagtcccggccagattcataccaggcttcattgcaaccattgcaaggaagtcattgtatgaagaagggcagacatgtggcatgctaaactgacgcgtggtggacaaaaatgaccggtctgtgactggtctgacgccggtcacgtcatcggcagacaaccgtgctcccacgttgcatctgcttccggcggagtggaggtagatatgacccatcccgtcggagggtaattcggacagcggcaattgcaaatctccgcccattaatgaaggaatgacaggggtatcccctgtgtcaggcgagtgacggcgctgagcctcactcaaggacaagctgtgatttagcttccaggagaaggcgcgtgccaagttttggtcaagatagggtgggtccccacccaaaagaagagtaggtagaagtggtgcatgtggtatccccttgagatataaaaggaggaccttgcccaccgaagaagggggactggaggacgacatttagaatagctgaactctcttgctctccaactctctgtaactctttcacacacagatccaccagaacacaggagtagggtattacgcttctcagcggcccgaacctgtctacatcgcccgtgtcttgtgcgtttgctctctctcgcgaacattccatagatcgagggtgaagaatctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgcgccaagcttctcccgctcagcccaa

SEQ ID NO: 45553 - DNA, 501 bp, Oryza sativa
ttgttgggtgaggaggtggtgttctttgatgttcggaagattcttctgacgaaccgcctactggggtttgttcggaatcgaatcttggggtggtgattaggagcaaagagagagatctcgatgctaattcaattgcaattggatgttattgtttgatgcaaacgacgttaaacctggacgatattgtcgcatccagttgaacctgtagtacacttgggctgttcttgattaatccccatctccttcctcctcccaatctcgtctcctcttgtacccaatcatccatccattgccgccgctttcgtggataaagtgggatttttttttcgtggtatcttctgaatttgacgtacccagtttccctttcatattatcttgctattcatgttgcgaaatattgatttctccacaggttagagaaggaagttgtgagctttaacaccatgctgagattactgttctctttgggaatttgcagatagaaaggagaagtgctcaaaa

SEQ ID NO: 45554 - DNA, 262 bp, Oryza sativa
agatatgaccaatccgtcggaggtcattcggacagcgcaaatgcaaatctcggcccattaatgaaggaatgacaggggtatcccctgtgttaggcgagtgacggcgctgagcctcactcaaggacaagctgtgatttagcttccaggagaaggcgcgtgccaagttttggtcaagatagggtgggtccccacccaaaagaagtgtaggtagaagtggtgcatgtggtatccccttgagatataaaaggaggaccttgcccac

SEQ ID NO: 45555 - DNA, 349 bp, Oryza sativa
acgtctgtatgtctagtgcctctgataagtaaaaaaaacacgttttgataagtcaattgacaaaactgtctttgattgcctctgtttgttgaaaaggtggttattttacaaagtactgtataggctattttatagaaaataaattttaaaattttaaaaaaaggaaatttgctaaaaaaggaaaattttgaaattcctaaaaaaatccagaaattgcttctttaccatttaaaaaaaaatcttgtttaatttaatccttttgggagtgtcttttccttaacttgcttgtgcaatcaacttgaatcaatgcattaactctctctctccctcttatcatgtgttctctaga

SEQ ID NO: 45556 - DNA, 1501 bp, Oryza sativa
  unsure (1)..(1501): unsure at all n locations
ngtctaatgatggcgcttatcaaagattccttcacgtcatgtaggtcccgcatatcaatgacatataaaagtatgaaagtttgccttatactagtttaaggtgttgctctcaaatcccatatccaccgctattcctttcggtcaatttgcatatctacctctcctcctgtcctctatattccaccttacatatctattgcgacaccattctccattcgctttttcctagttgtggtggagctccattccacaacctatctactccacgctaaggtttacaaaaatgtgcgatcaccatggttatcgcgtgcagtaagcttctcagtttttaaaatcacggtatgcatcgcggtaaccgcgtggttaccgtgataaccaccaaaccgtggggtgacggtaaccccacccaaaacggtttggtgaactctgctccgcactgcctctattaatcagcttcaatatacacctctaacaactttaccagcctcgatacacactaaagttgtcgtctccacaatagtcgccacaagaagccatttgatctatgagggaagaagacgatattacattagagggtttatatggtgatagcgattgtccatggatcagatgaacttaatcggccacatcgtactcctcggtgattacctttgcactcgaactgattatattatgctggaatgctggagttcacggcttcaatgtattacatatgaccaactttgtggttgctcatttacaatattgatcgtatctgttgtattagcacggatatattactggtgaggaaaagtgatgaactcacaatcagggatatacatagcaaactcaagtataaatatgtttgtcaagctttcaccacaattagtattgtacagttgtttctccaaaaagatcggttattgaactcttttctcaaaacagccaaacttttctaccagaacacacatttgggcatgtttggggagcttctagctgctgcagcttctcccataattaaaagctcccccaaacagtccagcttttggtccaaattttgagaagctgtagttgtagaatccagataatgaactagaagtcagaagttggaaaacctagcttttccagattctcagaagctgctaccaaccagctacttatcagaatcttaagctcccctaaacaggccaaaaacttcgtattcaaaaatttatatattgtccattatatagaatttctagagaattgtttagaatagctccccgtgcgatgaaaattgcaggcattgaggtgaacccagtttctggacaagaaaacattgagaagcagctttcagacaacaccaatactgtttcccagggggtcatgggtgaaagtgcattaatcctcctagtgggttttggtgattaatgacaaatgtggttaagggtctaatgagctcattgagtagctttcaggtgcattagtccaaggtgtgaaagatggatgcttggagacccctcaaaaagtacaaaatcaaagt

SEQ ID NO: 45557 - DNA, 1501 bp, Oryza sativa
  unsure (1)..(1501): unsure at all n locations
catatgtaatacattgaagccgtgaactccagcattccagcataatataatcagttcgagtgcaaaggtaatcaccgaggagtacgatgtggccgattaagttcatctgatccatggacaatcgctatcaccatataaaccctctaatgtaatatcgtcttcttccctcatagatcaaatggcttcttgtggcgactattgtggagacgacaactttagtgtgtatcgaggctggtaaagttgttagaggtgtatattgaagctgattaatagaggcagtgcggagcagagttcaccaaaccgttttgggtggggttaccgtcaccccacggtttggtggttatcacggtaaccacgcggttaccgcgatgcataccgtgattttaaaaactgagaagcttactgcacgcgataaccatggtgatcgcacatttttgtaaaccttagcgtggagtagataggttgtggaatggagctccaccacaactaggaaaaagcgaatggagaatggtgtcgcaatagatatgtaaggtggaatatagaggacaggaggagaggtagatatgcaaattgaccgaaaggaatagcggtggatatgggatttgagagcaacaccttaaactagtataaggcaaactttcatacttttatatgtcattgatatgcgggacctacatgacgtgaaggaatctttgataagcgccatcattagacnttaaacgaaaacctctttaaccttccaanaaatttncccaactagattaacttgacaaggtaataagtgacatgaagtaaactcttggagacgaccttaaactaatcaattggatcctttataaaaataaggaaaaaaaatcaaataccccttataagtcacggtctttctaccctctccctacatcttacttttgtataaaacttcccctacaagttcaatttttcttccagtttctcaacttccattacttttcaatgatcttatcatcattggctcaatccctcgtgacgcgtgggcttctagcaagacgagatgaggttaccccatgtcacctctaaagggcacctatctccttaccaaccatgaatcgcactgcgctgtatatgtttcgaacaccaccattgtgttttgcatcgaggtttgccgccatgctcgcgggaggtaggtggaacccacccttgcaaaagatgacacgaggtaaatctattatttttccatgtcggttgcccactaaggcacgagaaattggaaaaaaacaagtgaaaactagcggcaagtggaaagcaagaagagatggatcaaacttgggggggaggggagtcttttgtccaaaagtgaattttataggggtatttggatttattttttatgagaaaataaaaactaatcgattggggaccacttgccagctccacgtcagcccccatccccgggcccacaacccgacaaagataaaccccatgacggagaggaatcaatcatcaagataacgaagagtcgagg

SEQ ID NO: 45558 - DNA, 449 bp, Oryza sativa
caggtacagtggcggtcagattggcatcgaggcaagtttgtgcataatctaagttagactattgtgaagcatgaaggtaagttttcaggtaagtctgattctgattttattagtgcatatgtgcctactggttctactggtcatgtgactcagtgttggattccaaaatttcttatttcttgtaatgccccgagttttaaattaatatatttcgcggagtattagagcaattgcgcaaaagttcaacttttaaaccattgttcgtataggcgattgggaaccgtggatgcgtagagctcgccgagtagtgcaaaatagactataaatttatagtaatcggagtccgaacgaagtcccgaggattaaatagatgtgagccgttagatcttatttagtctctttatataacccacaaaaaaaacaaacgaaaaaaaaaacaggagaatcgc

SEQ ID NO: 45559 - DNA, 1501 bp, Oryza sativa
  unsure (1)..(1501): unsure at all n locations
tagaaatttcggcaaaatctcccctaaaaatacggacatcacgacaggcagttataagaaaggtcaataccgatataagccacacaatccaaaccatcctagctccacaaatcccacgtgaaaaataaggatcagaaccttaaatgacctttacaagttctatgcaaaacttttgctgagcaaaaaatagtctaaaactaatttcaattgtgtgcaataataatgtgtagtccaagggtgctactcccgccccatgccgatcgatgtcattaggtacctaaaaaccaaattaaacacaagagtgagtaaagaatactcagcaaatacaatcttgaactagtaaaacatacgcatgatttatgcattaagaaaccaatatgaagggttggatttactttatttttaaaccaaagaagtcaaaagatagtagttccctcccgggcaggtctgaatatcctcttagcattaccggtaagccgagcaagcgtgatcagcgcttctcaaggatcatgaataaagacccaaattgcactcccatggctacgcatggttcttgaataatgtaaacagaacatccggaataatgaaacatgaataacgtcatgaatttgaatatgggtcgaaacacgaataagtagcataacgtcagagccatacaatcagtaatatcaagcaattgaataataattatgcaagtaaagccaaacaaaacaactcagtttgtccatcacataagtctgtcttgtacttgccttaactccttcgatactccgactcaactcctccaacgttggaacccttcacacctgtggagcaaaactacgcataaaccactatattcaactaacgatggttacaagggatatttactaaaatcgaaacctagaacatataaaccttttaccgatttgattaaataacctatagctgntccattactggtttatgcgtaactcacaaaccgtctaacggaaactagcaaataatacaacttcagacatctagaaaaaattctctacaactttcatgttgagcacaaaatcagattatgcctctgaaaatcccagattaaggaaaacgaactactgtcctgagttcctgtctctgtcagcagnattggttttgctgtttctcctaaaccggttatcggaatcgagtgaaactagcaccggtggaaagatatcgacaatgactacaaactttatttaggacaactaacccgattcctgatgggttaataccagatttgaaaatacggtttcagcctagcggtcgatataaaataaaattcaaaaaaccgggaacggatcgtctttaatataaattagaaacaactatagactaaaacggattacctagcagtactaatgtataagaaaaacgaagaatttggaaatattcaccaaattccccaaatttcccttcttctatcaaatttccccttctttccttccttcctgttcttctctgccttctctccctccttcctgttcgttgcagg

SEQ ID NO: 45560 - DNA, 1501 bp, Oryza sativa
tcttcaacctgtattagcacgcagggaatgtctaaaaaggaattcattgaaaatgtcataactcacaaggcactttaaaacatgattcatcaattcagaactgtattcttttaacagctaatttgaaatgttacagaaattaacaaaccattactaaggacaaacggtgataatccttgtggatcaaaggaaatgaaagtatagaaggttgcacatacctgaaagaagacaactggataatgtcacaccttattatgcctctcctgtataggacaggtatctcagtgatcatctcctgatgcccttgttcattaggaagacaagttggtccttaaccctagatttcttgcatggacagtaggagtatcatctgaaccagattatttgataattggagagcaagttgctgtctcgaaataatcagtggcaatagtaataggattagatgcttacttgcactgcatgtaaattcatacattaatattccctaacccagagcagttcaaggtagtttacaccatacaatttagacatgcaattatgtgagctagctaatatatgaattatccaattgcaatgatgagcaaaggttaattaaatcgtaccaaaccactggaattataagcataatgtacaaagctgaatcttgatgagtttccgaacagttaccaatgatccgaacaactgaacgaacataacacgatttacttgtactgcccatgagcctagtaggactaataaactcaaccatgagcctagtagggccaataaactcaaaggatcatgatcttcctgaaaaaaatgttaaatgaattagaaaatgaggcatgccaccgttgtatgttctctgaataaaacaaaacatatatcgagaactgatgcaaatgtagaaagtttaatgcaacatgattcaacggagaaataggtgcaccagaattccatctatgacttaatgcttgggctaggcattttgacaagaacctccagtgcataggactgtggcttacctctgggctgtggcagcatccacagatcttatgtgcaggtgtgctggcagaggggatcatgtacgtcttcgatgagcggcggacagcggacgacctggaagtggcggtgacttggcgacaggaattcggggcggcgcggggcgtggcggcgagcggcggacaacctggacccgacggagacctggcgacgggagttcgacgtggtggatgacccggcggcgggcttcggcggttgtgagattgaggggccatgggcgagaatctcgccgcgaggttggtgggggatgggagttatgggagagagagagggggaggcggggagggagactgatctagatcgttgtttctacagccatatgatttaggccgttggatgtgtgatatgatgaatgatgaataatgatgatgaatctaccctatagttgaacaaatggttttactcattcatcattgatcatatcacacatctaacggtgtaaaatcatctgatgagt

SEQ ID NO: 45561 - DNA, 1501 bp, Oryza sativa
cagatgaggagttccttgaagatgaaggctttggtgtctagctcgtgcctgccgtcaagcgcctgtggtcgtcgccctagtcttccgctgtttctcgttgtctttgagtgtgctgggccttcgttgcccgtgtaataattttatttacgcttccgcttgttaaactctgaattgtatcaacttttggtgtaccttgcctcctgggacaaggaataatacacgcacgtcaggaatgcctgttgggtgatttccggtcgtgacaagttggtatcagagcctcccttgaccctaggacgagccgtagatcccaagccttagctatattttcaaaaataaaaatcctctgttatttgtgaaaacccgctattctctctttgtcttgctgcttcacttatcatcaaaatctgatcttttaaatgttgcttttcttttgtttttgtttgtagatggccggcagcgttacccgtcgtggtttgcacatgactggcttcgtcttggagctgcgaggcatgtgcgtggtcttggggtatccacatggagtggattaccaggccaggccgctcccggatcaggagggtgaggatgcagagcctcacgctggttgggaggtcactgcagtgatcctctccggctctcccgagcggacttcgctggcagtcaccgcgggtggagattccttccccgccgcttgccagaacgccgctctcctcgccatcggcacccttcaccagcgctacccggacgagttgcagcactcgccctaccgctaccacccccgtcgcggaggagccagcgaccacgccaccttccgagacgccagctcggaggatgacgctaccgtcgtgcatctggcacgcatggtggaggcgtacgacgcggctcgtatcgacttccaccagatggtgcgtcgtggcatggtggagaacaacctgaagatcctggagctgcgtcaggagaacctgcagctcaagaaggacctcgacgcgttggaggcgcagctgcatcagctcaagatcgcccagggagagatcagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacaccggtgtgtggtgtaactatgtcggagcctgtcttattttatttgcctaagcaacttgaacattaatgaaccaatttaatagcagtaataaattcaagaattatggtagtcgtgggtggttagttttaattgttagctccttctctgtttgctggttctgtgtggggtttttc

SEQ ID NO: 45562 - DNA, 939 bp, Oryza sativa
gcgcgccctcgcggctgccaagtgggcccggccgccagccgcccgcgcccgcgggtgaggctgacgcgcgggacccacggcgccgaccgccgccagccgcgtgcgcccggtccaccgtggaccgagcggctgacgcgtgggcccccacccccatggacccggtccgcgcgtcccctccctcggctgacgcaataaatgggatttttaattaaaatttaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgttattgttattattactaccttgttcaccctagacaaacaaaacctcaactagtggacactctactcatggtatccctagtacaattttaggtagatgcttcgcaatctaattaggtaaccttaggtggttttacaactatagactttgggaaatattcatatcacctggatactctggaattgttggtttattgtggaattggcttcacaccgccccctctattcaaaatcccctaaattggttttaggctgggctcggggtgcatggttttgatagtagcacctcggccgtttaaggaccggt

SEQ ID NO: 45563 - DNA, 957 bp, Oryza sativa
caaagtatttaatgaaattttatctggcccaattttatattggaatttattaattaaacttagatcttctcttcaagacttttaaaattatttctagaaattccaattaaacaacaatttatatattttgaattttcagggtgtgacagtcgccttcaaacttaaaatctgagaaacttcttgtgtaaaacttgggttttacaaaagacttggaaaacccgacacctgggtcggtgcttgcgaactaaatgaatttccaaaatcgcggaccgaggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgccaagagacatgtggattcgccggggtggtgtcggggaggacctctgggcttcctggcacagtatggtctgggacctaatctggtgttggtctaggacccctctcgttggcatatggtgaacctgtgttggctttcgaaatgccttgtcatgaaagccttaaggtctctagtcgtggccgttctgcacgggctggatgatccgggttagtaatgtcgtgtgggtaaagtgtacccccctctgcagaggttattaaaactgttcgaatagccgtgcccacggtcatgggcggatgtgaggtgattcctagcgtagtttttgtttgactactgccttgtgaaatttgctgttgtggaatgggtttgatgtttggaaaatctgcggctgatgggatcagccaggcctgggtggccgtttgaaagctgttggccgggtgccaatcttgatcaattcaaaagattgaatcattgcacatactccgaccggacgagacgcactgtctcatccgtgtcgtttgagaagcactcccttagttgtttc

SEQ ID NO: 45564 - DNA, 1501 bp, Oryza sativa
ggaatcgtaaaagaaatctgtttaaaaaactcgcaggttaacttgagatgattggactctaattacaactcataattttctaacaaaatatatatccaaacgaatttaacacaatgtgtttcatcttaactaaaccatatatctctatctcttctttatctctatctctactattataaaaatttaaggtgtttttatcgagattttagtaggtcacccgtgtttaaataggttttaatttaatgtttccatctgagcgaattaattgggccgccttaaaaagaaaacgtgtccgattcctcgtaagaactaagaaaggtgaaaaaccatccgtaaaaaaaattaaaaaagagtgaaaaagtcccccagaagaaaagtctgattcccccagagcggcgaaaaaaagttcgttccttcaaaaaaacaaaaaataaagatttgttttgtatgcaacaataaaaaaggcagtccaccagtccgtgaaaaaaatccatccaaaataataaaaggcaaaaaaaaacaaaaaaatgcttcaaaagagaacaaaatgtttccgtcgtaacctttacctattataaaaattgaagataattttatactcatcgaattttcgtccgccgtcccttcattccaacaagccgtcttgttccgattcatatatgtttttagcattttgaccatattcacgtttcctttttttttttctctgcacatccaatacgtttttgcacatatgggcctaaaattgtaaaagggcccaacgtctatcacaatctgtcttcctatttcgagctgtctcagtgaaaaatattgcctatcttctaagcatatgttacatactatttattacagatttgtttgtgttatttcaataattttgtacacatgcaaatgaaaaacatactaatttttgtatgggtggcttgcatgcatgtccgtttattttgtgaaggattcatctacacatgattctttttaacataattttttcaacatatgattccgttcggccatttaggattaagtgatttattattaaaactgaagttgtttccgctgtgaagttgtttccgctgatagttttagtatgttgtccgtatttaagttggttttaaaattcgtttgcttttaaaaatacaagggtttcgaattggatatcatatcaaaataaaaatcccatatactttttagacaaaaaaaaatctaacaataatacaattaaaatagtcttcacccgttgcaacgcacggatattttttctatttaaattaaaaaaaaatagaaataaacaaaattagaaccagaacatggtccacattggacattggacattgggccttgctgcttggctggtctaatcaagccggtagtggcaggtcaccacatggggtcgtctggcgggttgtgcacgatgtgtctgcatggctgaaaaaattgccgcatctgcaactgcaactgctacaataatcgtcagttcccagatccatggacacctccactc

SEQ ID NO: 45565 - DNA, 1181 bp, Oryza sativa
  unsure (1)..(1181): unsure at all n locations
atgcagcctcaccatttcatttgtggcgagtaccttaattccatcttgccattatcgagggagtatatcatctgcacctaattctgtatatagagtatttattgactagggtcttggaaatttttgaattgctgtcagatgcaagttcctcagattgatgatttgattagttcacagctaataccattgatcacagctaacaccacttatagaagtttaatggatttttatctaaaaaggggaaaaagggaagttaataactgaaactgcatagtagtactatggtctctgaacaaagaaatttgttgagtttcctagcaactgctgggtgcattttcctcttgttatgtgtgcctaaccttccatccattaaatttcaaaagtgcaaattctttgtataggtattactgggactcaaatgtacacctttcagttcactctcaattttgtttctgaattgtgtgtctgctgatgcttgcttctgaattttgtatctgaaggcgaatcattgcttctgttttatgtagtcctcagcttgagtaagccaggaaattatgcactgtgttgtcaaaaagctatgcactttgttattaggagttgtttaaataataatggatccccttttgtttccagccttggagatcatccaggttctcagggggtcaaccctatcaacatatattttttaatcatttcaggaagagaaatagagaattattgcatgcattcctttgatatcaaagattgngattaaatttccagcttaatcctgacagccgcaatgtgtcttgtgcaaaaggaagcaaggctgcaactgaaacacggtgaatagtaaataaaaatctcgcttttaggaaaaaaggtgagtcgtgcacaagtgctataatcttggtttggcaaaattttatcgatatatacaactccgttgctttgtttacacaataaacctgaactctaggtgcagcaggttgaagcattaaaaaagaagatggcagcaaacagatgtttgctttattgtattcaatacttggatattccactgtgcttcccaaattgagctgaataaatagcttgacgaattgttctcttaacatgtctcagttgtcttttgtatcaaatcagcagcataatccattcatggattgttctttttcactggtgatacagatagttacttctaa

SEQ ID NO: 45566 - DNA, 1432 bp, Oryza sativa
cttgattattagcttttcgtatgctagtgtttgaggtagtagttttggttaatacaagtagatacatatcaattcatgagaaccttggtgatattgttggcaattgggtgtctttttcaaaagctttgtttccttcttgatttttgtccggggaaaattgaaggttaatttgagagggggggttgctcttggtgttatcaagcaaatctgaaaataacaaaaaaaattaagaaaaggagagctttgtcttatgcattttgtatattcttgtgcatgctagcaatattatgaaggttcataatattttgccatgtattttgtatattcttgtgtatgcattttagtgtttttatgaggcttagatattgcttttaagtgagatggtgcatggcactaattcttttacttgaattaagaaaaaaatgcaatgttgaagctagtacatagtttggatgatgaatgcttatgtatatgattgttgaattgttattcctcaaattgctctttattttctcatcgtgcaagagaataaaataatttctatgagagaaaaaaaatgaatactgaatccttggaaacagtcttgacaacaaggacgtattcgatgtgagcgaaaataatgggtgccgaatcctcaaaaatagtcttgatgacaaggacgtttccagaataaatgagagaaaaaaatgagtaaaacaaaaaggctcaaataaatgttacaaattctattggttgttttgtgctagagctaatattgagaaagatatgtgtaggcttgacttttaaacctatgtgcttgtgaatatattgcattataaattatttgaaattatgaatattgattgttgatttgaacttgatagtaatatctttgattcatgattatactctagtgcatgcctgctatttaattgatgggttcatcttctttctattacaacacataacatgaattgctctatgtatgatgctaagctcttgaacattactaattaaaatgcaaatgcatgatgaaatcattgtcaaagggggagaaatatacaaaatgcatgctttcaaagggggagatttgaatttttttttgttaccaagtcaccggggggatttgaattgttttgcttttaaaaaatagtcgattttgtgctttgtttgccaatatgggaagaaattctttcttttgaaaaaggagagagtttttcttttttgcttttgtgatttttgagttgtttgtgttttttttatttgtttttgtttttcattttttaaaaacaccaaattgcattttgaggattttgccaatgtgttcatcacggagggattgtagagtcatgtaatgatttaatcatggtgatgaacaattgtcaaaagtaattattttataaaaataaggtgaatagtgttttcgtttctcgactttgtgtggccgattaga

SEQ ID NO: 45567 - DNA, 285 bp, Oryza sativa
atgttttatatctgtatataatgatttttgcaaattttactagtgcttcaaagaggtttattaaatctgttacccgatcatggtagaacagcaagtaaagccctctgattcacatccaccacctgctactccggtggacagccaggattcaaccgcacctcctgtcagaactcctgaccctgtttctcaggctacttcaaatgattctgccacccagtttgccagtacattccatgtagccccttcacctgcacctgttccaaatgctgttccaatacaagatgc

SEQ ID NO: 45568 - DNA, 179 bp, Oryza sativa
caaggaagtcatctcaatcgggccgaaaagtgcccgactgatatatggtcgcacagacatgttagatgggtataaaacttaagcccgtcacggatgatacccatcagtgacgggccacaactttaggcccgtttgagatatggaatgttatctcaatcgggcctaaagttgtggcccgt

SEQ ID NO: 45569 - DNA, 238 bp, Oryza sativa
gccgccgtcctcctgcatctctcctcgagctcgaacaaaaaaccaccgcggacgctatcatctccaccacgtccctctctttctccgcctcctctcgtcggcgaccaaagtaaaaaaaaaaaaaatacagaagcaccaccgcgcgtctccacgtcccagaagaaaccgcatcagcctgcgtcgccggaattggctaactcgaagaaccttagcttctagccgccagcatcatcaatca

SEQ ID NO: 45570 - DNA, 620 bp, Oryza sativa
caaggaagtcatctcaatcgggccgaaaagtgcccgactgatatatggtcgcacagacatgttagatgggtataaaacttaagcccgtcacggatgatacccatcagtgacgggccacaactttaggcccgtttgagatatggaatgttatctcaatcgggcctaaagttgtggcccgtcactgataggtatcatccgtgacgggcttaagttttatacccatctaacatgtctgtgcgaccatatctcaatcgggcacttttcggcccgattgagatgacttccttgtgacggcccgctatttctaagcatattagagcccgtcacagatagaaggatctgtactagtgtggcaaggacgagcagtcgagtagaatggccttgttccagcctgccctgcgctggcgaggttgcaaacctttaatgttattactacggtcgtcgccttcatctgaattacgcagaaccgccgatgcatcgtcccttctaaccgccgcctcgtcaagtgcctcctaatcgactgatttagtctcgtttgtccaacaaattttacctattaaatgacatgcaatttgtttcctaatttacttctccaccgcggtggtttcccctctcaggca

SEQ ID NO: 45571 - DNA, 691 bp, Oryza sativa
aaacataatctagcattacagtaagcactgtggagaaagggactttagtcctggttcgcaaccgttttttggatgcataatccgcccatctttagtcccggttgaaataatcgggactaaagatgcatattaagtcaaaaaaatgtgtgggatgtagaattcgaactaaagatctctcatctcaacccttacgtgcgttaccatcctacctactacacacatctaacttagatggcgatgttttctttttaaactaaccctagaggcatctttagtccgggttggtaacaccaacctggactaaatatagcctgacatgagctaacagctattgaatcgtggctaaaaatatgatttttggcatccgatcaaagatcagttctttaggagtgaagcctttatacttctataaatcatgttgatacgagatatttagcctctctaaataacgccccaagcatagagctttgtaggccattaccttaaggtaacacgcccctgccaacttcggaagcataaaaaagagccgtgcgataagcttccattccagcatctgcttcaaccacctggccatcagtatccctaacaacaaaaccccagccaccttgagcgggtgttatcatcaaaatcaccatcagtgcgttaaccttcaggttagggtcatctggtttctgccaaaatttaagcatga

SEQ ID NO: 45572 - DNA, 169 bp, Oryza sativa
gctcagtgtaagacgcagttctcctcccccttcgttttttttttcttaagtggtgtcaaatggtaatattgtttgagtgtatgtggcatagcatttgttttatggaccatcgccatcacctagcagaagtattagcgaacaactgaaattccagagttggtcgacacca

SEQ ID NO: 45573 - DNA, 154 bp, Oryza sativa
cgtataaaacctttatatacacgtatacaaagtttgtatatgtgtttttcatatgtacatatacaaaatttgtatatatatattttgaattttgtatatatgtacatatttttttacataaaaatatatatatacaatatatatacacacacat

SEQ ID NO: 45574 - DNA, 1501 bp, Oryza sativa
caatgacgtattcgatgtgagcaaaataatgggtgccgaatccctagaaacagacttgacgacagggacgtacccggaataaaagagaaaaatatgagcaaaaaggctcaagaaaagaaaaagttgaaaaaaatttttctcttggttattttgtgctaaagtttatttgagaaagagtgataaatgcaataagtatatgtgtttagtgtttattataaatcgtatgaaatcatgaattttgattgttgattcaagcttaattgtaaaatctttgattcatggttatactttaatgcatgcatgttatattatagatgggttcatcttctttttattgcaacacatgacttgatatgctatatatatgctaagctcttgaacattaatgaacataatttctatgcatgatgaaatcattgtcaaaagggggataagtaatatgaaaatttttggattgttggagaagcaaggtgaattttaggagagttgttgagaagagcatgtttttggttcaattgagaatttctttcttttgaaaagggggagaagttttcttttggatttttcgagcacgatgtatacgtttgtacgaagtgtgctttttaccacttttgtttttatttttccgaacaccaaaacatttttgatgggtttgccaatgtgttcatcaaggaggagattgtaaaatcaaaggtgtttttgattattattctgtgatgaacaattgggcatcggagattattggttttgttatttggaatttattcatgaagtggttttggagatgattgaattcacaggtgatcgcaggattctatcattttatgtgaccggtcaaactggactgtgtatgccggtcagaccggcggtgatcgagcggtcggaccggcgcagcccgcggtctgaccggctgactctgtgtcagtttcggtttcgggttgtttgtttggatatccgtgattatttcgtgattatgacttctagatggataccttacgtatataatactgttgtttgctactaatgagtcaagttggagaaagcttggtctcggaatatggtttctttgtttatttaatgtgtaggtgactcgatgcctcgggagagtatttgcggtgatggaccgggagtcggcttggggacaagacgacgtccgtggtggtcagagatcatgcgagatacctaggctagagttgatgcacgtggttgatggagattctatatggcatacgatggaggtattgtatgtgtatgggatgcggagtcgaatttggaaggagtccaaatttggtacgattggttatgtaaagtttctttcttgtactagagggtttcctaaggtgtttaggactcttagtatgagtttggttcgtggctttaggctgcctacctcgggtataaatagagggagagcgtgaggctttccggtatcgtttttggagagcaattgagttgagttttgagttagggtttcgagtttagtcgaaattttataaggagt

SEQ ID NO: 45575 - DNA, 1501 bp, Oryza sativa
tttttattatcatctaaccccagtactgaggcttcgacttctgcttgtgtgtaggctttggtggcaaggaaggagaacgtgtggctcgtggattccggttattcgcagcacatgaccggtgataaaaactgattctcctctctcaaaaaggcatctaagactgaatcgattatctttggtgatggttctacaagtgccgttctcggtacatgtttggttaaggtaaatgaaaattttgaattgaagaatgtagctttggttgaggacttaaaatacaatttgctttcggtttcacaaattgttgatgaaaattttgaggttcactttaagaaaactggaagtaaagtttttgattcttgtggtgattttgtgttgaatatttctcgctatggaagtgtgtttaaagctgattttgaaaatcctgtttcacctattataacatgtttggttgctaggtttgataaagatgtgatgttttggcatcttagacttgaacatgttggttttgatcatctcactaggttaagtggtttggatcttgttcgtggtttgcctaaacttaagaaagatcttgatttggtttgtacaccgtgtcgtcatgctaagatggttgcttcttcatatactcctattgtttctgtgatgacggatgcaccgagacagctattacatatggacactgttggtccagcaagagtgcaatgtcacgtcctgataaattcatcccgaattaaaaatcattttctaaaaggaataatagaattaattaaaattcggaaagaaattggcaaacactaaaatacgtgcaagaaaaattcaaatgtggcccggagaatttttgttaaattctccttggtctaaaaggagccctcaaattttacttgaatttttatagcaccggaaataattattaagcaacaaaaacaattaacaaagtttattaaaaagaaaaacctaaaaataaccctccttcctcctttgggccaagtctggcccaaagtcctccctctctcccctcggcccgcggccgaagtctccctttcctccctctctttctctccctctccttctctccctcctcttgggcccccttcccctcggcccagctccctcctccctctctctcccgggctgtctctcccccccctcccggcctgcccggcgcaagccgcctccccctcctctcctcctgggccggccgcccagcccaacccgagcggcgccctcccgcccgtgccgcgcacgtgcgcgcgcgtgcgcgcgcgtgcgcgcgcgtgcgcgccgttgccgcgcgctgaccgcgcgcccgaccgcgtggggcccacgcgttaggcgcgtcgtctccctcctccagccgcccggccacctctctctctctcccggaaacctagctcgctccctcctccaaatccgcttgattcaattggccaattccaaaattaattggggggttttaatccccattgaatcctcttcaattgcccccaaattcccccttgat

SEQ ID NO: 45576 - DNA, 698 bp, Oryza sativa
gcggcggcggcgctagggcacgggcgcggcggcgggcgcggcgggaggaaggggatgacaggtgggccccacccgtcagcgagagcggcgggcgggcccgcctgtcagcggcgcgcgcacgggggaggccgatgggccgcgggggaggagagagagagagagggagagggagggaatgggccgagccggcccaagagggaaaaaaaggggggaaacagacttcttttaggattttctttttataaaaccttttcactttgtttatttcttttcaattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagaagatgatttttattttgggatgaatttatcaggacgtgacagttttccctcgaggaaaccggtcagaccgcagtgggtcccgcggttagaccggcgaccggtcagaccggcagtacagaggcggtcagaccggccactgtacctcggttagaccggcctcggaggaatttttctgaaaattctaaaattgattttgcacgtggatatatgcctattggatcttctggtcgtgtgtctcagtactggtttcctaaatttt

SEQ ID NO: 45577 - DNA, 377 bp, Oryza sativa
attccacattttagttcttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctacctacggccggaacccccgggacaggcaggcaggattgagctccctagcagcaggacaccagccctgtgccatgacatctcgactaccgggccgcagctcgtgtagccttcatttgtcctaga

SEQ ID NO: 45578 - DNA, 182 bp, Oryza sativa
aggatcgtctttataaaatggctttgggcaactaagtgacttttaaatgctgtttactgcaaaacttaacccctatatcattaccccttgtacccccttgcattaatcgtgcatccgccggtgtggcttgctgagtactgtggttgtactcattcttgctctatctttctccccccttcagt

SEQ ID NO: 45579 - DNA, 198 bp, Oryza sativa
ctctctgggagcatctccgccgacctcttccaggaagtcctgtccccaacgtcgtacgcgtgcgtcgtctagcgcaacctcgagcaccagttcctcggcaactccgagcttcgcgccatccacctcgccgccgagttctacaccttcctccaaggcgacatatccggcaccgactactgtcgtcgtctgatgtgacca

SEQ ID NO: 45580 - DNA, 1501 bp, Oryza sativa
gcccgcttgtgacgtgtttgattttttttgtccccggtgatttgattcaaattcaatccgatcctttgttggttttgtttttttttgtgttctatatgttgtttcccgtggtcgtcctttcgccgtgttcggttgttgctggagcggatttgattggaagttcccaagtcgaggtctcaaggaagaggtcagtttcccgtctacagtccggtcgtttgatttagtcacttgggttcggtgattgatttcagatttgagtggttgattacaaccttcaatcgatggatggatgatcatcggtttctatcagtccttacacgaggtgattcgataccctgggttgattgttatttgtaaccgctgatctggcttgtggtatgtgtttgtgctcctctagatgatgcaggaaggagagtgcctgttgagatgaaccgaattgatggaggtttgattattatggtccaggttcatggttgctttgattattagttatattcatgatgaatcggggtggtggaggtttgcttgttatggttcatggttcttttgattagttcatgatggttttgaaattattctgacacgaaagtttgtggtgccgtgacaaccctcactggatttcctttggtcagatcctcaaaatgtgcagatttctaagtggtttcgagatagatgtacgagagattgtcagatggaatagcaatgctttgtttggattctgaccccccccccccgggcgcgcgatttgatttatgcctgaaaagtctgatttgggccgttggttgttcttcagaattgttggagttgcatctcatggtgagtcctatttgctgcatgaattggaatcatacatacaggccgctggcagttctttttgtgtgatcaacaattccccttaatcaaattttccatgtttttcgtcagtaattcttagttcttgagatagcacataacaaagatggaatttgcaacccaaacctgcctcggtctacgagctcaagacaggctttatccctatgcactcagtctttaattcatgttttctgtacttaggctactttcttccaaaataatattcttgctctctgtaggtctttgtcggtgacatgggaccggaggtatcatgactagaggcttgggcagccgctgtcacccacgtggcctgaccccctcgggggggtcgggcccgagggtgacgaggccacccctccctctgtctccccgaggggtcgggccgctcccgttttggccccgagggctggggtgccccgaccccctatgattttggcgccacgtgtatgggttaggtgagcacagcggggctcacctaaccgcatttattgcgggttggacgagcgcgccacgccgcatttaatgcagcgcagcgcacgcttatccggtccgtgaccggtcgcagtgtgtgaccggtcacagaccggtcagatcacgggttaggtggcaacaggcggcttgtcacacgcctcgccctgtcccgtcggaa

SEQ ID NO: 45581 - DNA, 1501 bp, Oryza sativa
accaagttggccacgtcatccagccaacgtcgagctggagtctctggatcggggacgacgggcgggtgacgcaggagcgcgcccgcagcttggagcgcgccctgaggcgtgctgccatcgccgtagacgaggaggcgacgctccccatctcgccgtccttctccatcgcccgcgggcgtcgaagtcgcggatctttcgacctcctcgagcgcctcctcccgcccaagacttcggcgagagggggacggtggagtacgagctcgacggcgcgggttctgctccccgtcgtcaccgctagcgctcggagagaggttgtgcgccactgcccgttcggccattgggctgagcgggagaagcttggcgcacacgaaagaggacgagggcttagaaagacacacgcgccctctacctggcgcgccagatgacagagcgtggggctcctcaccgggagaccgcgcaggcccccctttgccggttcggccgggggcgctaagcgagtttcttcgccctcgatctgtggaatgttcgcgagagagcaaatgcacgagacacgggcgatgtagacaggttcgggctactgagaagcgtaataccctactcctgtgttctggtggatctgtgtgtgaaggagttacagagagccggagagcaagagagttcaggctctagaacccctcttcctctttctctcctctacgagctcaggtattctccgagttgtcttcttttttctttttttgctttggtgggcaaggtcctccttctatatctcaaggggataccacatgcaccacttctacctactcttcttttgggtggggacccaccctatcttgaccaaaacttggcttgcgccttcccctggaagctaaatcacagcttgtccttgagtgaggcccagcgccgtcactcgcctgacacaggggatatccctgtcattccttcattaatgtgtggagatttgcaatggccgctgtcccaatgaccctccgatgggatgggtcatacctacctccactccgccggaagcagatgcaacgtgggagcacggttgtctgccgatgacgtgaccggcgtcagaccagtcacagatcgatcattcttgtccaccacgcgtcagtttagcatgccgcacgtctgcccttcttcatacaatgacttccttgcaatggttgcgatgaagcctggcatgaatctggcggggactgacgtgttaactccaggagttagcacgccggctccggcttagagacgagtgcctggaggctctcatcattccgacgggacagggcgaggcgtgtgacaagccgcctgttgccacctaacccgtgatctgaccggtctgtgaccggtcacacactgcgaccggtcacggaccggataagcgtgcgctgcgctgcattaaatgcggcgtggcgcgctcgtccaacccgcaataaatgcggttaggtgagccccgctgtgctcacctaacccatacacgtggcgccaaaatcatagg

SEQ ID NO: 45582 - DNA, 1501 bp, Oryza sativa
agttggtgtacacggtgtgtacacgcgagggcctgtgtgcataggatacgctccctttatcttgattggacttagccattctgtcacccatgtttgaaatgtccatatggctgtttttcttttaaaaatcaatctcatggtgcagcttcattaggaagctaaaacaggcattggctgtttatcaatctacaaagctgtgcactgaattggtgcacaaatatttttaagaatttcagggtagaacacagtcaatgcaaaccttccttgaattaactgaatagtttaattgtccaagcatctttctcctactggggctcaagatgtgttccaggatattgcaccctcatggttgagtagttttttgtatttctgattcaaaagcaccgtttgtgggttgacatcattttgtgtgccatgcttctccagagattctgattcttggttgtggtagacacatccaaccaatcagtcctgagctccgcaaattcattcggtcaactgggatgaagctggaagcagttgattcggtaaaagaccaaatgttccttatttacaacatcatcacttgtgtttgtaaacttcaatgtagcagatatttgtagtttgttctctacctacaatgtttagtcttttgcacatgtctaatccttctgttgtatggcagaggaatgcggcttcaacatataacattctgaatgaagaggggaggccagtcgcggctgcacttcttccttgcggagtcacttcttgaaacacgagtgttacctttgtggtggtgagcgtcttctccttccagtcgatactcgatagagttgaaatgaagcatattgtcgcatgggaacactgaaaatctgtaacattaacaagtgccgttgccctgtccttttccttttccccacccaagaacccaaccccctaggagagatcacacctttggttttgtgggttcttctcttgtaatcgcgggaggacaaggtttttgacctagtagtatacatcagaataacgagtctgaaacaagttgattgtcttctataacatcacactcggttttttactactactccacactactcagtgttgtcagtcatgttggcatttgggtctgacctagcatctccagttgtttctgccagcaagtctttctcccgcatgtggtaatactgcattccgccttgtgcgtcgttggtggaggtgcggtttgctgaattttggacagccgccattgcagattttgccaggtttcagcatgtttgcatgggcctgagaagctcggctttctccttgttatagtggccggcagcatgaagcagaggccatttcagtctgcaaagcgatgagaatgagatagacgcatcacacatgggcgacaaggtacacgtgaggcacgcagctctcatggcgaaaacgcatcgttgtcgcctcctgcctccacgcgaacgtctggtcgcgctcgcccacggtgggctgggcctggggcgccattgctgacgccgaccca

SEQ ID NO: 45583 - DNA, 1279 bp, Oryza sativa
catatgctaaaaagtcaacggcgtcaaacatttcgaaacggagggagtattagattagattatttttattgtggcgtgggcccctggctgacgctccgctggcagtgtcagtcagtgtgcgttgtcgtcacgtggtgtggcccttcgcacccaccaaacgtcaaacaccatgtgaacctcgttacccagtggcagcacgcacgcgcttccttctccttctttttttttttattttttttctcctccccttcctgatttcttgcttttattttgtttgatcgtactggtagtactgctggagctataggcctgtttagttgttaaaaaattttacacctgcatatcacatcggatataaaaaacacatttaaagtattaaacgtagtctaataataaaataaattatatattccgtcatgaaactgcgatacaaatttattaagcctaattaatccgttattagcaaatatttactgtagcaccacattattaaatcatagcgtaattaggcataaagattcgtctcgtaatttctcttttttttctacatttaatacgcacagataaaccatatcgatgtatagcgtatatgagggtataccttatccgtaaccctgacaataaaagagatatttttaactatataaatcaggtattcagattcatggttagggttgtttttctatggactaaaatatatctttttagtcttaaaatataaggaattttggatgagttatacatactctcaccgttagctttcattgttttgtcgccacttgctgctcagtcgttaaacactgcataatactaatccctcacgtaacttggaaactaacagacctgattgagaaaatgatgttagtcgtcgcatatatgcatgcgtggagcgtgttccaatctctcggttggtttagttgaaatgaaaattcttgttgtgcatccatctagcggacgcatcgaccggccacctgcacaacaagcgccgcttttatatactcagtctgtctgtcagggttacggataaagtaagcgctatattttagatgtacgttgtatactgatacggtatatccgcgcgtatacagatagtttccgtatgcgttaaggaaatctatgtaacatcccggcctagggcttaatagaattaatagaatactcatatcaacaagttgcaactttttttccggaagtcaatctccaaagaactccagggttaagcgtgcttggcctggagcaatttgagatgggtgaccgaccgggaaattcttcccgggtg

SEQ ID NO: 45584 - DNA, 929 bp, Oryza sativa
  unsure (1)..(929): unsure at all n locations
tattaatatctggtccctatcatacacacattacgtcctagagtctgtgctgcagctggctatagatctatagctcgttgctcttctctcttcctttatctcgtaaaatatctttatagctggctatagcctgctattgtacctgctctaagggcttcttcgaattgtaggaactttagaggatccatttcctataggatttaagtatttttcacttattcggtttggaggaattgggcatgtgaaaaattggaggatttttccttcgcctgtgatttcatataattccatagggaactgaatgttggacgtccttttcattttcctatgtgccgaacaatatgttgtggagatgcatttgatagtgcaaacaatatgttgtggagatgcatttgatagtgcagtgatgtgcggtttaacccggaggtctctattcaatcccctaacacccctataatttcttcttagaaattgtttggagagatgtctctctctccaatctcttttttttttggaataatgtgttgcgtatttttcatgtgttttnnatcctatatttaccatatgtaccctagcctatttctacctattcctatgatttttgcattcctatgttccaaataagccctaagactgtaagtggggtgggccacgccgctaacccgctgggctaacccgccccaccaacccgctagcctacttaggctagcccgctgaagctgatgtgggtttatgcagcaaacccacaccgtccagtgacgctgcaaccaaggtgcatgactgatgcacgcaaaaaaaaatttcatcccgattagtttgttgcttccatggcatccaccatgaagacgtcgagccggccggtcttcgccaggtgccaccgctaatcactgcaaaggtacacgcccatcgtcctattccccaatggcagg

SEQ ID NO: 45585 - DNA, 936 bp, Oryza sativa
ttgatatggatttggttttccgcacgctttttactgttttccatgagtgatgtattaattatgataacataaagtcacccttaaatatataattttattacaataccgtatgattttttattttcaagatatgccggcttatccattaaagatgtatatcttagaaactatacggtatgcgtatatgtgtttaaggggtgagtatatgtgttatgattgttcgtgtttgtagcatatttctaaaataatacacccatttttcaataatcaaataatataaaaataagatcacacgactaaaacatttgaccatttaaattttctggagaagatgggacgtctgatttgaagtttcttccattttcgtcacttcccaaatcccccgaaaaaaaaatctccagctgccaaagtcctccgtcactggatcgcatgactcgcgtctcgtcgccccttccttccgcttcagagttgggctgtgtttagttctacactaaaattataagtttgaagaaattgaaatgatatgatagaaaagttgaaagtttgtgtgcaggaaaatttgatgtgacgaaaaagttagaagtttgtgtaggaaagttagaatctacacagggcaggcacacacaacccacatcaaacacggcggccacctgctgccgcacaagaccacaaagcccccaaccacgacaccgcaccacatccccgccgcacaccgccagtacaggtgtccggtggtgtcccctccctcctccggtcagccatccccccacgcacgcacccgccaactacttgacggcttgacgcccgacctttcccccacaacgaccaactactttgcagccttgcaggcagcgcgagggagggaggagaggcgggggccattgccagccgctccagcaacggcgggcgccaccacaatctccctgtccctgcagg

SEQ ID NO: 45586 - DNA, 1501 bp, Oryza sativa
ctataagcaatttgttctggttaatcaggtgttggaccactgctacacaactggtgtctggtgcttcattcactcgggagcttgaggtaccaatgtcctgacttctgaccttattgcccttctcattgtcagccatctgttgcaaaggtttggagagggagagagggaaaacaaaggggagagacagattagaaactaaggataggaccttaaaggaactaactcttcttgctgatgtgttgtttgtttcacttattctgcaagttgattaagcaaacaacctagcatggttacatcacaccccactgatgcaaaccacgcgctacacacacaaacaaggaaacacacgactaacgactctaccctagagggcggcttaggttctgcgacgggttctccaagatcttcactcctgcttctcagctggcttcactgcttcctccacttcgctagcggatcctgcagtcttctggagcttcggcaaacaattgacgacatcttcttcttcgcaaagctgaccatctagtactagttgaaatctgaagaaggaagaagggagtaaaccttttgcaaatagcattaggggaaggagaaaaagaggagctttcgcaaatagtttcatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattacatcgatagtatttacattattacaaaggcgctccaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggagatgcataattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccacattttagtgttgagcaaattttaagaattagaacactgacttgggtacattgctcggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttaga

SEQ ID NO: 45587 - DNA, 1501 bp, Oryza sativa
tcgaatagccgagccctcggatatgggcaagccgagcaatgtacccaagtcagtgttctaattcttaaaatttgctcaacactaaaatgtggaatggttggcctgggttggcttgggacgagctggaacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctggagcgcctttgtaataatgtaaatactatcgatgtaataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagctcctctttttctccttcccctaatgctatttgcaaaaggtttactcccttcttccttcttcagatttcaactagtactagatggtcagctttgcgaagaagaagatgtcgtcaattgtttgccgaagctccagaagactgcaggatccgctagcgaagtggaggaagcagtgaagccagctgagaagcaggagtgaagatcttggagaacccgtcgcagaacctaagccgccctctagggtagagtcgttagtcgtgtgtttccttgtttgtgtgtgtagcgcgtggtttgcatcagtggggtgtgatgtaaccatgctaggttgtttgcttaatcaacttgcagaataagtgaaacaaacaacacatcagcaagaagagttagttcctttaaggtcctatccttagtttctaatctgtctctcccctttgttttccctctctccctctccaaacctttgcaacagatggctgacaatgagaagggcaataaggtcagaagtcaggacattggtacctcaagctcccgagtgaatgaagcaccagacaccagttgtgtagcagtggtccaacacctgattaaccagaacaaattgcttatagagatactacagcagcatcggatgccaattttgaacccgagtcggatgcaacctcaagtacagttggaggcagtccaagcactcacaccacaagtcagcgcaccgccaacatcccagaaggcccctcatgccatgc

SEQ ID NO: 45588 - DNA, 1070 bp, Oryza sativa
tgaaaagccttcctgagattctctatcttcctcccttgggatgaactcttcggctgttgttgttggtcttctcaccatctttgtcttctcttttgcctctcccaagcttaggacaatgcgaacgaagatgatcaattgaaccacgcattcaaagcaacgatttggaccacctcttttcatgttcctggcattattcatagctcgagaaattctgttagcaaccaaagccaaatcctcctcctcgatctgttcgagttgatcatcggatgtggcattaaaaacagcaagaaaataaggcttatatgaagaagcatgaacatccgaagaagaagaaaaagaaaccaaagcacttgacttagaatcaactttccgagaaagaacattcatctcatgtgttttcaattttgtataaagtgaatccaaagtcatccaaagcttctccaggtttcatctcaaatttaatgtactcctttttgaaaaatatcacgacgaagttctttaatgttattcgttccttgatgaaagttactcaaagcattccaaatttcatgagcagctcaaaaatgcgcaacacgatcataatccgaacgagaaataccactcaaaagaatgttgtgagctttgcaattttgttcaaaagcagttttttcagcagcagtattaatagcttcaggaatcacatagggacgagaaacttttctccaaatatcataaacatgaggcttagttgaaaacctagcaggagtagccatggcaaaaactctagatcgataaaaatccaaagaagaaaacaaggctctgataccacttgtaggatcgaatcacaataactaagccaaccagagggggggtgaatggttggtatacccaaaaaccataaacttttagcggaaataaaagttaccctcgaaatcgacggagatcggtttgaccgagattgatctgctggtctgaccgaagcgtagccgccggtctgaccggtgttgaatctccggtccgaccgccgcttgccgccggtatatcgccggttagaccgtcgaaacccggtgaaacacaaatcgaagaactct

SEQ ID NO: 45589 - DNA, 1501 bp, Oryza sativa
cgccgccgactggtgtttccgcctgctcgctggcctattatgccgccgttgttgggcgtctacgtcttcaccgaccggcttgccttcgccgctgccgactggtgtttccgcctgcacggctggcctattatgccgccgttgttgggtgtctacgtcttcaccgaccggcttgccttcgccgccgccgactggtgtttccgcctgcacggctggcctattatgccgccgttgttgggcgtctacgactccaccaccgacctgcctccgtcgccgccgactggtgtcctcgcctaaacggttggttggtcacaccaccgttcatgggcatccacgtcttcaccgaccggccacctcgtccgccgccgactggtgtttccgcctgctcgctggcctattatgccgccgttgttgggcgtctacgtcttccccgaccggcttgccttcgccgctgccgactggtgtttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgctggtgtcaccgcttgcacggctggcctgttataacgccaactgatgctatcttcttcacggctggctacatcgctgtcactactaataggcatcagtatcttcaacacaagctgcctacgtttgccatggctgccgactgttttcttcacttccatggctgcatgattctgccagtgttgattggccttaccatcttcatcgccggtcgtctcgtctgctgctgactagtgccctcgcttctacatctggtttatacagctatcactactgatgaacatcatcgtcttccgtcgccgactggttatgttgtcgccgactagtgcttttattttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacatcaactctcctccaagtgaagcatctacaacag

SEQ ID NO: 45590 - DNA, 1101 bp, Oryza sativa
ttattcaaattaatccaaaaactgtgctattaattggataaaggtcttaactccctcctttcacttgtctttagatgccgcgttacaagcctgagtacctgtttggtgttgagggttttgtccaggagttgcgtatgatgtcctttgtcattggattcgggactgcccctttttatacccagattcctcatgatcgtcatgaagagaagtgccgagtcaaagtcaccttgaacagcaatagtgaagaggtcccctcagtaatgtttgaagctggaggaagaaactacatccatgcatgtcaggaggtggcaaggatcgccataggagagctccgtgatcgctacagtgatcaattggccgacactgagtatcgctaccatcctcgccaacctcagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagttagaagacaaggtggatcgtttggaaaaggaattagccgcattgaagggagaagcaccgccgcagaaggccaggattcgtcttaccgcaaggaagagagctttatttgtccctcgctatcaactggcgccaaaggttcgtgtggtggagaaagaagttgccccagctcaagcggatcctccggtcatcatcataagtagtgatgaagaagaagaacccaagcgcaacaattccaagtttgagtgggtagctatcaaagatgaggaagatgagccgaacgagccttcaatcgacctccgatgcttggaagaactagagtgacttgttaagccgttgtcttagatcgttgtgttagtttgcttgttttaagtttgcttgtgtgtgtgtgggtcttgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagtcaaagtaattctctatcct

SEQ ID NO: 45591 - DNA, 1501 bp, Oryza sativa
aacagcagctcagtaggtttcagtcacctgctacctaacttgcagacaatatttcttgcagctgtggaggttgcttttgtaggcatgacagtcatcctcttctgctgcttgaactgggattctgcagtgtttgcagggctaacctccctccagaagataaccaatgcattgttcatggcagtgagtgcaaggcaggcaggagaaaattccattgattgttcccttgttgcgccagcggctttagtactattcatggtcatgatgtgagttcctctctttcaagctcttcacatttttcaggcaacaatcagaagagataacataacacggttgcttacatttctcaggtacactccatccttgacaaagttgttctcagcatgtcaagatcacaaacaaatcggcccggaaagcgacgatagaacaagcaaggggaaaccattcctgaagacgatggcattttcaccactagccttcaacaccacagtgataatgctggtctgcatcactgaaaggagatcgatctccactgaccctctcaatttctccacatttaacatcatctttgaggtgataaggtaattaagttgcacatctactcaccaaattcttcttctgatactgttcttgctccctccatgattaattcagctaatttattcatcacccattgcttctgcacacagtgcctacgggaacattgggttgtccactggctacagctgctcgagacagctacagcaccaggatgggattgcttgccatgagaagccatacagcttctcggggtggtggagtgaaccagggaagctgattcttgttcttgcgatgctctacgggaggctcaactcaaaggattccacaagcgcacgaactaggtgatgatgttatgcaagaatcaagaatgcagtgtaccatcccatcaaaaaaaaagaaaagaaaaatggatgcactcaactatgatctgcctctatgttcaaatttcaatgattggcgacagcgcacttaccggaggcggcggagggtgatgcccttcgcgggagtgcctcgctgcgacaaacagacggcgccgttgcgattcctgcaatttttcacaaatgtagacagtcaaaaaaggccctccttttcttaaaaattaatggattattaaaaaagaacacatttatcccccctttaacctttattattatatcaattagtaaattacactaatttaattgtcaatcatagccaggatcatgttgcatgcaagtatctagacgatgaacaggggaacatgttctcaaatgaattgatagatgagagaacaggtaaatgaacaatgtatctaccaatgcttctgaagttctgaaacttgctacgaatgcattcatggtaaatgctagtagtcattttctgcaaagaggtccgagtatcacaaaccaagttgagcttcttgccaagatcccagaaatctcataaaccattcccctcgaggaactagtactgaatataaggagta

SEQ ID NO: 45592 - DNA, 390 bp, Oryza sativa
tcagcaagtcataccggaacggagggtatgatgcaatataaccaaaggaaggctaaaggggatcctttgcatcaagctggcatttataaacagtagttgaaagcagtaaaacggttatagtaattaatcaatattaactatccactgtccaatgctacaccacgttgcaacaggcccaaacatccatttgaactaatcaattccattagactaaactagggtgagactaatcacggtgaatctggtcgatcgcccataacgcgggcacagctattcgaatagttttactctgatcagaggtgtacaattgtacccacaagacacagccccacaacacgttcccgtgtgccgatatgccaccacgacataccggaaagaggccgtgtcagg

SEQ ID NO: 45593 - DNA, 1501 bp, Oryza sativa
ttggtcacacaactgaatgggccatagcagtaaccaccattgacaaaggcaaggtggtaatgagcccgaacatcttgcattggtaatcgagagattgccttgatgtacttggcatgaatcttgtcaagtaaaacagcccggagtgatattgtcaaaccacctggcaccttctcaccattagcatcaccagtatgacagttacgaagccgccgttcatcagcgaaaaatcattggattgtcagacttcaagcgtgagcggcttcttcttcttcagaattccagaaagcaacaagatcttctcaagccgcgatctgctattatcacggcctgggtgacgaattcaagatgagacgccagcgaaaacgaagcggcgatgaagccgtcgacgttcggttgcctcgcggatgaggctgcgcatgtaagggcagccctggcagcgtaggaggagatttggaatcgttcgtccttggtgttgtagcagccgcgattgagctcgatgaggcggacggcgacgaggaggtcggtgttcgcgaggcgcaggtagcggagcgcgtcccaggtggggaggtagcggaagtaggatgtgaggaaggtgacgagcccctccagcgatcgctcggcgatggctcgtgtctccgacgacgacctcgctgctgctgccgatggcgccgccttcgtcttgcgcttgcgcttcttggcactgtgatcgggagggagggaggagagggtgttggcgatgatattggtggtagggtcggcgaagccgaagcagacgccggcggcgacgagaagcggggcgagctccgtcggccggcgatttggttggaagacttgggaattcgagggggtttgggacggggaattaaaaggtcgaattccaaccaatctcttatctggggaagacctgttaattcgtgagacttggagggaattcaatgtgaaaccaaataagggatgatgactaaaaatataactcccacgaccaatctcaccatcaactccctccttaaaactcccattcctctttccttctcttcccaaacatgccgttaaggtttggcgtcgacaggggatttgatttgatctgatttgatctttttttttcctcccctttctccctcgctcctccggcggtccggccttcgacacttcgacagacaactcaggggggaagacagagagtgagtgggcctaaactgggccagattcaatgaataggagttccgtgtgtggcgtgaggaataagttcattttaggtcccttaacttgtcaacgaatccgattttcgtccttccaccgaaaaacaacatgtctctcaactgtcaaaaccggtgaagcccaaggcgttttggacggcggtttgcgctgacgtgatgcctacatggctaatttgactcggcctaaaaattgtgggcctacatgtcagtaacaccaaaaacaataacttaaaaaaggtgggggcccacatgtcaatctcactctcttcttcttcctcctcact

SEQ ID NO: 45594 - DNA, 482 bp, Oryza sativa
tttctccttccttcctggctacgacacgacacgacaccaacacgaaggagaagggcattagccaagccggcgcatgtgtttttgttaaattaaaaaaaaaacaaagaaaggatttctacctgagacgagacgagacgagatcgcacgaagaagaagaggaggaaaacgcaatcaatccgatcgatcaaagccgagaagaggataatctctccgccgccgccgccggagagcgggggcaccgaccgacccacccaacgggcgatcgccggccaggatcgggtgggggatctcgtcgctcagatcggccgcgctgggggcgaatcactcgcgccactccccggcgcagcccccgccgcccggagccttcttccccttccactggtggaaccctaatgctcgccgccgcatagacttctccaccatggacttcgccagccgccacgccgcctccgccccgccgccggcgcccgacgcgtcttccc

SEQ ID NO: 45595 - DNA, 507 bp, Oryza sativa
ttgtatcatatcatcttagtcaatatcgtcgattggccttcactagaatccctttgtatgccatgccatattgtcattcttctttggatccttatgataataaaataagttaattttggtcaatgtcaacattgagagctgctcaaggctgatcatatgattttattgcaatatcagtcatcactatgccgccacctatattctaagtctttagttccattcctaactaccatattgcaaacatcaaagaataaagatttaataatcagactagcatgcaccatcacttggtttaacattaatttgcaaaatagaaatgatcaatggctgccgaagtccattctttgttttcagagatgtgaaagttctatcaaatgatagcaaacgtgggactattgtttttctttgggtgactcttactggatctttttatagtgaggatcatgctgagttgaggagtcttccttcacaccctcattcccatcttaaaatgatctacattacagg

SEQ ID NO: 45596 - DNA, 1186 bp, Oryza sativa
gtcatttttttctttttactcgagagaaaaatgttttttttatttttttcgagagacatttattttattcttaaaaacattttttctgttcaccaaacttttatctaagcaaaactcatacagggctgagataaagttacataacatagcagagaagcatttggcaatatacgtaccatgcaccttgagaggtgatatgtttctcctttgcctgttttggcaattgatttgttcctggcccttgacttacctccagtgtgactcgtgcttaagaactcacccatcaaattgaaaagttttcctataggggttagtacatgaagggtatacatccgaagtccatgaaagtactatctctacggttcatttaagcaaacttgacaccacgtcaactttgattaaagcaagctatttatcctaagcatcatgcttaatttaaaaagcctatgaatgtcgacgaccacccaaaccatagcatacgaaaatagaccgaggacgcataaccatgcatgatcaagctagactcaactagagataagtatgaataaaagtaatggtgaatcttttgttgtatacctgagtgtgcttaccgccggcatgatgtatatgttgaaatctctagagcggtggcacggtcaaatgtgattgtcgatctttcctccgtcttgatgcgggttgtggcggaggaaggcactttgattatgccaactcaggcaagtggttcggttatgcacacatctcgggtgcaagaaccttatgccttgaaggcatgttccgtcggcataatgctgaagagacgtaggatgcatctcttttcgggcaagtatgcaagtgccaactggagtagagcagcaaacacctagaaaagaagagggcatttcctgttgcttgtatgcatgtaggtgttgtgggagcgacaagttgtccacacctaggagtggatgaaggctaagtcaaggcggcacatgagctcaagagaggggctgggtgtagcctagcagcatggttgctaatagcaaggtgtatagccatattttaaagactcgcagatatctattgaaacattccaatcatattcctttgttccaaaagataacataggaaatcctttccaagcattccaattcttaaaaatatcctttaaagttccttcaatgcgagcccttcgcggagccaaatttaggca

SEQ ID NO: 45597 - DNA, 404 bp, Oryza sativa
tccaacagattctagtacataacaacataacacttgtgcagcacctctcagtaaaaacctgatattgtaaaacggcaaatttaagtagagataaaagtcaaaaactaatttgtaaccacaacacttcacacatgagctgacacatacaatgcaagaactgtcaaggaagatggataaacaacagaatataattaggatatggtctcgattctgttggcatttaactactatccacagattatacagcaaagaaggcatatacacattatgtgttgatctgttactctcttagcattaaaaataaaccactacacatgcattaaaatgtgacatgcatatacctggtttgaagaacacggatagaccaaaatatattgcgtctatatcatcatctcctttttagc

SEQ ID NO: 45598 - DNA, 1501 bp, Oryza sativa
tactccagtaacaaacttggtgtatgcatcatccccattattcttagatgcataaatcaatatccatttactctaatgcacaaaaacgaatatacttaatgaatgaatgcaaatatgatatcatttagaaataacatcaataaaattatatgatgatcaatttaaaacggatggagtaacaggtagcagtgagttatacttatgaaacttgctcttatgaaaataacattgctgtcagtcaattgatcttttttttatgacaatagtacaaaactgcccgcaagttaaggaaggggaaaatagccttaaggcttgagtaactcttgataatgatagaattcgtcttaaacttaaccataggaccgcatgaaccttctgggagaagcacacgtgattttatatttttcttcaaaggaatacgatgtgatccacaaagtcctaaaaagatttagtagtagtataaaacattgtcaaaattcggatcgagcgaaacatatgctccaccactgcctcctaacatgtaatgtaaaatctacaaagataagggatcgtaaaacacttcccacgagaggaaagcagggagagagagcatggtatggaggggaggacgctgacatgtgggatcgagcgagagcggaggctgattacccggagggaggttacacaaacaggagataggagggtggttgcggcggctaggcgagcgatcccataggcccaagccaccatgtgagcgcaccgatgatccgaaaatcgctctttcaaattctattttttaatatatatttttagattatcattattttataactatttttactataaattatactagataaattcatcctaaagatgtcaaaatcttttataaatttttttaagataattataaaaaaaatttatttaaaaaaccttctgtttttttaaataaaggtctatatataaattcacgatatacaaaatgcatgcaaactttctatttataaactttattatgtataaatactcgttatttcagggaggctgaaaagaaaattagtatatactgtactttattatttgcagtatacaaatcgtggaggctaatcacggaatgatgcgcatatgcatgatttgtgtggaaacatgcataccacacgttgatagcgaaaaataggaattgcgggcgatttaacatggtatggctaaaaaaaggaagatgagtgaagcggtgatggtgcggctggcggacgcgcgaatgatcgctaattaggagtgtagacataggaggagtgataataccgaaaatacccctggacactaaatatgatttgatttgagtgattagccatgggacccatgtgggttttgttatctcctctcctcaccaccaaaaatccattccaccccatacccatccccacctttcctctcctcctattctcttcttctcttgtaggagtcctcttccaaatcaaatcaaatctagaagaagaagaaatcgagatcaaatcgatgaacc

SEQ ID NO: 45599 - DNA, 622 bp, Oryza sativa
agtggatcccccctcgtttttgttcttgggcagaaagcctgacgaaactgaatcctccaacaaaagcaaatggcgaagcgtgggctttgttgttaattatactttttgagtttgcccattcctcgaggttggtagtggtgaactggttggtgttggtgttgttgttgatgcttctttgatgagcgcactgttgcttgcagggctccttaattaatcgctttttcccaagatttcgtttttaatttatatttatatactcttctttttttctccggcttctaggtagaagcagggggagacagagcggccagtgtctttctctacaagaaattcctcggtttccacgcgcgctttggcatttcttttcttttgtttttcttttttttacctttcctttcatctcttccgctggttttgtgggatatttgtggggggttttgggggtttagaatctctttgatttcttgtgctttttcttgctttttctcgtgatgttggagtggtgtgttttctgatttgatccgcccaagtagcgattttcttttttcttttcttgttgtttgtttggaggggggaaaaggttgcgatcttggtggcgcgccgatggcgtcgtcgtgcatcc

SEQ ID NO: 45600 - DNA, 811 bp, Oryza sativa
cgaaacacgcgaattgtgatcctagggaatttaaacttatttctatgattattgtatatttttttcttaatcctgtatataacactaagatgacttatatttgaaatgagggctatagtaatagtctaagaataatagctgtctctacgacccaccggtggatccatcacttgtcaatgatccatgagagtgcaactggaaaaatgaaattctaattttgaatgatccatgagagtgcaactagaaaaatgaaattctaattttgagtagattgtattgatgatgtacaaacttgttaggtgaatgctttttagtacatgaatttaaaatgtttgctttggtgtatgaagttgtctaatgcatgcaaaacaagaccaaaagggcatgtcatagccaattttaccaaattaaacactgattaggatgcgacgtaaagacacgatgtgggcatgagacatgctatctttgtattgtaaacttgatttgtgattgattattctttgttttcccctttgattcatttctcggatttttatgtcttctccgtgtaatctttaggccttattaaacatcttcacttaacaaatatatacatgtatgtagcattcttttgacaattttcatttacttaacaaaaaatttctccacacctattcttctaacaattttcccagttccaattgcgatttagtgaattttttttattttctccgcacatattcttctagcacacttccccgtttatcccacctcaatatttaggaaatgtgggcaaccgaagcccccaaaatttcgatctccattttgtagt

SEQ ID NO: 45601 - DNA, 328 bp, Oryza sativa
ccctcggggccaaaacgggagcggcccgacccctcggggagacagagggaggggtggcctcgtcaccctcaggcctgacccccccgagggggtcaggccacgtgggtgacagcggctgcccaagcctctagtcacgatacccccggtcccatgtcaccgacagtagcccccggcgttacgccagggcgatcgcccccctcgagggaagcgctcgggtgtgacgccactccttaggcctggtgacaggtggggccggtctctacaggcgggcagaaacccagtggtcgcaaatcgcgcacatcggcaagggaaaaacgaccgtcaataa

SEQ ID NO: 45602 - DNA, 1501 bp, Oryza sativa
agaacaacctacacgcaagaaaaaggcgtacttttctaatgacattgccacagctcacacgcatcttcctgtcaaagagaaagaaaaaaaaaagagcatctacatccaccaaccctctaataaagtcgccaacgtgcgtttattttggcagattccggtgaaaatggacattaaaaaaaagtattaagcgagcgcaaaaaggtttcagatttgggaccccaagaacaacgattgcaacagaaaaagctccacaaaatatggagaatcgaacccggtggtcaccggaattctcagagtttatactaatcctgatttggtcggcatgattattggctatccacgagatctcaaacgagcatcgtgcattctaacgaagaacagtgccaaattcatccgagaattcaggcagcaagaaacaacaaacagcttgtaacaacctctccccctcaaacaccagatcacacatcccaatggggctctgccccatgacacccagaacataacagaacagaacaggatcaagaaccgatcccgattctcggtttcgatactcccaaagcagcgagagagagagagagagagcgcccagaatcgaatcaatcacagcctcagagtcccacaccacaccacaccaccaatcaaactcaccatgaacagatgaagagaagagaagggagacagagacgtacactgggcctcctccatggcggagagagggagaggagcaaatccagcaaacttttcagcgagagagaaacgcgttgcctgaccctcgtgctctagcttagcttgtggcgggtgttgcgttcgttcggcccgcgcgcggcctaaataaagggaggggagagagcccgacctcgactgtgacacggcaaagctctgactgacaggtggggcccttagactaagggggccccggccccacttggccggcgtcacgtggggagaggttctgtggatcaagtgggcccatggtcatgctgggccgtgtggtgggcgtcgagtcccgtgggtcgtgttcgcttctcacggaatggacgcaaacggcgcggcgggtttatgtgaacgcggttcactggtaattggtaaaggatgcaaaactggtccgtggattactactggaatcacaggcagccgtccccggctaggaacaggcaaaaaccaggaggatttacttattatttgtcatcctacccaaatacacatggctaaataccactttcctaaatttttattttcaattattacctgggctcacatgtcagccttcatttctatttattaagcttgtgaacatgtgtggacccggaaagaaggctgacatgtagactcggatagcaaatgggaatgaaaatttataagagtggcatttgggcatatatttttggtaggatggcaaatagtaaattctcctgacaaataccccgcaagcgggggtgtaggaatttttaggtgtcaaaatttacaattaaacaacaaatgaacgctaacactaccaatc

SEQ ID NO: 45603 - DNA, 1501 bp, Oryza sativa
gtataatcaagtaaaagtaaaagaacaaatccataacatattatgatgcttcattccatggtgtttctctgtggaatgatttaacaaaacaatctatttcctattgtgcactaagttcacaggattcggtgccgtattttttgcactaattcttctcactgtaacttcacggaacaatcttaccggattgttcagtttcttgtgtaaaattcagtcagtaaccatccttgaatccatgccttgccttggtttgaattgctgcaatagcagactatcacaatgttagagcagcagcaatgtttagttgttgcctggatataccatcttcaactgtacctgctgcttctccttgtcaaagctttcctcattgcccatcttctccatccttgatgagattgcagacatccgagcactctgccaagctaattgcatatgaaacacataaatatataatcagagtggagctcacatagtactaggactgcacaattgaattgagctattctgagaggtgcaatggcgatagaacaggtaccagtactgccggctgcggaattgtcccttgaaaactaccagaggcctgcaggtttaacagtaattgagctcgaattattggcgaatgaacatattttctgcaggaattcagtgaacatatttgatcaggctacatgagattgagagagggtactgctactttctgacgttgagggggccctcgccgccgcggatgcaggtggcgacgcacttggaggtgcactgcagcgccttcgccgacttgggccgctttatcctcacctgctgcttcccgtcgccgcctgcaaaatcatccccacacccacctcgtcgtcgtcatcgatccatcccccagcaaaaggcgtgagaaaaaccgcgagagatcggtctcgcttaccggagagcgtctgcgggatgttggagaaggtctccggctgcggcggcggcgtcgagaggatcgccgccagcgccagcgccaccaccgccggcgccgccgcgcgggccaagccgccgccgttcatcctctccgtctccgacgacgcaatctgcgcgcgcgggcgcgtgtgtggcgggcgctgcgcctctctgtagcggatttttttttcaacttttttaatttttaattttagaaataaacattttcaaaacttatttttaaaatataaacttttgatgacatgagcccgcctagaatggcaaaacaatattgacacgtcccatactgcagacctgacagttttattatgctcgtcagctaagatggtgtgaatatgtggtgaaataacgctaccacacgacgtggccaaataacggtgtcacgctagttagattggtgtgtaatgttgccacgttagtccggtcggcgtagtaaaaaggttcagatttaaaaataagttttgaaatgtttgtttttaaaattaaaaatttaaaaagttcaaagaataaaaaaatctctatgtattggtgttggtgttggagcgcgctacgg

SEQ ID NO: 45604 - DNA, 1501 bp, Oryza sativa
aaaagtctcatcggttgatctaataagccaaagtaaaatactaaaatttaaatttacggacttgaagttgtatttaagatatttttaatgcaatttctttttagtgttggcttttaagtcactatgaagaatataaaaaaaattacctaaaaattaattttattccctggtaaaacgttttggcaaccaatgagactttgacggacccaatattccaagtcaagaaccggtgttccgtccgtccaatattccattccatcgggcagcagcagcaccaggttccccctatccgacctccgaccagaacaatcgatgagccagcagcctctgcacacctcccaataaagtgaataaacctcgtgactgtagcttggtccagtcctactcttctctttgctgccgcttggagccggagaaggtgatggggagtgagtgtgttgagtgaagccatcggcatagccgtcgccgtcgacgccgctgcgttcgcggcccgagaaggcgagcccggagaagtagagagtatggcttcttgtttgcgttttttttttttgttttgttttgtgtgctgtgttcttgttggttggtcgctcctcgttcttgatttccgtccatggtgaccctggttagtggtggtggcggctggttgcaggtcgtcgatcttggctgttgttctggtgtggtgcctgctggtgagtcgatttgagggaggaagaactgacttgacagtttcttcactcgctgctagagaaaatgatgagccgatccgcatctgtaagtggacgatttcttgttttgggtcccgtttcggttgctctgattgattaccttgtagtagcatgtcctgccttggccaagaactctaatgtggtggtagaattgagctatagatttggataggaatcaactgatccaagaattatttgggtagaatttggcagttcgcttagaattcagttcttttaagatcgggcactgtgatggacagcctaatgggtgcatcacgggataagtgcactgctgctgtctttgtctttttttgatggagacatctgtcttcttgcatggggattcaagtgggacttttataattcccatttggccacttttcttttgggaaaattctccgaggatgatgtgtgagacctttgctcctagtggaggagctccatgctttgcttttacctgtgattccttcccctataccatggattccgacattgcagaaggcggcgtggccttgttagaacttagaagtcagcattggcaacactacggaaatcaaagtcagttgatgctgacattttatccaacccattgtaaggacaaagactgatggataacttgaattaatctttgtggcaaactaaacaagttcacccccccccccccaaatagtgtttactctgtgtttgaactatgtttcatttgctttgtatttccttaaaaatgcactattcagattcagctcatgaacaacattttttgacgttcatcttctgga

SEQ ID NO: 45605 - DNA, 222 bp, Oryza sativa
cggcgagaagagaagagcacggggatccttttaaaggggctcggaggcgacggcggaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccgaagatcatttcccctctatcaattcagc

SEQ ID NO: 45606 - DNA, 648 bp, Oryza sativa
gttggcttaggacgagctgggacccagggtcgagttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaacccctttatggtataattcccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtttctcgtttgtctttgtgtgttgggcctccgctgcccgtgtaataattttatatacgcttccgcttgttaaactctgaattgtatcaacttttggtgtaccttgcctcctgggacaaggaataatgcacgcacgtcaggaacgcctgttgggtgttttccggtcgtgacacgccgccaccctcgccttcgcctctcgtcgccggagtagccctagcgccgtgtgccctagctttgccttcgccgccgccgctccagc

SEQ ID NO: 45607 - DNA, 1501 bp, Oryza sativa
atcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttaacaaaacagttaagtaataattaagcaatattaaaccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccttcaaatccatgtgctcacaacccaccattaccaggttttagttggcacattaattaattaactaatcacgattgaccaccgtgaactatcaataagccatcatgaaataatagtgagtcattagttatcccataagtgtactaatgtttctaagcagggctaagcaattatatctaatatctagttgaaccaatataaataaagctcaactagtcaaattataataacccaaggtatcaaggaataaggtaatcaagaacaaaagggccataacaatcaataggttaattccacccaatgacattcgaaaatagatgcaatagttgaatagaaacaatagctttaaataggatcaacatgctcaaagggttgtttgggatctgtgtgacttgccttgttggccttggaactcttcaaactcttcttccgcgaaaacggactctctggaaacgacggaatctaagcaaaaagaagcaaaatcaccaaaacagcacataaacaagcatgaacagttcatgtggatatttttaatgtgtagatctcaattttagaaaaatttagagacttgaaccaactaaatcggagctaagatgaattagttatgaatttttaaagattaaaccggattaaaacacttaaatcggtttaaaattgaattatgacgcaataatgaattatttttgaaaaggaaaaggggatttattgcgtcagcgg

SEQ ID NO: 45608 - DNA, 320 bp, Oryza sativa
atccacaaagccaaacaacctaacaacccaacttacggctaaccggcaacattttattatattacttgcaatgatttgatttacaaatttccagtacatatatgtatttcttcactcgtgaatacgcaagagattgtatctctattaaacaccgaaaacggcacacaaactattttttgaaagaaaaaacatatactcctagtttgttttaatttattctctttttacttgtaaaaactgcggatgtaacaacaagccagatcctttaaacttgctctttgtaatctcatcaatcctccttgccatctctggcgtcaggt

SEQ ID NO: 45609 - DNA, 1501 bp, Oryza sativa
ggagctggaaaacaaacatgtcggtgattcgcccatacccaagattaatcaggtgagatcaaaagcaaaacatatagcatatggactcacgtgtgggcagcctgcgcctgcggtggctgcaccgcctctgtttgcttcgtcggggccgaggggtcccttacccacttattttgaaaaggctgattcaacaatttctttattagtcatacacaacacattcctatacatggaaaaacactgcaattgaagaatttcctttgttctgattagcgctgacaaaccttcgcaggaccaggagcattacgtgactgggcattggcaccttgtaccccaaaaccaaaaggattgggcttctgctgctgctgttgctgctgctggaactgtgagccaaatgacggctgctgctgctgcctgcttccggtgccaaatccaaacgggttgggcttcgcctgctgctgctgctgttgctggtgaggggaggcatgcaaatacctgcactgcgctccgtacttgcaactgcacgcatcattcagaaacaagcattgcaaatcaaaaactcgaatcaatggctgggtaatcaatcgatggcgtagttctcactgagagagatgagagaggggggggatccggtaccttccgcgctggaagttgcggcaaatctcctgccgccgactcatcgccgcaaagcggaaggaaggggggggattcgattctagagctccgcctctagggtttagctcctcccaagcgcttgctcctcctccttccgccgccacgggattggcgtgggcacgcgacgcagcaagcgcggccgcacgacgtcggtgggtgggttgccctcgccggcttgccgcctccgccgagaactcgagacgcggccgccggccggagtagtcgtgcctcctcccttttgagaggcggtgacgacggcgagcagccagtgggccaggcgggccgcgggtgattcggcccacgagagggcccggcccagatagaacggccgtagcgcgctccaacaccaacaccaatacatagagatttttttattctttgaactttttaaatttttaattttaaaaacaaacatttcaaaacttatttttaaatctgaacctttttactacgccgaccggactaacgtggcaacattacacaccaatctaactagcgtgacaccgttatttggccacgtcgtgtggtagcgttatttcaccacatattcacaccatcttagctgacgagcataataaaactgtcaggtctgcagtatgggacgtgtcaatattgttttgccattctaggcgggctcatgtcatcaaaagtttatattttaaaaataagttttgaaaatgtttatttctaaaattaaaaattaaaaaagttgaaaaaaaaatccgctacagagaggcgcagcgcccgccacacacgcgcccgcgcgcgcagattgcgtcgtcggagacggagaggatgaacggcggcggcttggcccgcgcggcggcgc

SEQ ID NO: 45610 - DNA, 623 bp, Oryza sativa
tttatctctgagagcaactccaggttgcagctttctattattcccagctgatctttgctggtgataacattgcttcttgccttctcctaagctgcatattttatctctgctgacgataagtgcaaagcaagacaataaagagtcccatgaatttattttcaaactgtgaacatgaatatcttttttccaaaatagacagatggtaagaatccaaatataaatttagtgttgcaatggtcagggtctcagtactttctttgcaagctggttctgagattcaaatatttttcattcaacgaatatatttgcatggtgttggactaggaccataggtgattttgagttactggaaatgcactagttgagaacccttctacattgcatgtatttccggaaataattgggataagtggctggtggctttttagaactcttggcatgatcaattgcttaacttggaccaatcaacctcatatacatttcttccctaatgcaattccacaactcagaaccttggtttgtagttccatcccagctactactattgattatatatactttctcatatttgccctggtatagaattcaaattttgatttcaattgtatttactgtttaccagg

SEQ ID NO: 45611 - DNA, 1501 bp, Oryza sativa
ggccaagtggggccggggcccccttagtctaagggccccacctgtcagtcagagctttgccgtgtcacagtcgaggtcgggctctctcccctccctttatttaggccgcgcgcgggccgaacgaacgcaacacccgccacaagctaagctagagcacgagggtcaggcaacgcgtttctctctcgctgaaaagtttgctggatttgctcctctccctctctccgccatggaggaggcccagtgtacgtctctgtctcccttctcttctcttcatctgttcatggtgagtttgattggtggtgtggtgtggtgtgggactctgaggctgtgattgattcgattctgggcgctctctctctctctctctcgctgctttgggagtatcgaaaccgagaatcgggatcggttcttgatcctgttctgttctgttatgttctgggtgtcatggggcagagccccattgggatgtgtgatctggtgtttgagggggagaggttgttacaagctgtttgttgtttcttgctgcctgaattctcggatgaatttggcactgttcttcgttagaatgcacgatgctcgtttgagatctcgtggatagccaataatcatgccgaccaaatcaggattagtataaactctgagaattccggtgaccaccgggttcgattctccatattttgtggagctttttctgttgcaatcgttgttcttggggtcccaaatctgaaacctttttgcgctcgcttaatacttttttttaatgtccattttcaccggaatctgccaaaataaacgcacgttggcgactttattagagggttggtggatgtagatgctcttttttttttctttctctttgacaggaagatgcgtgtgagctgtggcaatgtcattagaaaagtacgcctttttcttgcgtgtaggttgttctgttgagagaaagaaaaaactgatgagaagactatctcgggctgggcatcgcatctttagaattgattgagtgatcaaccggatcaagtaggatatccttgtgagttggcatccctatcacgccatataaggcaaatgcagaactcgtgttcggctggaaacaactgaaagtagatgagagcgatgtcatgctgtctaccggttgtcacagtaactctgttctattgatatgcgtgtaccaactggccgttgatgcctttggatggaaagaagaatctgcttttatgtttctctgccttcttggcatttgtagtatgtctttgacaagtacaactaatctgcctttctggacttcttgcctgatttagtttggggtaaattgcaatactccggatgttcagagacaataagagaatttactcgaattgtcaatcagataacgtttggtagcgatcactatacttttagtacttgttgttaaacttcgttgaaggttctactcttttaggtctctctgcttatgaagttgccaatgatcatgtcctcaatatgtaaaataagctaaaataag

SEQ ID NO: 45612 - DNA, 1501 bp, Oryza sativa
gataagaaataggtgcaaccacaacagctggcactgttaataatgaagcagagatgtagacaaaccaacctgcagtatacaggatgaatattccaaaatggtgcattcatgaaggttaaattggaaataacaaccctgtcagagtacatcagttcaagaagagggggcctggtataatttagtgtgtgattgtgaaaccagttccaccaaagttcaccttggccatcaatggtgccattagcacctgcaagagcacagcaatatgaaatgcatcattacaatttacaagtaggctaataaatacaagagcacacatgatataaatatgatacttactaaccagttattattacatcagtaagattggatccaaaaataagactctggtgtcttttaccagggagttctctgccacgcccataagatggcagaggatcaataactggccagtcagatgaatcctgcaaaagaattcttatgacgatcgcgattgtaatacttcttgcactgtttgttctagtgtaaagtattttcatgttggaacatgagaaacagttactgtaagttccaataatttgttttcaggaaagaatgttatgaaatataaaacatttcacgttattctgcaattttgttagaatgcgatttatgtaaagcagtataaagttgaatgcactagttttgttaaatttcataagacaataataaataaatcacttctgtgaaatgaatcaaataatgcataaagttatcttacttgagatccgattattactgcatcggcgtcaagtgacacagtgagatgactgataagattaaaactcccagtcaaccaccttccagcaggcacaaagagctctgccccacccttatctgcaaatgagctgaggtaaaagattgcattcttaaacgctttcgtgttaagagtaacaccatcattaacagcaccaaactcagtaattgacacactgtgtggccgatgcacgcttgctgtcaagtcgttgcagtacatggcagatgaagtggcccattgagtcgcagcaaaaacagttgcaaaaaccaaaaggacttgaagtgcctacaacaaattccagaagatgaacgtcaaaaaatgttgttcatgagctgaatctgaatagtgcatttttaaggaaatacaaagcaaatgaaacatagttcaaacacagagtaaacactatttgggggggggggggtgaacttgtttagtttgccacaaagattaattcaagttatccatcagtctttgtccttacaatgggttggataaaatgtcagcatcaactgactttgatttccgtagtgttgccaatgctgacttctaagttctaacaaggccacgccgccttctgcaatgtcggaatccatggtataggggaaggaatcacaggtaaaagcaaagcatggagctcctccactaggagcaaaggtctcacacatcatcctcggagaattttcccaaaagaaaagtggccaaatggga

SEQ ID NO: 45613 - DNA, 1501 bp, Oryza sativa
cacaaggggaaaggtcagatttggaggagaaaaaccgagccaaatcggtctcagttcggctgctagaggtagaagataaacagtgtcgagggaggcaaatagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttgaattgttaaaaatacttcctatgctcaaataattccaagaaaaatcttgaacatacttggacacccaaagtatttaacaatattaaaaacagaccatttaatgattaatttaatatgtgggtaattactgaaattctctttgtatgattaaaaattaagaattgagctccgaaacatctgagaaaatttcagagagtgtaattaatcatggagaatttaatcaaaattaaatccatccatgctttatatttaggaaattttatttcccacatttaacttcacttgtaaattaatgaacatttaatataaattctaataataatttattaaataatttataaatcctgaaacaaaaatcaggatgtgacaatcacatccctcaactacaactcccttattttcgaaatgggtacaaatcgatgtttgaaggaagcgtttcaattacgagcaagagatgagggaggtaaaatagacttattcctttcacatgtataccctctcggtcccttcttttatcttgactaggttggctcagctagcacaagaagtgcacttggcccaaagccatgtcccactttatacttcagtgtttatgttagagacatcatcttggacaaccgtcgggctaaatttttctatgaccaaggccccgtttttcttcaacttcaaatttttcgttagcactaggggtgaaagtgagatggatatttcccaagcacgtgctcgactgtggagattatggatacccatacccacacaacatgtatatccgactaggtataggggtaccatatacagatataatacctttaagggactcgggttaaattccttacttgtgtatcaaggaaatacatgaggttctagtcggttacgattgtattttatctttatttgcctattccgttaggaatatgggctgtaccttgtaatacggattcctcccactatataaggaggggtccgggtgcctcttggggcataacttttctcccagatcatactatctataacacactcggcgaatcaatccccggacaggagtagggtattacttcacattgagaaggcctgaacctgtataaaattccttgtctccaaacccatccacttttcctgcttgatagccaccccctttttgtattgccgaaatcttgtttcgacaattggtgcgccaggtaggggttgcgtcaagcttttcgccgattagtgcga

SEQ ID NO: 45614 - DNA, 280 bp, Oryza sativa
atagtaggatgataccgtaagcattttaacatgtaacatatccagttttctgcatacgcacgactggtgggtgttacctggtggcacacttctttttagaagggagcttaacccatcctcttgagtcttgacagttactattatattgttatataataatgcatagtaatcatatatggtagcttgtgtattttcatgatgtagttttccacttgacgcgtttttaccaagtcctacacaaatctttcatggtgacagtgtttgcgattttgcattgcag

SEQ ID NO: 45615 - DNA, 638 bp, Oryza sativa
ttctccttcccgaatcattcacagttactgcatataacaaattctactgctccgaaattagagcaatattggcaaaaattacagcaatgcacacttcaggaaaatattatagcataattgtcctgcttcagttattaatgggcgaaatttatttatgaacaatctttcttcagtggcctgtttgttgatgacctgggaaccaattttcttgccagaaactctatactatagttttgcaaggtagcataaggaaaaatttagaagcttcacatactggatggatttttttagtagttagcattttggttattggcagtcaaattttttttagtagaatggtaggaggatgggcttatatttggcacaattaattattcagaagatgttgtctcaatcttccattttactctactaaacttattccatatgttttcttaaatgttaaatacttaaaatgggactgcagtgggtctctgatggttgcttgatagccataaggaaaagagagacaaaaataatgaattcatgcagaggtttcagtcaattgcaaataatatgagattggtcgacttaaaattgaggatggtgtgatatgacgagcctctggtgatatgatcattttcctttttcatgtcagg

SEQ ID NO: 45616 - DNA, 384 bp, Oryza sativa
ctaccgtatccaagctttctacaacgacatgagtagtgccttcagatctggcaaattgttgagatggaaaattgatttcccagaaattgtcatgtatatccatgcaaaagttgcatatattttagtcttgaaaacgagatatcttctcgagggacttttgaaaaagaattggtggaacgctctgttgcttgttaaaattgctttgcttctgtgaaataataggaaggtggatgtcataagacgtgtcctgttaatctagttctataataaatgtatcgtgttagagctgtaataactacatatttaatcacttctgtgtaacttgactgcttttgtgcctagtccctaatgctgatactcctaactctactatgtaatgtcaga

SEQ ID NO: 45617 - DNA, 660 bp, Oryza sativa
tcgccaaaattctttcttgcagtctatatgatgtttcacacatatagagcacatgaggcccttatcaagccatgcggcctcagccttgttgaacaaattgatattcaataaatattagtctattgttgcccatggcagatatgtttccttgatgtacatcacagtatgatggtcagttggtcactatgtttgtgttgtctgagtacaatgatgcaaatatttaacatgaatgatgaaatgttttgagttaaacaaggatggcaaccagaaagtatgcattgagtgctaatgcgaatttaaagtttgagtctatatgttatagaggaagggtcgtataattttctctataatgatattaatccttaggtagattgtttttcctgtttgttcgtcgattgtaggttgctatgggattgtgcagtagatctttcacaattttgaccattaatatgttaggatgttgattgactatatgggattgtgcagtagatatttcagaattttgatcattaatatggtaggatgttgattgactatataactattctgacagattgaacatatcatttgtcaaggttctctttttgatataacatagatatttgaatatggaactctttaaatccacacggtaatatttgtagtttcgtagcaccatga

SEQ ID NO: 45618 - DNA, 1501 bp, Oryza sativa
taattcacttcctcctctatgtatcttttgtctcaactttggtggttattgatggcgttaatttggtatttaacagccgtcaacaaagaggaaccaattttgtggaccattcgacgcgtacgtcgtgcacgtgcgctgcctgcctccgaggcgaggcgagcgagcgtgcgcgtgtgttccccctcttctctccaccacacatgcttcaagtggctaggagggcatcctcccttttaaggaggtccccctctcctagaataagcaaggtgctactaaactccccatgcatgccatcccatgaggtgggcttttgtgattttccaaagaattaatctttgagtgggctaaggcccatctattaattccaacatgtgtaaaatatgtttaccggttggtgaattgtagtttgcacattaaaagtgtttggttcagccccaaaactttcccctttccttcagttcttcccattgatcttgtgcagcacgtcgatgtgtagccatggtgcagcatggctgccgaagctacagacaatgcggcggtgcggcgcgacagccggctctgcggtcagcccaatagttacagcgcatggtgtggatgcacatggcacagtgcccaagactgcagcagacgcttcagctagcgtgtgtagcacggtgggacattcaatgtggcggctcgccatgggggtcttgtagcttctcggtagcttgtggcatgcagcctcatcagccattacttctattggccacacatcatccttctccgccctcgctgccaaggcatcggccaccacacccacacccactcgccatcgccgttcatcgggatcgagtcgaatcaaatagccgaggagcccaatttcatgtttggttagaataaagggcaaatttgtcttattaagcctctaatcatggctaaacaattgaactctgatgaaaaatttgatgggagtgctacgaatctagaaaaaaaaaacaagtggcatgtgcttctgatcaaaatgtaaaaatgttgtacaatttttggtagtattttcctgtgttatagatcgaaatttctcgtgtgtggattaccacgctcaagttcgttctactattgtgccaaccctttttgcgaggtacattaatttaatgagagataataaaaatgttaaaagatatacatcaataaaaaaattgtacaatattagtccctcaattttataatataaggcaaaagttgtttcataatatatggcatacatgcatgtatgccattaactaacacctcttctccactaaaatattattatttaaattctccactatcaagatctctaattttattagatgcatacattacatttattaggttaatccaaactatgtgatgataataattatttcttgatctttgggttaagagtggttatgccttatattttttaacggaggaagtacatgttgtcagggttacgggttaggcataccctttacccttcgatatacgttacatatcgata

SEQ ID NO: 45619 - DNA, 309 bp, Oryza sativa
aagtttcatttactagatatttgtactgttacatggaagaaagatggcatataagctttcacctagtgaaattataaatattattctattgaggggtagttggaaagaatatgcttgcgcctaattcaaaaaagaagttttcaaaagttctgcttgatagtaggtattgtggactaagattttcaaaatatctattctaatacatctgactattttctctttcatctatgttcacaggcttttgttccatgattccatcccttctgggaattaataactattgtgttgggttgctatttaacttttaga

SEQ ID NO: 45620 - DNA, 248 bp, Oryza sativa
gagggctggggcgccccgaccccctgtggttttggcaccacgtgtgtgggttaggtgagcacagcggggctcacctacccgcatttatagcaggttggacgagcgcgccacgccgcatttaatgcggcgccgcgcacgcttatccggtccgtgaccagtcgcggtgtgtgaccggtcacagaccggtcagatcgcaggttaggtggcaacaggcggcctgtcacacgcctcgccccgtcccgtcggaa

SEQ ID NO: 45621 - DNA, 1501 bp, Oryza sativa
ccatccaaaacggacggccgagatcgatcgggtctacggcggctcacggcagacggccacgatgacgtcagcggtgacgtcaccaccggcggcggctcgggcggcgcaagcttgccggcgaacgacggcgcgacgacgtgaacggagggctccaggacgatgcgggcatcgcggcgaactcaccggtgaccaaagcaacggcggaagatcaacggacggcgacggcgacggcgacgaggaagaagcggcggcgacctacagcgacggcggcggtgctccggcggtctacagcgacggcgaaggggcggacgaggacggcggcgacttggcgaccacgatggtgaccttcccgagcgacgacgacgaccggaacggcggcggcgcacggctgaaacggcggcgacgacggcggcgcgaggttacacggcgctagggctcttccgacggcgagagacgaaggcaagggtggcggcgggtagagaagacactggggatccttttataggggcaagaaggcagcggcgaaggcccacggcgaccggcggcgagaaggaaagtttagggttcggaggagagagatcgatccgaatcgaactcgaatccaacactttccaagcgattttagctggggattccaaaagagaaaaggtagaggagatctcgggaaacatttcccctctattgatttcaccggaaacggaaaggatcgaccgaatttggaaggagacggcggcggctcggcgctagggtttcgggcggcagcggccggaggtagacgacgaccccgacaggcgggccccacctgtcagcgacgggaacgcgcgcgcggctgcgacggactgggccgacttgggccggggagagagagaaggttttgggccgactttcggcccaaagccaaaagaagacatttaaaaaccttttcaatttaaattattcatgaaatgcaattccatttattaaaaatactcccttagctcaaataaatcccagaaaaatctaggaattatagaattaagcaaagtatttaatgaaattttatctggccccattttatgttggaatttattaattaaaattagatcttctcttctaggctttttaaaataaattctaataattccatttaaacaacaatttatatatttaggatttttagggtgtgacatctcactacgcatatcaagtgcttaagatgccggaccgaagggaacaatcaccattcaggggaacacaaagctggcggtgcaatgcaacaagcggagcctcgacatggtcgagcaaacgcccagcccacccgccacgactgagccacccaagaaagtgaccaagacaaacaagacgccgaaaccagacggtgccatcaagattgttccactctccagtgccaaccccgacaagaccgtcaagatcggggcgacactaaacgagaaataggaactcgcgctcattaccttcctccgcgacaatgccgacgtgttcgcttggcagccgtccgaca

SEQ ID NO: 45622 - DNA, 371 bp, Oryza sativa
attcctgcagccccacgcgccatgaagcaaacaccggagatgttctttcccttatcttcatctccactctcaccatctacgatcgcttagtggctcaaacacggcgtagacttgatcaaaagccttcttgagagtctccttgatcttcctccctttgactgtacccttcggcttgttatcattggtcttctcatcaccattatcttccctccttgctctcccaagcttaggacaacgcgaacgaaagtgatccgtaccaccacattcaaagcaaagatttggaccacctcttttcctgtacctaacattagtcacagcttgagaaagtctgttagataacaaaaccaggtcctcctcctcgaattgttaga

SEQ ID NO: 45623 - DNA, 1501 bp, Oryza sativa
aaatcgatatgcaattttattatacaaccaagaaaaaaaacaatacataatacatgtagatccttatcgagatagtcacaacataatacatgtagatccttatcgagatagtctgagtgactgcttttttacatcgctagcttaaaaagtatatatggtgtggaatattgattttttaacaaaaatgtacacattatccaagttatcgcacctctatgctttttttttaagttcttgcattaaattacatccacctcaagtttatatacgtaccatagacacaatttactacttattaaataaacttggttagcacttgagcacgagcttatagagtgcactatctaattacagaactcgtggactaattgcaccaaccatctagtagcgctaactaaaactctaataaagatccaatcattcaacactctcagcattttaaaagcacagatccactcctataagaaaccaccccattgctcagccgaaattctcaaatccactgcatgcatgtcctgtccccgttgcaaatatacaaaagtgaccacctttccagcaccatatctctcgccactcttggataccaaccgtacttaccaacgcacaatcaaaagttcttttgtggacttgtgaaattcccatgggtttttgttcgttccaagacagacgccaccaccactgccatgccaaacaaggagttgcagccactggttgttgtggatgcttagcttgtgcatccaccactatggatgatccatgcatctcccaatggaaatatctctctcagttcatgcgtaatgccgtgcattatgcataattgagaatagttcatcagaaagccgtcccattagttttgttgtgacaatgacatgcatattgtctgaaatgcaatacagctctggactttgaaattttcgtgtatggcactttgttttgacatagaggctggaaatagcttttcttgttcaggacttgttgctacattgaatttcaccgcaaaaatattaacaacgtgatggagtaattaaggattttaattttttctttgtttagaccaagtcggtggattttgataaatatatctagttatattaatgtgtaaaatgaaattaagatggtgacaatttttccttcaaattaagcaaacacctctgaaaacacaagatacccatgaagtagctacttacatatgacttactaattagtcttcttttaatagaaactacaccatctctcactctctcctcattcaacaaatggcatgccatgaccaaatacagcaatatgagatatggactaatagaagcacttcatcaactagtggacggggaagaaaggcagagaaaggttgggctagtgccaaattccactgattagactttgtgaatctccaccttgcctttttgactttggctcctaaatgaatgatctaggttgcatgacatgtgcaataaaaaggggttgagggcatgaccaagaagtagtgcaagggcacatgaag

SEQ ID NO: 45624 - DNA, 440 bp, Oryza sativa
attcctgcagcccaacaccaaccgggactaaagattgatttttagtcccggttatttgaaccgggactaaagatagcgatctttagtcccggattcttagtcccggttgaaaaaccgggactacaggggggttacgaaccgggactaaaaagcatttctccaccaatgtacggttcaaagatgattttgtaactcgatgataagttgagtgaccttcagcgtactttttctgcattttttttgtcacgttaggtgatgaacatgggccctatttttctattctcaataattaataatcctgaaactgaataagtggtaattacttgtactttctccgtttaatctggattcattaacatcaatatgaatatgagaaatgctagaatgacttacattgtgaaatggagggagtagttgctaagatttcgtaaaatataagg

SEQ ID NO: 45625 - DNA, 1501 bp, Oryza sativa
  unsure (1)..(1501): unsure at all n locations
ggagaaaaatagcagctagctgacgagaagcattcgctgtgccttttatacacacagggaatgattgcaataatgcagctagcacagagtctaaggggtgtttagatccgggtgtaaaattttaacgtgtcacatagggtgttcggacactaataaaaaactaattataaaatccatcggtaaactgtgagacgaatttattaagcctaattaatccgtcattagcaaatatttactgtagcaccatattatcatanatggagcaattagggttaaaagattcgtctcacaaattagtcgcaatctttgtaattagtttttttagcatatatttaatatttcatgcaggtatgcaaatgttcgatgttacagggtgtaaaattttttttttttgcaggaatctaaacatgccctaatttcctggattttggagtgaccggtagaacgaaatctggtgatacatgtgacgttgttggattggacatacgacgacgtgggagagcagtagcaattaaatggctctactatggaggccaggtacccccagcggccatagccgagtgtgtagagatagataggagcgtgcaactccatcaccctaccctactcgctgctcttttcgatcggccatgcaaccaaatagtaacatttgtcctcgctcacattcccgtcggaaatttagaatttagaacgaaccacaatacaaatcatacaacaatttagcaagttttgctcaaaataaagctagcctacagctgatcgtttggcctacacagctgatataagccgtaaaacggcatataaacaactttaaaataatttatgcgtaaaattgttatatctatgtttgttcgctatttaaaagttaatgctaaaaaaccattaaaaacactaaaattaaaaaaaataaaattttggtaacagcatataagctgaatggtatgtagacaatggggacatgcacgatgaatcagaaaaattcagagttactacatgcatactccctctgtactcgtaaataaaggaagtcatttaagacaatgtttaagtcaaaccttggtaatataaatcacaaataactctcaagttgttgagtttaaaaatataaaaattatatgaatagatttgtcttgaaaatactttcataaaaatatacatatatcacttttcaataaatatttttatagaaacaagaagtcaaagttatattttagagaccgtatcaccgtccaaaacgaattcctttacgagtacggagggattataagacagtaagagagaataggaagttagtaatggagtttgttaaaattcagttcttgtctttcccaagctgacgggggtagtgaattctgcaagcattacgtatacatgatcagtataaactcaagtcaactcacaacagtgggggaagctgttgcatgggggctgcctcatcacttcatatctaactcatgtcatgcgtgaatgcagagaaatatggccagtgctcatcagtaat

SEQ ID NO: 45626 - DNA, 1501 bp, Oryza sativa
aagaaaacttagcaaaaactcctctctcttgaaaaatttcatttgattctatatcttttatttgattcttgtgtttttctgcaaaccaattaaccagttatttttgtgattttcaatcccttgttttacatttatatttcaaaatcctatgtattttatattacttctttttttttcaattcctacaattaaaagagacccttaaactgcatgcaactgagaactggagattttgtccagatatctttatcggaaaatgggaggaagaacaaaaaacaattatgaaagtttattttttcctacactttgatcagattttgtagggaatgaaaaccgtacgttgaacctcggtttttggctcaagaacagtttggtgaaccttatgcactgatcagtttggtgaacacctcttgccaccattgttgtgatgtactgcatccgtttcaggttataagactttatagcattgcctacattcatatagatgttatattaatgaatcttgacacacatttatatgtttaaattcattaacatatatataaatgtgggcaatgctagaaaatcttatgacctgaaacggagaaagtacttgatagtgcagtggcaagaggtgtgtgatttcaacgtcgaggtcccgtgttcaatcctaacaagtttataatttcttctttaaaaatatttgtagggacgacgtctctctctttaaatctcgtgtctttttttccatggcaatttttggagtgaaatgctaaacactttggagcatataccttgagatggccaatccatatatatatatatagagagagagagagtaaagtagttaatgttaatacctaagtaattgaaaaagtttcatactcatttgaattaggtatatactcaatttcaacaatggtgcccgggcaccatggagcaccaaacaaaaatatatatatatatatatatatatatatatatatatatatatatatatatatatatatatatatatatatatagagagagagagagagggggggatattgataatccaattttctaatattaatttgacttggtccaaaaaatatatgatgtcatgcaaaatctaatctcacatttattttttttcctcgggggagggaatgtgtgttagagtgtgtgatgcaagttgacctacaaatccctctgtcctgatcctgcagtgatgcaagcagactagcagggctcaaaacaaggtgaacacacacacggaagcaactaattaacctgaaacgagttaagttaattcatacaaaacattgacatcgaaggacaatactaataaggcctaactcacttcaagaaaaagacagctgagccatcagaacccaagaaagtcacaccaacatcgatccctggatacttatgtacgtacgtatgtatatacagacgtacaaaaatgtcgtacatatacataatcctagatacgcgctgcgcgctggtgacttacacttcagagagtccaccctcaaca

SEQ ID NO: 45627 - DNA, 181 bp, Oryza sativa
aaattaggcaggccaacctggcccctccgcacgcaacgccgcatcccggcgccatcgaaccctccaaaagcctcgtttaaagcccccacgaaacaccaccacctccttctccctccctccctcctcgatcccattccccccccccctcttatctctctccccaatctcctccacacagcaa

SEQ ID NO: 45628 - DNA, 1501 bp, Oryza sativa
tacctactttgagaataagggtgggccctatgttaatgggtattagttcttgttatagctacaatggtgaaataacaaaagtgggtagtaagctgggccgcacaaccaatagccatgagagagggatgagaaaaatcatttgtttattacttatggctaggtagtaagcatattacctagtatttattacttactactttcacaatgtatacaacctgatagaagtagtattttattttttattacccactttatatgcaggatgcaattactgatggaagaaatgcagcaggcataagccaattctatttttcccttgcactgcaaattaatcttgtatgacaagtaaaaacaccactttttgagaaggaacagaccgcaaaatagatggttcttttttttttcttctatgatcttgtgtgcctttttctcttgtcttggtgaagaggagataatagcaataccgtcatgtccttccgcgtgaagaaaggcaaaaaaattctaatttttttcctgatgaacatataaaggtagtaaaacttttgattattccagccaaaatttcctcaccgttttatttattctcttagactagaaaaatgcattcttatcgtgtcatttccttttacctccagcatcagatgctgccaacgtataagtgtttttttttaacgaatagcatcaggcgatgcaatgttttatattcatggagcatgaaaagaattacaaaaattaccaccctagaggataataataaggaaaattataagtgttttgttgaatgtaacttaccaagggtttaccacagcaatgaccagccgatcaaccctatatatcgatcgtagatctctgtagaaaaaaaaatctgcccccactagtagatagcgtccatacgaaattgtcatcacacatcttaagacattcagtcaaccgctcgaccaccctaaccaccccctggccccccgtccaccggatcccactcgcccctctccccaccgtgagacacatcaaattcaaccgagaaatgcaaaaaaaaaaaagaacggaggagcagtagagaacaaggcgcaaatgacaacaaagacaaaagacaaaagggagaaaggaaaaaaaaaacaaacgttgcctccttccaaaccccgaacgcgaccgcacgccaagtccccacgctgacccacctcgctgcgtgcccgcccgcgacgtcgccgtccgctctcccccccgccacgcccaacccccgaacctcccgcgaaccatctctctcccccacaaacccaaaccaacccgttccacgtctttccccacgaccacgaccgttcatttctttcccacttccccgcgagaccgcctcaatttcctattttttcctttccttccttttccacgcgactctctccttccggcttccgcgaaccctccttccttcccgccttcgcctcgcctcgccttacgcccagagctatatatgccgtccccgccgttgatcccggcaaggcacacg

SEQ ID NO: 45629 - DNA, 1501 bp, Oryza sativa
taaatacaagactccctaggaggggaagagagcggacacccaccagagagaaccaacacaatcaacatacacccaccagaagccacaacatacaagccaacatacgccaagacaagccgccggatatcgacatcagagatacgcctggatcgaccctatccggtaccttcagaggccggccgtagggatctagcactgtctctgattccgtcgggcgcgagctcgaggaggaaggctaccctgttgtcgactacgagtcagaccttcagaccgccatgtcgacaacagttagataggctaccccatatattgtactggtgtgattatggtgaataaaaagcaacatcggctccggccaacaggatgtagggctattacctgacaattcaggggtccgaacctgtataaaaatccctgtctccatctcttttaccttaatctcgcgtataccctagcatcgacgatcctcataccatgcaaataccagaattgcgacatcaaacgtcgacacctacaaatatacatttagcatatcatattcaggtaactgtagatgtttttagcagggtggctagtgaacagcacagcagtacagtacagaagtcccgcggatccttcctcctctttttcggatcatagttgggccaggcgaagaattttggcccatccagatcactccataaggcccatttcctattcggctcggctaagttgtcgcttggtgggcttcgggctcgtcgtcgtcgtcgtctcccctccccccacctgacttgagacggggagatgcggaggccgtcgccttcgccgccggcggcgaggggcccggcgctcgccgctgcggcggccgtcgtcgtgctacttccgtccatcttccccgcgatcttcaccccgcttggccgcgccttcccttccctcttctcggtgagcccccctcctcccctctctcctcctcgcgcggcccgaaattggagccgatgtgctgtgaagtaagattcaaagctactcttcgtagatttatgattggtagctccagggacccaatcacttgggatgagcaaaggtcgtcttccattttggcagatagctagttccttgtagtgtatgagggaagaattggtgtgtctaattgatgagaattttgcttgtgctcttctagtttaggttttatgatcttatatttgctttgagggttaactaggcagggttttgtcaattgtttgcaggagtggaatgcccctaagccaatgcatgagtctcttctgaatgaggctttgcggcgaacaattgtgagtacataatacttagctgaaaactggagtatttatgttggagcccatctgtaacttgtattttgtacagtcaaacgaacaaaagagagagctgtggtcaccattgccgtaccaaggttggaaaccatgcttgaagtcatcaagtgttcacggtaacctactgaaatggcatgattccgacagccgcagcgatagaaaatcgattattgatc

SEQ ID NO: 45630 - DNA, 1501 bp, Oryza sativa
cggaccgtcatcttcatcatccttcatctttgaggtgctctgatctccatctgtagccttctttgtttgctttgcgtattgctccgcaaactgcttgtagatgaaactatctttggctgcatggttagagtttggatgatgcgagcattaggcgttcatgatcttgtcgaaggtgttgatgcacgagcgctgtcaggaagatggcgatgcaagtgctacaaggtcttcaggcttacgcttgtgatccttatggttgttgcttccactccccccggtgactgccgtatctttcttggacttccaattgctacccggctgcttggaggcggtgacggcatcatcagctttggcatattcgttggctttttcgaacatttgcttgaccgtcctgggaggcttgcgtccaaattttctgactaagagttcgtgacggacacccttagtgaaagcggctatgatgacgttgtcggtgatgtcggagatcttgttacgttgcttagaaaaatgttggatataatcccaaagggattcactaggcttctggatcacattgtagaggtcgaagtgggtgtcgggacgtttgaaagtgccttgaaaattggcaatgaagtgctcacgaagctctgcccaagatccaattgtgccacggggtaacccatgaagctaggaccgagcagaatctgctagagctaccaacaagtagtttgccatagccttgttgtctcctccttctgcgcggattgcgaggccatagacggtgagccaagactcaagatttgttttgtcgtcatacttctcgattccagtcggcttgaagccagccggccaatccactcgacgcaggtcacttgtaaaagctgcaactccatcttcatcgtcaccgtagcggtctggtgatcggtgtgggacataacctctctctacacggcgtcgattgagtgtgtcgcgaagattgatgggctgcctgcgacatggagagcgaggctatttagcacggtgcactctgtgtctgtcggcaggcgagtgaacagaacgttcaacatgatctctgctcctgcgattagatcctgacgcggcaacgctgaggcttggttggtggtaatcttgagattgaagaggcggaacccgactgctagtcggcgtgcggacacttgctgagttaactgggaccgaggcggtgatcatgatcttcgtttggttaatgatgttgaggacgtggttgggcgcatcttcctgaagcaaagtatccagaagagtgattgtcgtgactgcgttctgctgtggggtgcgaaaaaccgtcgtctcctcaacgtcttactgtccaatgagttcacgtgctcatcacccggcttccagggtgcactgtcgttgatcctcagcctcctttgcggcccgctcgtgttcccgctgcaactggtctcgctcttgcgcttgtcgttcctccttcagtcggcgacgctcggcttcttgtcgtgtgcgctgttcttctgcttcacggagc

SEQ ID NO: 45631 - DNA, 1501 bp, Oryza sativa
aagggtattgtcacagcctctattcgggtactttccagtatcgcgacgcatggtagacatgatgatgaggctgtgtcttgtgggtacagtggtacacctctggccagagtaaaactattcgaatagccgtgcccgcggtcatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgtcatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgaaagtatgtaacactattattgatgattctgtatattaaattgtcagtttgtgtacctcggctgattcctggacgaggattttatgcataaataagttcggaaattactagtgaatttctgggcgtgacagtgatttaatcagaagcaagaaatgagagagaaaatatagacttattcccacatgtgatgtggaagaagagagagtgaaatatgggctgggttgctccaaagttcagcccaacattgatgtgttttttttggaataggttcacatcaggtccctaaaccaagttgtcgccgagtctaaaatttgtcctaaaccgcaataccaaatatgacacatccctcagctttcaaaaccagtgcaaataaggtgccaaggcggtttgggtggtggtttcagctgacatggcacctatgtggcattgatgtggcacttaagtaaaaaaatgtgggacccgcatgtaagtgactgttcggttaaaataaataaaatattacagtgggaccctgtcacaccctgaagttctcctcccaagcctaaaatttaatttataaatgaccctaagaaaatgccggtgtacatcaagagaaaaccctaagaaagtaatacaaataataatcgaatctggcatgtggaatttttcttgagttttacatgtcgaaattcactaacaggatttttagtggaattttcagagccctagaaataattttaaccaattaaaattgagcaagcaatattttaattccagggaaaatccttttcttcctttttctttttctttttccctcttttcttttcgagtgggccgccggcccattctccttcctcctctccactccgctgggccggccgaaggccaaggcccagctaggcgggcagc

SEQ ID NO: 45632 - DNA, 881 bp, Oryza sativa
acagcaaccatgacaggtcggttcaagaatttccactctcaccatacttccttctgtaagcatgtaaatagatcattacatggccaatgttcctctcttagtctatactctacagtaacgaaagctatcggcaaacgtggaaaccaccttcagcacaaaatttataaaatatatctaactctatagtgataatacatcagaggcaacacatgggcatgccaaaattaccttatgcagcgaaacaagttcgctcgcaaagcgtgtaaaagatgtgcgactgtgcgctgatccaaagttgttaagaactattattatttacccccttcctggaaatcctcgtttgctaaaattctccattccgtttcgctcgcaaagcgtgtaaaagatgtgagactgtgcactgatccaaagttgttaagaactattattatttacccccttcctggaaatcctcgtttgctaaaattctccatttcggataacctagccgtatgatctctcaatctaatcgactcaaaagcctactgaaatccaacattatacaaactaagtaactcttaaacaatcaaaacctaaaacctaaaacgagtaaaaaaaaaggggaggaggggggtacggcttctacacgctccaaccccgatttctcccacagcatagatgggctcctactcctacatacatccccggatcaccaccagaatccactccaaaaccccaacatctacaaaagaatttttaccattgcctcctcttctcccatgcgcgaacgaagcaaaggggggcgcgcagcagcaaccggcagccccgccgcgcctcctcccgccgacgacgatccccgcgacctccccccctcgccgtactccccctcgtcgcctcctagg

SEQ ID NO: 45633 - DNA, 558 bp, Oryza sativa
cgcccgcagctccagcagttcctgcagctccagcaccagctccagctcccgttcccgtgtcagctcctgcatccgctctctccttcgcgcctacatcagccgtcagggtccctgccagtggcaatggaggttggttgccagctactcccagtggcagtcgcgacctcagcagcagcagctccagtggctcagagccgggcagcggcgagacttatccgccaggctccaggagtcgctcagagggacctggtgacgagcaggaggacgccttcgactccaccgaccgcaggagccgttccgagcattaggctcgttttccattagtttatcgactgtctagcatttatttgttagtttgtgtgtttaggttgcttgcttgtgggtcagtcgacggtcgatatcatgtgcctatgatatggttgtcttaataaggatttttgcttgctttttaagtgttttaattcagatcagaacaattgcagtttaaattcctatataataaagcttagttcttgagcatctgtttttcttcttttccccgtctgctcttcctccaga

SEQ ID NO: 45634 - DNA, 327 bp, Oryza sativa
taactaaacaaggccttagttgtacgcaaaatgagaaaactcatcagcatataattaattaagtagtaatgattataaatttaaaaaatagatttattttattttttaaacaacttttatataaaactttttttgaaaaaaaatacatctcttaacagttaaaaaaaacgtgctaataaaaaagaggaagtttaaattcagagttaaagaaaagaacgggcctaaatgttagaagtacatcggcaacgattcaaagttttactggaatgttagaagtacatcggcagtgattcagtaaaactacctgggtcccttctcttttggaga

SEQ ID NO: 45635 - DNA, 285 bp, Oryza sativa
tggctattagattgattatagatgaattggagatagtagcgggctatacatttaaacttgctcaaaaaggtgttactagttaattaacacgaaacctaatgctaatctacagtactatctaatcaccacgtggttagcttcgattaatgtgcacgtgcgtgggggaagtttcccgaagagtctggagacgagtgccaaaaaaagaaaaggaattgaacgagtcaaaagaggttttttttttaattatttttgccgggtctcgccgcgaagacgccatcggaggca

SEQ ID NO: 45636 - DNA, 166 bp, Oryza sativa
aatttttgctaccagtacgtctactggtctcttgacaagcgaattgaattaaattaaaatgggacaggaagccatgttgttcttggcaaatcaaattgttcttgacaagcgaattgaattaaattgaattgatgtagttttgacccaatgggccttctatcttagg

SEQ ID NO: 45637 - DNA, 1501 bp, Oryza sativa; identical to SEQ ID NO: 42606

SEQ ID NO: 45638 - DNA, 1125 bp, Oryza sativa
gaggaggcagccatccactgggcctcactctcctcttgttgctgcctcctcctcttgttactgttcagtctcaggctctcaggctcacaggaaaggttttgggagatactagttaggagggaaaggttgccatcttgtgtgtgttggatactttgtgagtcatgtcctctttatcttggtgcttttgctttttcttgtgttttttcttttctttctcctatcttcttttgccacaaaacttatggctattgttttcatccaggtagaatacaacggggataacgattctctctcagctaaaggaggtgagattcttggtttcacatcaagtattattgttctttcttttacttccttcaaaatagtttctttgctttttatttcatatatggtttggtttatttatgctccccaacaagcaactggttcatgtgcggtaacaaggagcaaataatgcagctctgattgacttggggtagttgttgtggtgatagattggaaagggtttaaatagcgggtggttgtggtgatgaatgggggccagccttgatggggttgatgctgtcgtcttttaggtcggggaaacaagtgggataggatctctctcaagtcgaggtgagtgagaactcagccaagaacaacaatggagtctctgttgctttagttctgccagccaattggtttcaactttcaacgctgctacttgttattcatcacctcctcggatcggtttgatttatgctcaaggttgtgctatgcatggtcatgctgattgagggcaagatttgcagggagaggaaggatccactgtgtttcttttctgggagaaaggaaagttgaggtaattgatcgttttcgcctttcttctcttgctatgatccccacaataaagcgcgtataattcattttggatggtatgttgtacttgtctttttatctgaaagacaaaatgattttggtacccgagatatgtttattgcctttctcatccaagttctgcaatttgttgtgacgtgtgttctttctgttccttcttgtttcttgaaatcctatcagatttgcaatatatacaagtgtgagcagcagcagttgagatccttaattcagccatggcttcttttggga

SEQ ID NO: 45639 - DNA, 1501 bp, Oryza sativa
gatgatcgaatttatcgtgtagccaaggatgaattgccggcgtttcacgctgttgatggtgcgtgcatatataagttggcgccggcaagtcatttcaggctacatgtttgcctcctcctctcatgctagatcaaagatgtcaggttttccaagctctcgatcttctcctatgtacgtatatatgcatctggagcgaaaaggtgcgcgtggattgattttcattacacgctatccatataatcagaagatcgaatttgttctgtgatcgatgcatgcatgatactactaatgcattaccacgaatcactacatatacattggtttcttctcatgcagcttaccgtgttcagggtgtgatcataattaacatgcaaagctgcagcctgcagccttgcgaggagatctcattgcaagtgtacacgaatctataaaagtttcttgatgtactcagacgtcaaggcctattagctcagctggttagagcgtcgtgctaataacgcgaaggtcgcaggttcgtgacctgcatgggccattttttttgttttattagtttttttattatttttttattttttgttttattagtttttttttgtgattttctgttttattagttttttttattattttttgttttattagttttttttttgtgattttctcttccccttgaacctgtgtctggaactagccacacattcccctgaatctgtgtctggaactatttattattttttttttgtgattttctcttccccctgaactgtgtctggaactagccacccattccccctgaacctgtgtctggaactagccacccagtgggtagtgcagtaattatcgaagtgatttttttaatataattatagtataattataatataagtactttaaaaatgtataacttgcatgcaactactttaaaaatgtatataaatttttttatctaaattgtatagatattatgatgtagttacagtaccaatgagttataatcattgcaacttattgtaactataatataattataacttatgcgctacgttagtgtagcgcgaaatttgacatatcatcgtacgattgaaaatttaaaaactagggaagaaaaaactgtcacatgttttctagcagttcggactaataaatccactaaccatgcacacaagaccatatattcaagtttaaaaagatatatattgttttgtttgatttatagacaatggcgaagcagccaattaagcagggtgtagactgcagagtatttttttttcttgaccagccgggacaggcggttgttgactagccgaatcagggctcacagccgccgccgacgcatgcaaagcgcacaaaagcagacaaagctttcgcggtaatccatccattaatcccttataaatagtgtactagtgcacacgttaattgccctggtagagtggtaattgctcgcgcgcattctgcatgcatgagcgcgcgcggcggtgtcacgatggcaggaggcgga

SEQ ID NO: 45640 - DNA, 1501 bp, Oryza sativa
gcgcggtggcggctcgcgactgggccagggcggcgatcacctgaccgccgcaacagtagttaaacggctgcaggctttctcgaagctcacaagctctgaatcaaactgaagaaattaaactgcaggccaggttcagtgtccctcccgtttctgaagaacttcagattaattacagacgggagcgtgatctccttctagatcgcggcttgcgtcagtcacagtctcatcacagatattgtagtatacattcttctagcttctctcacacagcacttgaatggagagagaagaattaatagaattctctcattatctggctgattatttagagtccgagccggcattcttcagacgtagacaggtctgctattaatataggaattctctcatgcaggctgatctgctgatgaagcacacaaggcatcgtgccggcatgtcaaagataggaaataaacaacgatcgatgaaaacaaatctaaatatcagctcaaaaattaagtttaaaacttaaattttagctgggacttgcaagctgaaagacaaacgataggatcggagtcctagtttccaactgtttctttccaccaaatgaaggattcaagggagaggtttcaaggtattccactacttcctctatccacaattataaacattcgaaggatttgaaatttatctatagatataagcatttgaggagtactatttatcataccaatcataactcactcaaaacaccccttttaaataagaggcgtcaaagttttttctcattgatcttaatctctgctaaagaatctataggtgcttatatttatgaacggaggaaggtaccttgcaaataaaagggggagaggtttgaagtaaagattattcttagctacattggatgagttttagattaagactttttttttcacacttcttagacttgaagaaaagatagttagttttgaatgaatcagagttcgtttgcttgtcatgatagaatttgaccctccacagaagtttttccttgaacttggactgggcaatagttcaatgcgagcctaatttaatattccttgcaatctacgctgagttggattgcatttcaaaatttgttataaattttgcagttatttcatgcatttacttttaaaatgcaattaatatcaaagtgataattttattcagttttgtagatgattttgctctattctatttctaaatgctccttccaaagtctcaatagcatcaaaacataggagtaccttaaattttgaacttgtgaaaattcagttcctcccaaaattcggcccaagttgcacttatcatgaaaatctggcccattatgccaggcccacaaacacaaggccttcttctaaaagaaaaagaaaactgggcatctcaaaaaaaaaaaaaaaatcttggtcgtctcgtcgtcatcgcctcgtcgcctcatctcgatctcgtcgattctatccgagcagtagactagggtttttgctgctcgagcggagag

SEQ ID NO: 45641 - DNA, 1501 bp, Oryza sativa
tgcggcctagggaatccacaggattcccatggcgtcacttctctgcaaattctttgttctttcgttctatttttctctttaatcgacttcgatcgctcagccgaatgaagaacggcagcatgtgtatgcttatgatcagtttaggtgctgtttggatcatggcattacaaagagccaagaaacgggttgtgttttacttgaactgaaatcgatggaaatcgaattgaaatgacaatttccgtgcttgggttctatccctgaatcaaattccttacccttggcttaaaaaacagaccgaacagtttttctatcctctacctaaagcatgtgcctcatctgcttatgcttatcagacaaattttaaattttcaaccttaaattttaaagttgattttgagatttttttcattgaaatttatttttagcttttgcttttaaatcgctaagaacacgtatataaaagtctatttaccaattactttttatttgcaaatatgccaacgatggctccgtacatgtggaaaggacttagtaagagaatatgaacgaggtttaaatttcactgattcaatttgatttaattaagcctttatataaatggtaaacatgtctccgatcattgaactctcattgattttagtttacaattgatattcaggcccatcaaaaccttccagggctcctttagattgaaggaaacttatagtagaatttttagaggattaaaaatttggaatctgtagagaagaaaaacaggattgctaaaaaaaaggtcgctacatttttcacttaattttagtccattgttctcctatttgtaggtataagcttttaattctcatatctcatctttcatgtaaataataaatactccttttttttaataatgggaataattgtattagaactgaaattacacccggtctctgcatcgactggagatgcacacgacctaaaataataaacacgtttaatcctaattttcttatacattgtgtgttagaaaatttgcattgtaaatgtttcttacaatgtaattataaacttgcagtgtacttacattataggtgtagaggtaatttacaaaagacgacttcttttttggaaattgtgatgccataacaaaaggcacactttctaaaaaaaatgcatctttataaaggaataggattgtaaaattctcaaggatatttttctttactaagtccgatgctatactgctcttttgcatgtgttttcctcccaaattctttctgtttcaattcctctgagccatctaaacacattatctcgagtgttattctgttctgaaatcttatgatattacatagcacttcctccgtttcacaatgtaagtcattctagcatttctcatatctagattcattaacatcaatatgaatatgggaaatgctagaatgatttacattgtgaaacggatgaagtacgtggtaatatattcctatgttttcatgtttcaaagctttggaatcatgggttt

SEQ ID NO: 45642 - DNA, 1501 bp, Oryza sativa
gacggctgcggcctagggaatccacaggattcccatggcgtcacttctctgcaaattctttgttctttcgttctatttttctctttaatcgacttcgatcgctcagccgaatgaagaacggcagcatgtgtatgcttatgatcagtttaggtgctgtttggatcatggcattacaaagagccaagaaacgggttgtgttttacttgaactgaaatcgatggaaatcgaattgaaatgacaatttccgtgcttgggttctatccctgaatcaaattccttacccttggcttaaaaaacagaccgaacagtttttctatcctctacctaaagcatgtgcctcatctgcttatgcttatcagacaaattttaaattttcaaccttaaattttaaagttgattttgagatttttttcattgaaatttatttttagcttttgcttttaaatcgctaagaacacgtatataaaagtctatttaccaattactttttatttgcaaatatgccaacgatggctccgtacatgtggaaaggacttagtaagagaatatgaacgaggtttaaatttcactgattcaatttgatttaattaagcctttatataaatggtaaacatgtctccgatcattgaactctcattgattttagtttacaattgatattcaggcccatcaaaaccttccagggctcctttagattgaaggaaacttatagtagaatttttagaggattaaaaatttggaatctgtagagaagaaaaacaggattgctaaaaaaaaggtcgctacatttttcacttaattttagtccattgttctcctatttgtaggtataagcttttaattctcatatctcatctttcatgtaaataataaatactccttttttttaataatgggaataattgtattagaactgaaattacacccggtctctgcatcgactggagatgcacacgacctaaaataataaacacgtttaatcctaattttcttatacattgtgtgttagaaaatttgcattgtaaatgtttcttacaatgtaattataaacttgcagtgtacttacattataggtgtagaggtaatttacaaaagacgacttcttttttggaaattgtgatgccataacaaaaggcacactttctaaaaaaaatgcatctttataaaggaataggattgtaaaattctcaaggatatttttctttactaagtccgatgctatactgctcttttgcatgtgttttcctcccaaattctttctgtttcaattcctctgagccatctaaacacattatctcgagtgttattctgttctgaaatcttatgatattacatagcacttcctccgtttcacaatgtaagtcattctagcatttctcatatctagattcattaacatcaatatgaatatgggaaatgctagaatgatttacattgtgaaacggatgaagtacgtggtaatatattcctatgttttcatgtttcaaagctttggaatcat

SEQ ID NO: 45643 - DNA, 1501 bp, Oryza sativa
tttcttgaacctctgcttcatgccatcaccgtcaaagagccgttagttggcatccttttgtgtatttaattttcttttagtgactaaaataacctttgacttgttgattgaaaacattagcacaccgtctaccccgacaaattgatctatccctgtctcccaaagttccagtgaggcggcgccgactccccatcgatgcaacgccgggactacccgacgcgccgccggccgctcggatgcccatcgacgcgcggccaggcgccaggctcgccatcgacgtgtggccgggcgtcgggctccccatcgacgcgggtgggcgtgggcggcggcggatgaagatgatgggtggtggtgggtgagctgcaggtcggtggcagcacggatgacaagggctagcgcggagaccatggcggaggcgttgtggtcggtgcgcgccgcgtagtagtactgcacgtacgtctccggcgccagagcgccaccgccgctgacgaccgcggcgagctcctcctcgtcctgctacttctgctttgctgctgctgctggtggtggtggcggcggtggcagaggcgcagctgtttgctgcgtcgacgaccacgggatcgagctgtggatcgatttgggctttggaggcagcgcgcggagacgatgaggattgaggacaacgtatgctgataagaacagccaagagagagaggagacgaggacaacgtatgctgtttttttttttgcattacgtacatttatttctactacatttatatagttcaatcagtttgacagtatatgcattcatatgtcgatagattacatacatatctccctggaaataaaatgtcagttaggggtaaataggtctttttatagcgctaacggatgcccaactaacggctcgtggacggcgatggcacgtagcagaggttcaagaaaacacgatgacatattattgaacttgataaagtcagtggtagattgtagaagtggaaaaaactcagtggtactgagtggattctctcttcaaaattgcagcattgatcccatgctgcaactgctgcaaagcagcatctctctcacgcccaacacttttgtctaaagaagcgtgctacaacccaacgataaaattatctcccgctcgcgcccactcacgttctctctcttcagctcttttctccatattagcattgcaatctacgtggacttggcgtcgtcgatattgtacctgctctaagcttatgtggaaaaaagatataaagaaaagtgaggagttggcacttagagcaagtttaggagtatagctgactactatctccaaatcatctatagctaatttaatagttcattcatataatagtttttttttcgaacggtcgatcgttgccaacgttttatataaagaaggtgccccattttaagggtaaaacggtgccaaaccttacattacgctcaattaattaggggaaactgagtgaaaaccacaactacaacaacccaccaactaacctaa

SEQ ID NO: 45644 - DNA, 1501 bp, Oryza sativa
gttctctaaataatcgtgtattgtctaagaactcatatcaaggtctacctttgaacataccctaaccatctctcgtatgtcttctaaactatgtttggggagtttaatttctagcagttacagtttcttcaagatctttagctccccaaatagccatattcccaactagattctaagaatctatagcgatatacataattcaggaaattaattagaaaccagaagcttgaaaatctaaccttttcatattctcaaaaactgatatcaaccagttatttctcataatcataagctctccagtcatggaaatgatatgaaaaagtgtgatatatatgccttcttatatatatcacggtgtatatacgtacgtacacttccacgtacgtttatacacatatacgtatatacatgtaactgcaagagcaaacatacgtccacgcctgcgtgaccacgtgtcccaacagtgcatcgctgtagccctcggtcgatccacaataatgccttcatcattccattcctaactctccataccacgaacacaccaacacacacatgtacacacaccagctaccagcagcagctggtgctaatatatagctactccactagtttactccatagctcgatcgatctctcgtagcttgtaacccccccaattaagctgcagtgacgcaaacagttggtttgtccggcgtcgactccggccattgctcctcatcgatcactgatatatcgatctctgaagcaaaaaaatcactgccaaaaacaaacaaacccttgtggtcagagagagagagagagagatggtgatgtctagtactagtaatacctaaagctcactctctcagtactcatctttcagcttcctgtgctgcttagctcctttcctttcccctttcctctccaaccttttctttcccctctccttaagcttcgatgcacacatcaccatcttgatcgatctcatcatcacctgatcactagctagtagtgctagtagctatagttctcatgtgaagagaggaagaacagaggaggagatcgagaggaagaagaagaagaagaagaagaagaagaagaagaagaagaagaagaagaagatagtggctgtggctgcaagcctgcaacagtagtactagaactatagatctcactcccagtaggaagctatagtacacaaagtgagtgcaaagtagtgatacacaaaatgttgccttactttcctaaccttcaccatttctgcatctcccaagaagcccagccgccaccgcctccaaaccctacgaccaccatgcagcagcagctggatcagcagcagcagcagcagcagcatcagtacgaccacttcttctccggccacggccagttcaactccgagacgctggaggccgtgctctgcaggccgccgcgcggcgccgccgcggatcctgctgttccggcggcggcggcggcggcggctgttctgacggcggcaagaaacggtggcggcggccatggcagg

SEQ ID NO: 45645 - DNA, 898 bp, Oryza sativa
gccaccaatgacaccacccccctcacctgctgctctggaatttctttcctcggttggattggaattcaaggtagcagcatgcaacttgcttgaaatactccaattagtgaggcttggttatgtacacacttcataattgtcgtgttaattgggaaggattatgcaggattacgagcataccgctaacaatttaatacttctaaatcagctgatgtggctagaggattaactttgttttattacttcctctgttcttgggaatagaacaggagaacataagtatagttgggatgggatttgatatggaaacgaatcataggtgtcactgtctgaaagcattgaatattacagttattgtctgcaatatccaaagtagatttgatcatatccaatgtaaatgatgaattgttcctatttacaaactctgctcttagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtaggaaaatatgctgacatggatctcttgtagagagcttatagataaccattgtgggtgcccttaggtgtttcagatgccatgagatcttgtcttgctctaggaagcaaggatagaagtatgtggctgtaaacagcaagcatagaaccatctcttttatgcggtttcgataagaatatatataatctgcattttctccccttcctgattttgacaaattatcttctactgagttatctaaatgtttattttccttagtacaaga

SEQ ID NO: 45646 - DNA, 1501 bp, Oryza sativa
aagcggaaactataaaagtggtttccgaaccgtttccatccaatcgagtactctacctttatatctttttcttactactttaaaactagctttatctttatgatgactagtggcccacagatcagcagtactcagagaaaaaagtacaacaaactccgttggggattgtgttgacagcaacctcatcagaccactagcaaccactagctgatgcttcacgaatgtcacaccctgaagttcttcccctaagcctaaatggaattaataattggtctcgagaaaatacctgtgtaaaagcaagagtgaaaccctaattaattaatgtaaataataatcggaattggcatgtggaatttttcttgagttctacatgtcgaaatatgctaacaagatttttagtggaattttcagaactctagggataattttaaccaattaaaaatgagcataagcattatttaaatccctggaaattcttttccctttttctttttccctttttcccctccttttttcctaatgggccgccggcccatttcctcctccctcccgtaccgtgctgagccggccgaaggccacggcccagctgagccgcgcctcctccctcctcccgtcgggtcgccgacaggtggggcccacctgtcgggcccgtccccaacctccggccacccgccgtccgcagccgccacctcgcaaccgcccgcgccagccttccccgcgccacgtcggccacgcccgcgtgtgcgcccgcctttcccgtgcccctcaactccctctcccgctcgcccgcgcccccgagatggccgggatccgcctctctctccacctccacctccccatgtcggccggcgaaatcgggccgctcccggccacgtccgagccccctctcccctatttaagcatcaccgctctcctctctctctttttctccatttcgccgagctcccccgtgccctccactgccctagcgccgttgccctcctctccgccgccgccgccgccgctccggtcgccgctagccgctgcgccaagccgcgccatcgccgccgtcgggttcacgagcccgggggccatgccgtccacccctccgccgccaatttcgacatcttggtacatcttggtacatttttctttgagatcttagtacatcttggtactgcctggatgaatggagtactgagtctgatgagcctcggtgagtatcagatctttcagctctttgtcatcaggtacgcacaatctttctcccaaccagattgtgccgtgctcatcttcaaggaaatcctgggattttccaaccctcatattctttttcagctctgctatttcaggatcatttacctgagctgctcggacttggtccacgagcgtaggccgtgcctctagggcagccatgtacccgtgttctacaattcccaagttgagatgttcaagttcctgctacaattctttacacatgtcttcggtgcacgaagcgttgcagtagcttttcctgcttaag

SEQ ID NO: 45647 - DNA, 1501 bp, Oryza sativa
aatgtgtaatcagattttagatggataggtagtgagctgtccttgtgagactgagcaacaaaattatcccttgtatatgagcaacaactatagaaatttcgaaaagataaattactgagtgctaagaagcctgcacaaacaagaaggaattatccatgttttatttggcattgcatgtctgcaccagcataaaactatcattgatccttttcacttgttagtcatgatccagcattccagttgctaaggacttacaattagctgataagaaaacatgacaaagccatactattggatcacacgttcaacacataacccgtgttaaccaaacaaatcaagattgactcacttctatgaaaacattatattaacgcaaattatctcaaccaaaaagaaggaatagaaacaaccagtaatctctttgatgcatagtagacaacatcagatgccatggtgtcctcctgatggatttgcttcgacagcctaaacgtttttcctgcatttttttaacctaaaaagaaaagttagataagttcgctagatatgaaaaagtgacatgaattgtgatagttaatctacatattgactaagtttgctaaacatttcagaatctagaacacaccatgtatatttaaggtaacatagttgattaactatagaacatctacaaatagtgcaattcatgcaatagtgttctatgtaaaaatatatggaacgtgatcctgacctcagattgtaagtacagaacctctatgctctcattgcaagtgcaagcagctaaccaacatattaccgtttttgctttgagtatcttgtaatgaacgtgtgatacaatgcaattacctgctacaagttggaagtcatgatccaatttcaaagaactgtaattgattgataaaatatgtgacaaacggaatacaaaacatgcattgaggtgtaaaaaccaatttgagaagtagaccattagcaatatatggatttgagatctatcagacaaatatgaatgtggtacctgttcttatttagtttattacgactttgcaaatgaagggaaatatggtgtgtattatctgtatttgcatacgattatgatgtagagcatcctccgttgtttattgaagtaggccgaggcaagcagatgatttttttttgaaacacggcaagcagatgattgactcgaatacttctagccacacaagtcaaatagctcccacctgacaatatcggtggattatttggagcaacaaataacatcagttctaaaacctgaaaccaaaataaaaaaattctgctactgctgctaacatgtggcattagtttagtcaaaataaaaagattagccactaagtgtgattggaattttggcactacaaaatcaaacaatgattctttgacaacttattgcttgtattattaagaacctttgataccatcaattttcaatctgttgcagttcctgctacagtatgcaacaaagtttctccaagccaagagtttcagc

SEQ ID NO: 45648 - DNA, 788 bp, Oryza sativa
gcgtggtggtagcacacttcctcaatgaactaagggcgtaaggtaaaaccgtcgacagtaatatagcaaaattccgtttgtgaaatttagttttcccaatcccttctttctataaagtggccaaaagctcaaacctcgtgcttccacatcatcatcaaattgtgaatcgtttgatgaatacattagatcacttcttagacgttggatggaatgcagcatagagcccaacccattagtcaccgggtgagtctcttcgcctcatcagtgccaaatatagctcacatgaacacattggctcatttctatacacatctacatgtatccagcctgtcaatccgtataaaagagctttatggctgaacgccccttcagttgacatgtgctacttaaatatctacaaattttggatagggctgctaaaaagaatttctccaaaaaaaactatttgttttttcatgagatggtaactcctatctaataaattgatgttaactaagtccgcagcaatgcgcggagcatcctctagtatataagaatatactaagcgggccaggagtgtacaagaatactcctgggccaattcttgggccgacattctcaccaaagtggaccgtttggattatttggcccggccgctctccgacaattctttccccaattattccattctctctcctccatcttccggttgcctcgctatcctctccacctctcccaccaccacccaagcagccaaggcggaggaggggagccggccggcgacgcgcgcgccaccatcccagcgacga

SEQ ID NO: 45649 - DNA, 1159 bp, Oryza sativa
aatgttgcagcaaactgatagttttctgaaatttactctatcttaaatgataaatatttatgactagagtgattatcaataatatcttgcccttttttaaacaaatactccctctatctcataatataagacgtgcacatattacaggattcaactttaaaaacatttgacgaataattattataatataaattaaattttatttattaaaattaatattattggattgacatttaaatttactttaagatgattataattttgttgcaataaaccttataatatatgagaaattttaagttaaatattagttttgaagactgtgtcaagttcgacaatgctttatcttataggatgcggggagtacaatttattaaagatgaatttcaaatatgtatatatggaatagaatcctggtactatcgcctaaagcaaacatcgtgcataggatatagatataggctttcttgatttcgacaggaaaggccgaaagggagactgaactacagaaaataactttgatgagcttgacagggggcagcggtgttgtcgtaagccgtagcgaccgtccataagtctctactacaagcgtgtgcagtgtgcacaccgcttaacaaccggcatctcttgggctgcctccatggaaaccgcacatttcgaggttttttgcttgctagctagctcatcatgatgtgtactaacgtactccctccatctacttttgatagttatatttccaaatctgaaaattttatttttgataggcatatttcaatccaacaacttatcatcttaatgactttcttagatttaatgcatgactcttcattcttctacacatgattggctacatgggcatttagaaatgtaaatattaatgaatcacttgtttacgaggaatgactagtagcatatttaaatggatgataagtaaaattacttatccttggtctatgtgccaagattaaatatgactatcaaaagtagatggagggagtagtagcaaatgaaacattaacgcttgtggttattaatcatacgttgcaccgacgttccaatcgaattaattgcctcctaactaacgggtttttaccatcaatgcaaaatccgcatctcttataatcggttgatcaaatgagaacttgtgaattgtctgtca

SEQ ID NO: 45650 - DNA, 677 bp, Oryza sativa
caaggattatgagaagctgtaattgtataataattcagaaaatgacatagaagttaaaagttaggttaccagcttctctagattctcaccagttaatttctcaccggctacttctcaaaatcttaaagtggtgtttgaatgagaggggactaattttagtccctgtcatatgcgctcattaggagtattaacatagactaataataaaactaattacataataagagctaattcacgagatacattttttaagcctaattaatctataattagcacatattttctatagcatcacataggctaatcatagattaattaggttcaatagatccgtctcatgaaatagtctaggattataaatatattttatcattaatctacgtttaatacttccaattaatgtcctaaccttaaatataatagggactaattagtcacatgcatccgaatactacaacattaacgccgtgtttatttccaaagtttttctttaaacttctaacttttcaatcgcatcaaaactttcctacacacataaattttcaacttttccgtcacatcatttcaatttcaaccaaacttttaattttggtgtgaaactaaacacagcctaagatctctccctatcaatcgttatttttttctgaaagcctttccgtttttttttccccaaaagt

SEQ ID NO: 45651 - DNA, 208 bp, Oryza sativa
tacatccgataaattttgtcaaaaaaaatatataacaaaactgttaacgaacaccttttgtggatcgatccgaacaactctgaactctgaagtgaaatccttttcgttttcgaatcggactcacactaaatctcctcatctttttatatcacgagctatcgtgcaatttatcgttgatcgatcgaatcgtggtgaagaaatctgcaac

SEQ ID NO: 45652 - DNA, 160 bp, Oryza sativa
cgttcactccgatgtgatccagtgccaatttgccattaacagtactccgtacttagcttcgtcacatcacccatacggtacggtacggctgatgcaatgcatgcaccatgcagcactaagtggtgtgtttccttaatatacttgttggacattaactaga

SEQ ID NO: 45653 - DNA, 1501 bp, Oryza sativa
ccgtcacagatgtagggttctggcatagtgggcggtgaggaggactggattgtggcgttcgacctcgagccccgacctcgtcggtggcccgccggtgacgacgacgaccagagacgcgcgcctctacgtcaccctggccgcacttaggggctccttggtggtggcacaggacgacggggagagcgcggaagcggtggtggtgctcgacgacgggagggtcgtcttctgggtgtgggacaccacgttttcacacgccgatgccggcggcgtcatgctggtgtacgacccggccaccggcggccaaacggaggtggcggctatggcgggtgccgtccatgtcggcgtgtacacgggaagcctgatgcgtctgcgcaactagtgacttccccgtcttaagggtgtttttatttatggcagtagctacatttaaatcatgccattaatcttagtttgtatgcgtagtattttatagacctttagttaaagttaatcactgagagcaggtacaatagcagactattagccagctacaaacatattttaatgagataaaagatgagagagaagagcagcggactacagatctgtagccagctgcagcacgaactccaagacgtaatgtgtgtatgacagatgagaccatatactaatagtataataagcaattattgtatgaattggctattagattggctatagataaattggagctaacagtgggctatactattaaacttgctctctattttcctactgtggccccttttacttttcagttatatatatatgtcgttaatttcattgctcaccgtgtccaatggaaagcgtcgcctagaacaaacatgctgaacctggataggtttctagtagtagacatgcatgcagccgatttgtttcaagattacagccttgctattggcctaatttcgatttcatattagaaaagatccttaattcaattgtaagacacaaccttttttttttggttttacacaaggaaaaaaaagacatacgtgaacaaagaaagaacatacaccgtcccatccacagggcaaaaaagttgatctgataaacagacacgcctacgaatgtcagcatgtgcatacaatcgactgcagttatcatatatcatatactccctccgtttcccttcgtttcaaaatatttgacaccgttcactttttagtacgtgtttgaccattcgtcttattcaaaaaatttaagtaattatttatttttttcatatcatttgattcattgttaaatatactttcatgtacacatatagttttacatatttcataaatttttttaataacgcaaacggtcaaatatgtgctaaaaaatgaacagtgtcaaacattttgaaacggagggagtatcatagtaccgttctatttgtcatgctcactatctggtgcaggcatgcatcaatttgcgagtttccagaatttcatggtcactataggagattaagtaatgaaaaaaaaaaccatggttt

SEQ ID NO: 45654 - DNA, 1501 bp, Oryza sativa
cctccggcccaggatatctccttccaggcttcgttctcagacgagaaatcggacattctgccactgccaagagtgggtttcgccacaatgccatttcacggaatggagtggttaaaatgccacccacaagagatgccaaatatttgttttgccatttgggccaattattaccatttccacctaattttgcacccggtctgaccaaaatgcccttaagtcggttataccaaactgagttggttgagtcattccgacgtcggcgtcgggatgcggccgtggtgcgctgcgcagataatggggagaacgatgcgggcgtggagcgggtgggtgacgacgacaaggttcttcgggcgcgtggcagccttcccgctcgcgtcgtggtgacggcgtcggcaaggtaggttggagcatcgagatcgtcatgctcaagtgtttttccgctttgatttgctttgctgagttcgtttgaaaccgatgtgtgtgcttgcgcgtgcgtgcgctgtgtttgcaggtcttgaagcggaggggcaccatcctgcccgtcggccgttacggctccggtggtgacgcggcgagagtgcgcagggcgaccgcaccggcgccggcgccgacacaggacgccgcctccagcaagaacggagcgcttctcagctgcggcgacgacgacacacctgtctcacggaacggatcggtcgttaccagcatagacaaacctgccaccgccgccgcctccacgccgcttgtgaccataccgaagcttccagcgccggactccctcgtgatccttccatccgtagacaggccgcagccagaattcatcatcccagacgcggcgtatctaggagctccagcgccgccgctctcctctccttgccggtggccgcgagtagcgtcgacaggggcacggcagtggcaaggctgtcacgctgcgtggctatctcccgtcgcgccgctctcctcctccttgtcggctgccgtcgctctcctcctcctcgtcggcggccgttgggctaggagctcctgcggggtcttcgccatcggatttttctagagcgggggcagtgaggttaccgacccttgcgtcgacgcaaaaggaggcaggcggcggcgagcacccggacggcgacagtcactcggaggggtattttgggaaggcgaagtgtgaaaaatgatgaaaatcctgtgaaatggtgaatatggcaaagcagcggtttggtattggtttaaagtggcattttaacgactccatttcgtggaatggcattacgccgaaacccactcttggaagtgtcagaatgtccgatttctcttctcagacacatcccggcgagagacgagagacggcgccaccgccgccgccgccgccgccgtgctggactccggctggccaccgcgctccgctcgaggtaaacccttctccttgatggcagagaactcgtccttcttctcgcactgattggttcaagttttcatccggttttgacccccaatccaggcgtcc

SEQ ID NO: 45655 - DNA, 230 bp, Oryza sativa
actcatggttgaaccgcatccatcaactgcaaaaccgagtgtaacgtctcccccatctattaaaatcggtgcaaatcgcctcctttagtggtttgggagctgatttcatccgacgtggctattgactagcttaatcatttggtgtgaccaacttgtcagcagccagcacctcatcccatcttcttcctcacctcatctcatatcttcctcctctctcacctccaataagc

SEQ ID NO: 45656 - DNA, 1501 bp, Oryza sativa
ttgagcggagcggagcgccagaggtggcgccaccgggaggagagcagctgcgtgcgagcggcgtcgttggatgggaggcgggtgacgatctcgcggagggcgtcgtcggggaggaggctgatctgggcggcgccgcacggcggcggcggcggcggggtctggtgtccctgcagtttcctcctcttccctcgagctctggtggtgatgcccatggcggggagtggagaatggaaatggagattcctcggggaggggagccggacggacgcgttgcctaagtcttttaccctgtggcattaagaaagtcactgcttacccgtgtgccacagcaaagtttggagtcacctatatactatgagcctaactttcgttgacccatgtgctattccgtccaacttttgttagaacttaacggttccatatctctgacatgtggaacccatgtatcaaaatgactaatttgcctctgctctattttcagctctatactctcactctctcctctcctgctctctccctatttttgccgcacgccagccgcaccctaaccctagacgccgccgcctggcctcgccggagccgtcgccgccgaccccgccgccgcctagcctcgtcggcgccccgtcggcccgtcgccccgtcgccccaggccggcacgccccgtcgcggcgcgtccaggccagcgcgccccgtcgccgcgccgcgcccaggctggcgcggccctgcgccctcgccccgtcggcccgtcgcccccctgcctccaagccggctccagtgcggctccaggtcgccgcgcgccctggccagcgagctcctgtgacctcgcctttaggccggcgcaccctgcctccaggtcgcctcccgtgcccacctcgcctccaagcagcccgtggaagcagcgaagtaaaacctctattctttcatgtccattcatcactgacatttcacagtgggggattgttcatctgtaggatggacgccggattggacagtgagcctcctgacatttcatagtgggaaattgggagtgggagtgggcaatcagttgaactaaagcatactaaatctgcagatagtgaatcccttgctaacccaaacccatccaatgagcatgtgggtgttgatgatgaatgcttgtatattgacattgcatcctatgaagtctctccacagacagtggacacactaaggaagaagtaagccgtcaagaagtgtacaccaaggagggctccaattaaagtggccaacccatccagcctagcttctaatactagaagcaagaagaaacttcagcttgaataaattatgtggaggaactactacttttgatgtaatttaagacatatatggtttggtgtgatgaaaactagtgaactagtactttttatgtgtggacttagtgtgatgaaaactagtgaacttgttgctataaacttgttagtttgatatgaacttgttactatggatgaacggtcatgtatggtttgatatgcacttgtat

SEQ ID NO: 45657 - DNA, 1501 bp, Oryza sativa
ttagaacaatcttatactaacagatattgaacaaatttagtacttcctctgtttcacaatttaagtcattctagcattttccacatttatattgatgctaataaatctagatagatttatatgtctagattcattagcatcaatatgaatgtagaaaatactagaatgacttacattgtgaaacggagggagtagttaatttcagtagtatgcatattggcttcggtcctttaataacgcagtagtctaataaatccatggatagtttgtagccgttttcaaccaatagataatgtcaacgagctagctatcaagaaattccaccagcaacaccacatgacaacaatagtataaataaaaaacccagggtttttcctcaattgcattagcatgcatttcattgaattgtggtggattatctttttttttcgaacggtcaggccgttgccgacgttttatataaagaagaaggtgtctcattttaaggagaaaatgagaccaaaccttacaatgcatggttaattagggaaactgggtgaaaacctcaacactcaaacctaagctaccaacaccgcgaaaaaagaaaaaatggcggagcccaaaacagccatcgataaagagcttgttgaaagcgacacaaaggcttcgacttcgcgaggcaagtgttatcgttgccgagcttgtcgcctagcgacacaacagcttcgactccagagctatcacatcatcgttgccaaaggcatcgaagaaaacgagcaagacaccgaatgtccactttgaacatcagcccaagccacttgagcactactacttgtagatagctaacaccaacctccctcgaaaactgcaacgtgttatcgttgccaagcttcatcgcatcccaataaagcagcttcgacttcaccttgaagaaaacgaagaaagttggatgcttgccacatccaagagcagcacccaggagacgaaggcctcgccgaatagctaggcttatagagctttgacatgggggtccattgtaaaatcaaaggtgtttttgattattattctgtgatgaacaattggcatcggaggttattggttttgttatttggaatttattcacgaagtggttttggagatgattggattttacaggtgaatggctcctggctctcctcaagctaaatacctgccaaactctttttttttaccaaactcttaattacagtacaaagtagcacacaagagttaaggatgtgtttggttgggcggacgcgcgcggcggtggatgcgagcggtggcggcggcggacgcactgcggcgtgcggcggcagatgcgggcggtggggtgaggaggagcggcggcggatgcgcgcggcggcggcggcaaacgcaggcggcggggtgaggaggagcggcggcgacgacgaagtggggaggagaaggagcgacgcccgtgggagaaaaaagaagcgcgaaccgttttttgtgtaatggcagaggtgggtaatttttcccccaa

SEQ ID NO: 45658 - DNA, 1501 bp, Oryza sativa
cgcatcaacttaaacttgatctaaagtagagtaaattaaataagaggcactatcctctatttcgttctagctccgcgccctttggatgtgaccaaacaacgttgaagattcagacttgcatgctgacatttgcctcatgacatcacattacccggttcaatccatcacgtggtgatcctcactgtcaccaatgatatgcaagcatctagtaatcattttcttctcaatcgagtagaaatggtaccaatcaacctcctaaatcctgccctgtgcatgcatacccccaaccaccagtaagtactaattgtgaataaaaatacttctgaataaaaccattttcaatatggcaagactaactcaaagaaaacagcataaacattacattattgcctgaagattacatacatgattgtgaaatccagccatatccaacagcaatatcattcatttctgtcctcctaaccaaactagcattactaagtctttggagtggtcaagttcatgaatgtgaggtacgggctgcattattaattgagaggcccttaattgagacgatatagtaacagtagagatttttctgatagaccagacaaatgaacaatcaaaagctactagggaagagaaaaggtaggaaaaggggaatcaaagcagaacaaaagcttgaaaagatagtcgagtcatggtgcacgaggagcaacaattattttccatccttcgttaatcctcacgcagaataatcgtgtaagaaaagaccaaggcgtagaacaccagaatggctcttcacctcgttgttgaaactctaaaacattttttgatagtgttcaaaccatttgagaggaacaggtcgatcaaacctatatgacagcactaaaaaaacacttattttctcgccggaccacaaaattttacttttattactaccttttcagccatgtttcagtatcatgtagggaaatcaaagattatgagatgaaacaaaaacagtttcgtctgacaggtagataggcacagcgttgttgaccatggactgctgatttgtcacaactcacaacccagcggagagccttgctctatgcaatgaactggacacagagcgatcaacaattaacaaaagaatctaaggcaaaaaaaaagacgaagcatcaaaacttgaggaatcccaaagccaaaatggacacaaacaagagcagaatccagagcgcagaaaattatcgtgttcacaaccctgttgcatttattttttggaataagaacaaccctgttgtattatccatgtactaaatgttttatctaacatcgtagtctcggttaactgacaggcattgacctgcagtttaagggttcagagtgaatgcatgagctttggccggtcaaagcctgtcagtgtcagatcattgcataccaggttgtcatggctggacgctactttgccatccggtgtgaatacgcatcatccatccatcatcacatcagtagaaatggccgccccttcctcctctcc

SEQ ID NO: 45659 - DNA, 1501 bp, Oryza sativa
tctgatagaacatttctcgagatacgaatacaagtataatgttctgatgatctggtccaacaattccatactgtatgcagtctctacggcatgtctttgatcataaatgagccaataatttccaaaaaaaaaaaagtcaaagttgctaactttgctatagccgcaacagttgcttggacatcatgaagttgtggctagtcttaactcttaagtggcacaataccaataatgatgcaaaaaattcatccgaaaaaagatgaccaatcgttacattcatttgcaggatatcccggtgaaatatctattgcaccacatttaggacatcctgactttaaatatgaacctatgtttttgtacaattcctcatcaagcagagtggattaagtgtttgaaaacaactaaaaaaagtgcactaatggcttcattcaatatgatttagaaatatgtgtaaataacatgatacaaaaattaacagaacaaatggacaacaaaatctatccctcaaaggcacataccttggactaagcccaatatctgtcaagaaaaccagcaaataagtaaaccaacatgaagaagtgatgtcatttagcatatgcccagaaccatatgaaagtattggaactctccctaatggttcatccagttcttcaatcgatgactgattatccattatcttaaccatattttatgtttgccagactaaaggtatcacctacacaaaaaaggaatacatgttgatttcagtatgtaactagcaatctcaatcccaactttgaataaacaaaacaataataaaatgccattttgccaaaagttaaaagttttgaaaaataaaaaatgcctacggtcctgcacactattttagaggcttgaaaatgaagttgcttagcttacaacgagtgtaataagtcaaaccgacagactttttattcagaaacatcaactgaagttatataagaagatagttggtacgtcatgactggcagcataacagttgcttttgtagtgcttataacaaggcttcaagctatgtcagatggatttgagttttattccttaactagaaaaaatgtctgtgcgttgcaacgggtgaaaactattttaatcatgagctgcaattaggagtctgatcgtatcaagttagcatgcgagttttttaaagagatatctatacggctccttctgtatttacaaaagcgaacgaacttaaaaaccgactcatacacggatgatgtaccaaagtaccggcaaaaacatcttcaatttttataatagtagagatgtatgactggtttttactgactgctgtaaaacacattacatggaccatcttaaagcagcaattgatatgactactgtacttgctaacttccaggaaaaaagttcaagttgtattagttcttacatatatgagaatcatgaaatgaatcaaatgccaatctaaagtggtgggcacaagaagataaggagataaactgaaggttccttttgttgttgtaaa

SEQ ID NO: 45660 - DNA, 1501 bp, Oryza sativa
ggcttgcagctgtcgagaagcttgatagtggaaggcggcgcgaagatggaattgaccttaaagacgatgcggtagagccaccagtgctcctccatgaaggagaggcagagctcagggatatctgaacacatcggtttttgagcagctcggcgggggtggctttgagcttgggggccgggataggagcttgcccaaggtgacaaggcggaagccccagccctcatgcgcgtaggtaaagatgacattgccattacaggtaggaccaggccgcaccgcgcacgcgctccagattgttgggagccacgtcggccagcggcctccgccgtcgagcttttccccgtcagccaacactattctccctacctattggcggctgtcctggaggtttgggttgtgatgggaagaaagggaactgagatgtaaaaagattgccaaaaattgtgaaattgtggataaccatttttttttaaaaaaaatcacttgtctttgtgtctctcctcagttctgcagtatacacaattgcagctaaaccagaggagagagagagaggaggtgggaactgggaagaaaaaaatggcggctttgctccgccacgccgcggcggcggcggcggccgtggtcctcctcatcgcggcggccgcctccaccgacggcgccaccagcttctacgcctcggacccaaacctcggatccgcccgcgtcgtcttccaggttcgccacgatctccctcattttcccgagttgctgttctaaatcagggaggaaaggagcggtttttaccggggttcatggagaaaacggggccaaaagtcggattttggcacggtcagattcgtaggctcatcaaagatttcggaattgtgagttgtgagtgaagatctacgctgaattccgacgccgttgctcttgctgttcgccagattcgtccgactgttggagaatcggtttagtgctgtgttggaaatttaagagttgtgttgcaattagatgttgcaaaacaaggggtacaaggtgtcaatcctcatgcgcaggcagtgttgaactgtccgttcctatgcttattgcgagattttactaggattaggttaaaatttagatgtatgccacctagtgtgcaattgggagaatgccaggacgccgatcaggcaaccagtctcatgtggcattcgttgctacaaacttctgatttcctaaaaatgaacaagaacacttacgaggaagaggaagtatgcatctttattatttaagccggtgacagggctgaagctaattatctcgttaatcaggatttaaaataacaggatatcttaatattttggatatgttcttccatttcagattctatatctcgtattggtgttataatatcacatcattttatttttcaatttgttatgaaatgccttggctaatgtcctggtgcagctaatacacactaggcaaaattggttctatagcatccaaagttggtagtatctgttcttatttctgattaggcaat

SEQ ID NO: 45661 - DNA, 508 bp, Oryza sativa
atcaccaacaatattaaggtttttcccctatagtttgattgtcttcagaagtatactctgcttcccacctagaattatcctaaagatagaatccgtcagaaagtccaaagaatgcaggaagcatcttcagaatcaccatgagcagcaataagaatgcacagcctgaggcccctgatcgacagttcaaatttctgctaaaatttcaaaacaaatcaaaactaggttccaaaatcaggttgctaacacaagttatttcgttaagctttccaaaaacaaaataaaaatctacccgtgcggctgagcgaggcaacgcgcgcgcagcagggctgtctcatgctgacgtcaccccacgcatcccccctcctcctcttcgataaattcaaatcccgtccttgtgggggaagattcacccgcccgcttcctctcctctctctctctctctctctctctctctctctcgataccctaaaccctagaaattctcgagcgctcgcgatcgagactccaa

SEQ ID NO: 45662 - DNA, 1501 bp, Oryza sativa
aattttgtaaatattcactgtggctaatgacctatatgattggcctcaagtcaattgaaaagaagaagaataacaagaaaattagccaggcagacatgaagaatttattcccaaatgtcattcgcaaaagaatctctcacagactaccacaaaatgcccatggtatatatgaacgaacaaaaaggaggaaacaaagatatgcagataaggacaaatgtgatttttatttcaaataactacgccaaataaatacataagcttagtgaagattatctataatctcataatgtgtcctgcaaagacaaagtattgtaggctgttattttttaagccccattagcaacacagggtaatcggtatacttattgttttcaattcgcaagggattgtgatacaattattattaaaagaaaatgaacagaaactgatttggtcagttgttacagtagatcaattgttgtttctgctcagtactcactattcacatgtaatgtcaagcccatatggaagagtagttcaatgttatcatacttcaggtaaatactgccgatgtgcttcaaaagactgcaccataggactccatgtaagaagaatctgtcgcctggggactcattagacaataaaaatgtcaatctaacacatatttagtttgcttttgaacagatgaggagaaaaatgcatacgacaagcatgatattttttctataataaaaaaagagaaagcacttatcatgagtagccctttgaagttcctccaatgtgcaagtgtataaggccttctgaagttcatccaatgtgcaagtgtacaaggccttctgaatttcctccaatgtgcaagtgtataaggccttctgcttgtcaaccagacacctcctcaccagcttaagcttatccaggagcttattcaataagctcaagataagctgcatgttagtcctagcctaaacttgtagctcaaatgtgctgaagtagttaaggtttaatccccgttaggcattaactcaacaaacatacaactcactcctggctattatgcccttaactaacatagtttccttaaattgatcataacaaagtcttaagatggaacaaacaaatgctgttcataatttcatatataagtactaagctgaacatgtttaaatgttagtgacaaaatgagggaacacactgtgttccaaactcaagtatgttaacaacaggcaccatacaataaatactacacggaggataagtctattgaacaagttcagaatgtcaatttaatctcatgcagccttttgtcttccaaaactagaatgttaggccacacgaagaccaatgatggtcttctaaccacaagtgaatctcacagaatcaacaactcagacaccataatttagatagtcaatgggcaattatcactcaatatatctaacaactcaattcataaataaacaaaaaaatcacaatgttcgctagtcacagctaacccagaagaggcaaagaaaacaaggcaata

SEQ ID NO: 45663 - DNA, 163 bp, Oryza sativa
tgaaacagctactactcctgctagctagctcaagctcaagctcaatctcaagctctttccactaagctccgtgtgtctagctcatcaatacctggctagctagctagttgcttgatcgatatatatcctagctaagtgatggacttcgacttgttcaattcct

SEQ ID NO: 45664 - DNA, 727 bp, Oryza sativa
tcctgcagcccgatcgagtcgttctcggtgcaggccttccatggcttttggtttctatccggaggtcctcccgctccttcgcggcctgtccgtcgccgccaagaagctcgcttacggctgccatggcgcctgcctccacctctgcgcccgtcgccgcggcgcccggcctcgccttagcctccacacccaccgccgcggcgccccacctgcgcccggccagccgtcgccaccgctccaccgcgccgcccgtatgttgtaaaaaatgagagagaggaggaagggagagaagggagagagatgatgacgtggtcacatgacgtgtgggactcatgctgactctgttgctacgtaggataaaaccggggtcaaaaccagccaagaatataaagtgaacggttttgttagttgagggacgtatctgcttttacggttgaggcacgattttgtatctggatgataagttgagggaccttttggtgtactttttccttgcaaatatgggccttctcaccgaaggcccatttatgatctcgatatgtgggcctaattgccacccgtgcgttaatgggccgagaaatctcggcccatttaacctagccctcaagctagggtttcctctcgtcgccgcatataaaagcgctctcctcttcactcctcctcccctcgggaaaccatagctccagcaatcggcggcggcggcgacgcgggagaggcggtccggcgacga

SEQ ID NO: 45665 - DNA, 1501 bp, Oryza sativa
acgaggaggaggagagcgacggcagccgacaaggaggaggagagcggcgcgacgggagatagccacgcagcgtgacagccttgccactgccgtgcccctgtcgacgctactcgcggccaccggcaaggagaggagagcggcggcgctggagctcctagatacgccgcgtctgggatgatgaattctggctgcggcctgtctacggatggaaggatcacgagggagtccggcgctggaagcttcggtatggtcacaagcggcgtggaggcggcggcggtggcaggtttgtctatgctggtaacgaccgatccgttccgtgagacaggtgtgtcgtcgtcgccgcagctgagaagcgctccgttcttgctggaggcggcgtcctgtgtcggcgccggcgccggtgcggtcgccctgcgcactctcgccgcgtcaccaccggagccgtaacggccgacgggcaggatggtgcccctccgcttcaagacctgcaaacacagcgcacgcacgcgcaagcacacacatcggtttcaaacgaactcagcaaagcaaatcaaagcggaaaaacacttgagcatgacgatctcgatgctccaacctaccttgccgacgccgtcaccacgacgcgagcgggaaggctgccacgcgcccgaagaaccttgtcgtcgtcacccacccgctccacgcccgcatcgttctccccattatctgcgcagcgcaccacggccgcatcccgacgccgacgtcggaatgactcaaccaactcagtttggtataaccgacttaagggcattttggtcagaccgggtgcaaaattaggtggaaatggtaataattggcccaaatggcaaaacaaatatttggcatctcttgtgggtggcattttaaccactccattccgtgaaatggcattgtggcgaaacccactcttggcagtggcagaatgtccgatttctcgtctgagaacgaagcctggaaggagatatcctgggccggaggccactactgacaagccgagcccatttaagcccacataatgaaaatcccagcccatatatcttgtgcgtttgggcccagcccataaaagcccatataaacgtagcacgaagccacgaacacgaagcaatccatccccactccccgatccccatcccctccgggctccggcggcgccgtctccgatcgccctcgactgagccggcggagaggctcgaggggagggaccccaccgggggaatccagctcggttcgacctgtcggcggcgggagcggccgccgtccacccatcgcagccggctcgacctggtgagctctaaccctatgtttcttggtcgcaggaaattttgtctggtaatgatgttctactgcgtattatacatcgatgtaatcatctagcgaatgcatgaccgtgttgtgactttagattctactgtgctttagtgtctttgtactattagagtagcagtataaattgcaaaattgatagttttccgatcatgaactt

SEQ ID NO: 45666 - DNA, 190 bp, Oryza sativa
ggactgcacctgggacttgaggaacttgacgtagtggatggcctcgtcgagcatgaagcggtgtccatcttggtgcggcccgggacgagccgctgcaggatgcggatgcgctcgctgatgcgctcccgccgcagccgcgccgccacgctctgcgggtccttggagatgcgcacgttgcgccgcttcggcg

SEQ ID NO: 45667 - DNA, 1501 bp, Oryza sativa
gtagagactgagggtgcaattgacaaggaaatgtataaaaaggaccgagttgtaagagttggaataggcggaggggcgtatctgcaaggaaaactatgggctccagggacctggttggaaatctcaaaaaatttggaccatttctcgatttgtgcgtgtcatccttgcgcaggggccatgctaatcttctctgtatcgttccaattttatcggatgtctccgaagagacaacacaagcggcagcgcgcggggttataaggtgggttcttcattgttcggtaggcgaggtggtactaaacctgtctcccctcaacgctcccgcgacccaccgatccccatccaacggcccccgcagcgcccagcggcatcccgcgcggtagtacacgctcgtgggccgtatcctccgttacggcccaaacaagcagagagcacactaggcttctctcgcctgcggcctcgtagctcaagtctgagccccatcatccatcgtgaccattcatgaataaaaccggtttgtatatgtgctccttttttttttgtccggcttagttcgttcttgcataacaactgaggttctaagtggcacgaaaaagggataaaacaattaacacatgatgaattaattattaactattataaacttgaaaaatatgttcatttgaatttttaaagaaaattataccgtttaacaagtgtcctaatgaaaaacaagcaagttaagtttaggattgaagtaaactgtaaactatatgtctgaccgcttgcagaactactgattgaccagcttgattgcgtccaaaatcaaatggtagagcgagagccgaaggcaagcccagctggtttaattagcaatcgcctatataatcagctagcgcaacaactgttagttagttggttgttgatgttgtgcttcaagaaatcaattaattaattagtctgttcttattgcttagtgtactacacactcttagctggagccctagccatgggaagaaattaattaaatccccagataaacacatgaccacgaaactgcattgctgtactaaagctctgaactagctagcaacgcgtcttagatatattccaccaagcaaaagccacatcatgctgtgctgtgccgtgccaaattaaaaccacatcgtggccttcaagtttctgctagcttcgtccttcgttgctaatcccagccagttaatcaattaattcgtcagatagatagatatatatacgcgttcatcagcgtacgttcttatagctagaactcatcctgctgtgcaaaacctgcatcactagctagctagctagctctgaatcctctagttgtctgatctcgatcgatcgatcgacaactatctcgtccacatcaagaaagcaaagttttcttgagctacgaatcaatcgatcgatcgatcgccatgggcaacagaaacgaggtgagtgagaaaatctgaattgatcatgcaatttcagagccaaattgaggtagtagcttagctac

SEQ ID NO: 45668 - DNA, 1501 bp, Oryza sativa
tattatatttttggctttatagtaatacatgcaatattcaattaatctactggataattagataatccagttctgttgagtccctcggccgaataggtttcttgaaatgaaattgctaaaacaggcatgtccaagttcgaggcccatcattacattgtgttctctccttaaagcccacccgcacaaaatcactctgacagatcgatacatgcttcacacacatttcagcccaacttcagccatcaaacatatgagaaaaagttcattttgacttcttcaactgtcagctgagtttgttctgcatcctcattcctcaactataaaatcagatatataattttacccaaatattaaaaccggatcaaattgcctccttcagggttataacctagcttggtagccgcatactccccttcgtaggctagtgccatctcgtgcagatatggtgcgcgcagcagctgcgatggcatggccggctgtcgcggatttgattgctcgagaacgctaggagtcaacgcgaacttgtttccgagcgccacctccactaagttagaactctcccactcgtcgtccttgccctaggcctccaccccgctgcactgcgccatcgacgcctctcctgtctatgaggttgcatctgcctcttgctcctttttcatcgatcgttgcccctgcagaccaacagaggggggagagagagagaagaaaaagtggtcattataacatgtggatcccatgtgggtgttactatattaattaatttgtttagctgatattaataccggatagatgccacgttagacgaagacaaaatcaatttgattagtcaaaaaataacaaaatcaatttgacgggtaggcaccacgtaggacaaaatcatcctctaaactactagaggagtcaaattaaatcggtttgaatagatgagggactcatatacctgatttcacgattgagaaacatggataagattcggccaataattgagggagttaaaatgagctgtttacaatatatgaactagctgcctcctctatcggcctatgctaaggtccataactaccccttgccttctttcggtccatcaagcccaataacgcacacataccgccgatccaaattccaaaccgacttcgcctccgagaagccctcacctccacacttcttcccccacgcgtgacgcgtccaacccgatctctattctctagcttccccaaatccccaatccgacctaagccggcgatccgccgccatgggtcgcacggagggccgcctcgcgtccgtggtgcacctccccggccgctccagggtctccgcctcgccctcccctcgccgccgccgctccccgtcccggtcgccctccccgcgccgcaaccgccgccgcgaccggtcgcctagcccctaccgcagccgcagggaccggtcccctagcccctaccgcgaccgccgccgccagtggtccccctaccaccgcgaccgtggccgcgacgtggagagggag

SEQ ID NO: 45669 - DNA, 1501 bp, Oryza sativa
caggcatatgaaaataagtgatttcataaaaaaatcaagataaacgccaaggaaattagttcatgatattttctaggactactttgcccaataactatcgcattcattttgatttagacaaatagacaaattaactatggaatatataaaggatcttcttcaatacctatccttttatcaacctggtaatcattgataaacttttgagggattacagaaggtactacatgctcatgttgttttggctataaccagaaggtagcaaaagtgatctgttaaaacatcaacaatgtattcacaaattgacaaaggaaataccttcccatggacagaatccccctgacatgcttgacagtactaaattcaccaacaaccgatttctctgcttcctcttgctgctcatcattcatgggggcagttctaccacccacaacagaagcaacttgtgcaacaaaacccttgtcaacctgaacccagtcatcgaccctttacataatgaaactgacaaagtcgtttagcaaaaatgaaaggttagcactaagaggtaattacccggaaaaagtgatttgtgttgtagcacccaagcctcacaagtttgtaaatgtgttcaactgtcttaggagcaacatgaggaaagaagccaaactcaatgtcaccatgagttgtctgcagatcaaattgcctaatcagaaataagaacagatactaccaactttggatgctatagaaccaattttgcctagtgtgtattagctgcaccaggacattagccaaggcatttcataacaaattgaaaaataaaatgatgtgatattataacaccaatacgagatatagaatctgaaatggaagaacatatccaaaatattaagatatcctgttattttaaatcctgattaacgagataattagcttcagccctgtcaccggcttaaataataaagatgcatacttcctcttcctcgtaagtgttcttgttcatttttaggaaatcagaagtttgtagcaacgaatgccacatgagactggttgcctgatcggcgtcctggcattctcccaattgcacactaggtggcatacatctaaattttaacctaatcctagtaaaatctcgcaataagcataggaacggacagttcaacactgcctgcgcatgaggattgacaccttgtaccccttgttttgcaacatctaattgcaacacaactcttaaatttccaacacagcactaaaccgattctccaacagtcggacgaatctggcgaacagcaagagcaacggcgtcggaattcagcgtagatcttcactcacaactcacaattccgaaatctttgatgagcctacgaatctgaccgtgccaaaatccgacttttggccccgttttctccatgaaccccggtaaaaaccgctcctttcctccctgatttagaacagcaactcgggaaaatgagggagatcgtggcgaacctggaagacgacgcgggcggatccgaggtttggg

SEQ ID NO: 45670 - DNA, 271 bp, Oryza sativa
ttttatcaatgtttaacattcatcttatttacaaatataaaaaaaatatttaaaacaacacttaatgataaatcaaatcactgtaaaataaataataataacatatatttttaaataagataaatagttaaacattggtaaaaaaatcaacggtgtcatacattaaaatataaaaagggagtaataattaatactcaagtagttatatgttatgtttttggtttcgcatgcaattatgtaactaatcagttgtttcttgtctttgtttaga

SEQ ID NO: 45671 - DNA, 1501 bp, Oryza sativa
gatgttatatgtgtgtgcatgtattctagtgacggttagttaaaaaaaattatgtacaaagattacaacaatattcctccatttcgaatattaaagaaaatattttgtttggattaatacatgcaattctcccttttcttttctcatttttcctttgatccaaactggttctaatgaagtattacttaataatatttttaggagagtactagctacttaatattagccattttttaggaattgtttttttaaaaaaataccttatgaatcacttgaagtttgacatttcaccctataaatcattttgttgcaaatatttaccccatacttgttgttgttattgtttttgttgttgtcagtccacacatgtttaactcaatcaacatgttttttttaccaaaactaaacatttataggagtacacttttcttggagattccactaatagaattgttgctgagagcttaaacattatcgtaccgagttttgctatatgtataaaaagtttaatgaaacatgaagaataagtctaatgcaagcacttggataaaattgattcggctaacttaacctgtggttactctacatgagcgataaaatgtctgattcggttaaataggtgcgcaattgggtggtttttataataaaaccgaggaggtgggggtggatatttgtaacaaaaataacttaattatggaatgaaatattaaattttaaatgatttatgggtggttttccttttattttaggaaatattagcgtggttaatatgcgtagacatatttggtcaataaccagcagtgaatttgtgttcatgaattgaaaggcaagctgggtaagacactcagctcgtgtcatcatcattaccagtcaaagtgacttaagactgcacttacgtgcgtactctttaactgcggcacacctaattaattcgcattaaccagtcaaagaaaattgagaatatctctttaagtggttgattagctaatattttttttaccctgctgtcaagtgtgcatatatatatgcacgctgacacgcagtcaaaacataccaacaattaaaatgttgtatatttgcctctgtcaatactcaagctagtcactgtcattaaccggtcaaaagtgaattaagagtgacactcacgcactagttaatgctcctatagcccgccaagccgccggcaagatattaatataatgttgaacttttttcataattgtcggtctttccaaggctgacacttgtcatgatctatcatgatgctcagtaagaatggattattggcacaaaattattttctaattatttatgccgcacttcggaaagtgcattttttcaaaaaaaaaaaaagtcaacatctgcatttttctagactttgttttaagctatatgttagatttatctttttttaacggaaagatttcattaaaaaattaaattacaaccgatctctgcaactatttgttagatttatgatatattatatttaattctttca

SEQ ID NO: 45672 - DNA, 1501 bp, Oryza sativa
ccatggacagattgcgcgtatatacgagaatacgaggaaaatgatccctctgtatcattccaacttggaaaggagatcggtcggcgtaacacggatggaatcatgctgaataaggatctctgttaattggaagaatcacagaacatatggaaagaaatgctaatcgctaaattaggcaattggctgatcacgcatgcactgatcgagccatgcatgtactggctggaaccgcctttcttcactataaaaggccatgccatttcacacaacgaggacacacacagaaacggaggaacacacacagacagaacacacacgcatacaaaagtgacagagagagacacacacaccattttggctggagaatctcggcgtccagcgagaacacgggcgctcggcggtcggtgacgttggccgcagtgcctcggcgtccggcgaggaggcgcgcggaggaggagacggttgccggagcacgtacccagccattgccatgggtacagcttattagttctcttttgttttcctgctctttctgttcagatcatcatgcatgcacaacacggcgacgaggcaagtttctggtgctgttcggcccgccggatatagcgtcctctccgcctgtcggacgcaccgccggccggagatcgcgtcactccctctcatcggagacgtcggtcgccggtgacacatctacctgctgccacgacgtccttgcctcgccggccgcaacctctatcccacgacgccttgtgatgtcgccgagacgctggacgttgtcaccttcccggtcgcagcctcctcttcgcgacatcactgacgtccgctcgctctcgtcgacgttaccatcttcttcgaactcatcagctggttgctcgaggagaacgccggccggagtgccactactcggtgcccgcaaggcgtcactagctccagctacgtcgtaagccatctcgtcggagttgccggggacgtcgcgtcgtcgccgagccgcctgagtccgtagacgacgcaacgctaccaagcgatgctcgtcatcatccgctgctcgccggagaaggttttttgtcattgtgcctcactagagcacgccaaagggagtcgaggcagccgccagggcgctacgctgctgagccgtcccatgtcgcggatgctgactgacttgtgcatgttattgtatacggtgacgagccaacaaaacaagacatgcatgcttgctactgtacatggtgacaagcaaaaatgagtttgcagattcatactcatttggggctgctgcgtattaaacttcccagccatgaccaattcggctatcattcgcattgatcattttacttttataatgtaattccgatgcaattcctacgtcgtcgggtcatccaggctacactattccatgcatatcttcaacaacaatataaaccaacacgccatccaaaacctatgaggctaaaatggcagggcgggtggagtcgacatctagacgacgtcaccaacaccggcg

SEQ ID NO: 45673 - DNA, 867 bp, Oryza sativa
cgagtcagccattcttttaaaacgagaggatgacgctggtggatatgaacctagctagttaagtatgtgttaagttaataaaaaaaggcaaaattggttatatagcatcgaaagttcacgtttttggttttatagcaccgaaagttaccggttcactttaatagcatccaaagttcaccatgttcccatttttagcacttccgtcaatttttcgtccgtcttgatcgttattgatccagccacacacatgatatgacatttctacccctcattgacatgcattatacttatacttgtgaggggtagaaacgtcatatcgtgtgtgtggctggatcaacacagacggaaaatgatcgagaattgacagaagtgttaaaaatgggaacatggtgaactttgggtgctattaaagtgaaccggtaactttcggtgctataaaacaaaaaacgtgaacttcgatgctatataaccaattttgcctaaaaaaaagattgttaagttgaatgaacagatttgctaaatctcaaccatgaaagtaacatttatatatggtcgtcgatcatgaaacgtttgatggtttctcgttgacaacatataggcatataacgtttttccgagttgaaccaatgtgccctacatccatataccggcacgaggtatatctttccgtaagaaccatagagcaaaaatgaattattgtattagagacattgcatccatgcatgcagagcaaactcatttagtataaatactgcctaatgcaagcgttaatcatcacctctgcatacagtctcagatagctagccaagctgagcaggactaagatcactcgtgaattcggagataccatgggaagtgtaccgaaga

SEQ ID NO: 45674 - DNA, 1501 bp, Oryza sativa
gccgctgccaccgcctcctcctcagagcttccctcagaagctgtatcattgctcttcctcttcttcctcctggagctccttcccctcctcttagacttcttgtgcctccgcgatctcttcttcttcctcctatccatagagtcctcggaatcataagagccctccgaatcctcctcagccttgctgttgtcgtcaccctctgtatcagatgaatggtggcggcggcggtggcggctacgcttgctgctacggtgactacccttacgccctttcttcttcctccgggtatcatctgatttgctggaatcggacaagctatcagactcaccggagtcggattccgacgaacccttgctatcctcctcttcgctcttatccgaggaggccaccttctttggcgattcctttttctcctcctcctcctcctcctcgtcgctgtagccataatcctcatcctcaccttcgcggcgaggagggctgggcgtgatgttccagatgcaccgcttcatgctcttgcggagcttctctctcttgacgcggcggtactcgaagtaggtgagacccttgagctgctcgtcgtcgtcatcgtcggaggcggaccaggcgccggcccccgcgccgccgccgccgcgacggggcgcagggtggtctcggtcccgagcccactccctctccacgtcgcggccacggtcgcggtggtagggggaccactggcggcggcggtcgcggtaggggctaggggaccggtccctgcggctgcggtaggggctaggcgaccggtcgcggcggcggttgcggcgcggggagggcgaccgggacggggagcggcggcggcgaggggagggcgaggcggagaccctggagcggccggggaggtgcaccacggacgcgaggcggccctccgtgcgacccatggcggcggatcgccggcttaggtcggattggggatttggggaagctagagaatagagatcgggttggacgcgtcacgcgtgggggaagaagtgtggaggtgagggcttctcggaggcgaagtcggtttggaatttggatcggcggtatgtgtgcgttattgggcttgatggaccgaaagaaggcaaggggtagttatggaccttagcataggccgatagaggaggcagctagttcatatattgtaaacagctcattttaactccctcaattattggccgaatcttatccatgtttctcaatcgtgaaatcaggtatatgagtccctcatctattcaaaccgatttaatttgactcctctagtagtttagaggatgattttgtcctacgtggtgcctacccgtcaaattgattttgttattttttgactaatcaaattgattttgtcttcgtctaacgtggcatctatccggtattaatatcagctaaacaaattaattaatatagtaacacccacatgggatccacatgttataatgaccactttttcttctctctctctcccccctctgttggtctgcaggggcaa

SEQ ID NO: 45675 - DNA, 1501 bp, Oryza sativa
acatgatatctcagtatacatttagataactccatgccgaagaacaacctgaactctctgatagctaaaggtagaactaatcaaataaaaagaagacgttacttcactaggtcactcaccgattgaaaagatccaccctatattccatctctttctctgccaatccaaacatctattcagacacaaagaggaaaaatattattaatctttagtcaaagaggttataattatcaggaaagccttagtcacaaactcataataacaaaggtcaaagtataaactgaatgacattacatacaagaactatcaaagaaaatgataggacaaaagactatctgacaaaccaacagttccaaatactgcaaattagactggataagtaaattgtaagacgcatagtggtggtctttcttagccatggcaacatagaatctgaaaactatatttcaaacaacaaatagagtaacatacaacagtataaacaccaacagtttgaaaaatacaaacatttgatttaaactttcttttaactagtacgatgttaggtaccactaggactggaaagaattttcagcttcagtgtatgctactccaaggaaaaatggtagcaaaagtgaaaaaaaaaagagagaaaaacatatattccctctttttttatatatgacattggttagtttaattttgaaccaaccaacatcatacatgaataagaagggagtactaatattttgtcttgatatatgtacatctcaagactcattcaagtttctgtgggtcaaatgaagtgaattatcctaatgctttacaaacaaatattatacacaatttcctagcttcctatttattttaaaatcactctagctcctatataaacttgttaatttcaccttacctagcttcctatttattttaaaatcgctgcctcgctgactggtatattctttttatgtatattgttcgtttatcactgttaaagaggatgttcaagctgtccttgcctcctgctaacccgactacagaaacaccataaaaaaatgtagaacagatccatgcatacatctggatggcagatcttattaacgcaaacgattctcagaagggcaaggtgcagccataacttgcacaaatctgcccaattttcaagattgttgggatcacaacaaaatcagcaagtttcagtttccctctaatcacatccagagcttcagcgtcagtgtaattaaaaaagcaggaaaatcacttgtgacaaagtagttcgaaaactgttactgatatcaccatacaaactgatacgcgaaatcagatgaaccaacacagacctgctccttctgcatattcacctgctccttctgcacattcaccggctgacctttcgcggccatcgctgcagctcacttcatgaaaacaaaatataccactcagcgaggcagcaatggattaatccagcaagaaaacatcgcagagagggggggaaacagtacaagatcccccgggggtcaaa

SEQ ID NO: 45676 - DNA, 508 bp, Oryza sativa
cgccgccttgagctgctcctctctcctgccggccgctgcgaaccgctcatctctccccgctgcgccgcgcgccgttcttctctcccccgccggccgccacgagccactcctctctccctccggccaccgtgaccgcaagtcgctcctctcaccgcttctctatcgcccgcgtgtcacgtgtcgttcctgtctctcccactggccaatgcgtgccattcctctctcccgccgtgcgttgctcctttccctcaccggtaacatgcaccgctcctctctcctgccgactgtcgcacaccgctccactctcccctccacgccgcacactgttcttctatcccgccggtcgccgctcctttctccctccggccgccacgcggttttcgtctctctcccgccgaccgttgcgcgtcgctcctctcccttgtcaatcgctgctcctctctcccaccggtcaccgcgcgccactcctctcctctccactcgcaacttttggcaccctccctgtagc

SEQ ID NO: 45677 - DNA, 1501 bp, Oryza sativa
tttgttatgatcaatttaaggaaactatgttagttaagggcataatagccaggagtgagttgtatgtttgttgagttaatgcctaacggggattaaaccttaactacttcagcacatttgagctacaagtttaggctaggactaacatgcagcttatcttgagcttattgaataagctcctggataagcttaagctggtgaggaggtgtctggttgacaagcagaaggccttatacacttgcacattggaggaaattcagaaggccttgtacacttgcacattggatgaacttcagaaggccttatacacttgcacattggaggaacttcaaagggctactcatgataagtgctttctctttttttattatagaaaaaatatcatgcttgtcgtatgcatttttctcctcatctgttcaaaagcaaactaaatatgtgttagattgacatttttattgtctaatgagtccccaggcgacagattcttcttacatggagtcctatggtgcagtcttttgaagcacatcggcagtatttacctgaagtatgataacattgaactactcttccatatgggcttgacattacatgtgaatagtgagtactgagcagaaacaacaattgatctactgtaacaactgaccaaatcagtttctgttcattttcttttaataataattgtatcacaatcccttgcgaattgaaaacaataagtataccgattaccctgtgttgctaatggggcttaaaaaataacagcctacaatactttgtctttgcaggacacattatgagattatagataatcttcactaagcttatgtatttatttggcgtagttatttgaaataaaaatcacatttgtccttatctgcatatctttgtttcctcctttttgttcgttcatatataccatgggcattttgtggtagtctgtgagagattcttttgcgaatgacatttgggaataaattcttcatgtctgcctggctaattttcttgttattcttcttcttttcaattgacttgaggccaatcatataggtcattagccacagtgaatatttacaaaatttaacatctgtgtgcatgggcctgcttaaattcaaggttgcccaattttttttctcagtgttcattcttatggaaaacctttgtgatgctgaaaagtacatatctaacactttaggctatctcagagagcttcaagtcggatgtcatatgtggaacatgttatgagttagcaggtagtttgtggaatgcagtattcaatgtaaccaagttagcagtaggaattattccaaatgttatggcgtaatcctgactaataaacaaggtttgcatgaacagaagaagaaaggaatatacttatctattttattgcttcatttcatgctctgtgtcactccaatgttttgtagggaatacagataagattcaaagttaacagttattttagtgggtatcatgcagttgccgctttgcttttctacacagttaa

SEQ ID NO: 45678 - DNA, 1501 bp, Oryza sativa
cccttattaaccaagggttagagttagtaaagtagtaaatcacagatagagttagcacagtaataatcacatagagcatcacaaaggaactccaagaaagaatattatcgagcctaataccagcagaaacttaataataacagacttactactattaaagtaattcattcatagcataagccacatggtcttccttataagggtcggtcaaatcacacaagacattactacctagcaaacaccatagataactgatactactacccgacagagagctagtaatttagtagctaagggtgaggcagtactcaaaagctaagctggcttgagaccatttgggtaagatacagtaaagaagtagtcctctgcagcatctcagttagcgggcgagcctgaaatcacagtggttgacagcaagtggggtcgtcgtagtcccagtcgccgaatttgacgccggtccagtcgatctcggcccattctttctccatacgagcctgcatctccgcctgctccgtgaagtagctctggtggaccatgtagcggccagtctccttcacctcgcggaggatctccttctggaactcctcgaactcgtcgttgacctcctcccatgaatcgaagaacgccaggcgctcgtcgcgctcttccggcgagagacgcgccaggtcctcgggcatcggcctcggctccctcttcagtgagaggatggcggcgatggtgttcagaggcatctgcaccatgacaggaggcttctcctcctcgccgccgtctccacctgcagtggaggccgtcgccgccgccgccgcgtcgagacgcttcccctccccggtgacggatcccgcatctgcagcgatcgccttcacttcctcctcatcggaaacctccaccgtcgtcgccgccttcggctccggtccaggagtttccatgaccagcggagcgggaagaagaggcggccgccgatgagagggaggtggcgagagcggagagaattcagatgatcggcgctgcaatgaatcacctgatgcggcgctgaattcctattgggctgcgcttaggcttttccttttattttattgggcttagggtagcccaaaacggatacggaaacatacatgagtttttttttaaaattcgtatctttttttatgcaaatacgaatataataaatctgtttttgttggacgtagacacggaaacggatatccggtctagcaataacctaaaaagaactcaattggcccaccatagcagcgggtgccatgcgtagtgagctagtggccagatcatcatgtggttcgagcccgacacgacgaccttcagcttgtggacgtcaaactcaaactctaccatgaaaacgttgttgattaaggctgtgttcggacagcctggttcccaaagttaacagtgcgtacggaaaacggaacagttcattagcgtatgattaattaagtattagcttttttaaaaaaattgattaatttgattttttaaaagcaacttt

SEQ ID NO: 45679 - DNA, 623 bp, Oryza sativa
tagcatagcttttcagtcttttgtagaaggctggcgatgttggatactacgtcgacgactgacgaatgcgaactaaaaactgtatgcattttgtctgctttttagccttgacgctttggttagtttctggggtttctttttaccctctgaattcgaagcatgcgtatgtcgtttttcagcattggacggtccgctgttatagtacaagaaacaagttgttacattttgtattatgtttgttcctaaacgtttggcgccaataccgagctatcgtcaactcgtcatgagtttatttgcatcacctcgcactgactatcggatcttatactccctcattttcaaaatgtttaacaccattgactttttagcatatgtttaaccgttcgtcttattaaaaaaaattgtgaaatatgtaaaactatatatgtacatgaaagtaatttaacaatgaatcaaataatatgaaaagaataaataattacttaaattttttaaataagacgaatgatcaaacacgtacttaaaaagtcaatggtgtgaaatggagagagtacttcatgacaaagtacccgacactataccgtgaaattgtatctgccagtgcatccggatgtactgcaatt

SEQ ID NO: 45680 - DNA, 1501 bp, Oryza sativa
aatggcacgcttagaggtcaataatagggctttattttcgccgtttgctgagttgtcccatttcgcgtatagtttcggagcccgaagacccgcagtgcgaggatttcgacgatcaagctcaagatctcgagcaaggcaagccacctttgaacatcttgagcctatatttgaacttaattatgttgcttggaaaatattatgcattgataggatcgtacttaatctgcttgtcccgtctgcaaggcagattggcggacctacctaatttgttgcatttgacccttccattgtaattgttataccatgttccctagtaaccacctagttgcacctcggaaaccgtgcactcagcacgagtatcgacggtcgccttcaaacttaaaatctgagaaacatcttgggtaaaacttgggttttacaaaacacttggaaaacccgactcctgggtcggtgcttgcgaacctaaatgaatttccaaaatcgcggaccgaggaacgtaccgggtgtacggtttcccgctcttgcacttaaggaccgtttccttggaatttcatccgaacataagacaagtacgaccacatgggtggaatgggacacccctgactgagtaactagctaatcgggggagccatgatgccaagagacatgtggattcgccggggtggtgtcggggaggacccctgggcttcctggcatagtatggtctgggacctaatctggtgttggtctgggacccctcttgttggcatatggtgaacctgtgtcggctttcgaaatgccttgtcatgaaagccttaaggtctctagtcgtggctgttctgcacgggctggatgatccgggttagtaatatcgtgtgggtaaagtgaaccccctctgcagaggttattaaactgttcgaacagccgtgcccacagtcatgggcggatgtgaggtgattcctagcgtagttttgcttgactactgccttgtgaaatttgctgttgtggaataggtttgatatttggaaaatctgcggctgatgggatcagccaggcccgggtggccgtttgaaagctgttggccgggtgccaatcttgatcaattcaaaagactgatacattgcacttactccgaccagacgagacgcactgtctcatccgtgtcgtttgagaagcactcacttagttgtttcagaaaggagttcaaataaaatcaattgtaaaaacaacagcctttccttgaagcctgcattaaacacttatttcccatggcttgctgagtactcccgtactcacccttgctttatataaataattcccccccaagttgtagaagaagatgaagcggaacccgttgacgaggagttcctccaggagcaagccggctacgatgagttttagggtttcggcctagttcccaagtcgcgcctgtgatgtttggtccaagtcttggcttccgcttcccttttgtaatgtagttgtgagctcgggatctgtccgcagcccaacatgaccgtactcc

SEQ ID NO: 45681 - DNA, 164 bp, Oryza sativa
aatctctctcgctcgctgtattggagcgccgatcgatcaatcgattctatgtgtacgggataaactaacccaaaatatatattcaggcgatcgatcgattaaactactggttgtgcaatccgaatcagattctgagaccggctcgatgatctcgggtgcttagc

SEQ ID NO: 45682 - DNA, 1158 bp, Oryza sativa
ttttttgtggcacataggtaagcaggaacttttttaatggcataagggtaaaagactctgattatgttggtcctatttcgtaactgatatgggattttgtcagttgacagtttagaaaaatagcagaacactttctagaagagatatttcagtattttttcacatagtcaacagtagaaagaatgagatgcctacacgcattgtcttcaaagaaacatatattgtacccattggaaaattgatcagttactgaccagcgaattagaaactataaaatcatgctcaatcaccttgagctctctattggagaactatgtctctgcttcctcttctttttaaggattaactgaaagtaaatataaactttgggctgcgaagatgacaagaacctctattttctgtaatgctttagttttgccctgaacaatgaacaaattagcacaatggagtatattgttaatgaaactcgataaagaaaataatcagcttatcccttgtagcaaggttgggttcaccatcctgattgtgcagcagtaagtgtaatcagatcattaacaggcattgttaattcaaaatcaatatctacccttaaatcttgaaatgttcctgagccacaaaatcataattagcttcaatttggatagcatatcaacgcatcagtgctgaagggtacatagttttaccttaaaactggagagggaatgaagttcataactatctcctacaacacacatttttatttagtggtaattcatggttcttttagttcataagttgactagttgataattattaggatttactgattcatgaaatacgaacacatgaatccataaaaaacattcctaattactacccactttggtcagaaacttgtggaactttaagtatcaaaatctttttcaatatttagattggaaaataaaaaaaacatatatgtagaatactagagttttcttggtaagtttcaaccaaaatactgtatttctgcgggactctataaatattttaaaatagaatcagttgttaaggttctgtgtgggaactgtgtcaatgtccaagacaatgtttttgtctaaccatgtaatgtatttatgatcacaattttgttacatattccttataccaatcctttaatttatggctaaatatttcctg

SEQ ID NO: 45683 - DNA, 613 bp, Oryza sativa
cggtcaaacatgtgctaaaaagtcaacggtgtcaaacatttcgaaacggagggagtagtttgtatgtcatattgaccttgcatagttaaggtctcgagtatatctccactgaaatagtcagatggcaacaacattacagaaggtcactcactggataacaaagttatcattgatgatcaatgtgcgatcaatgccctttaggacgcctttcccaatgatttggaactatctctttagccctttttaacatttctcatgatcggattataagttacgggttttatgagtggtttgttgtgagaatagtcacttcacacgtatggtttgttattatcttttatgttcgtgttgatccaatcttggttggttgcatgcatatagagcatttacagatacacatttactatttgctcaaataaaaatagagacagtttagtagaggatgattatttcggaaaaacatcacgttgattatagatgatgactttgttatccagcgagtaaagaatcaatctgtatgcatgtaaactattaaataaactataaaataaagacattattaatagtttgtttccaatacttgtatagaatttgaaagaaaaatgtaagaaaa

SEQ ID NO: 45684 - DNA, 305 bp, Oryza sativa
atttaatttcctcctgattggttacaaatttgtatgtgtttgtgtttaaaatttacaccctctgtcatatatgtgcagaaagtatatttgcagttcaggaatgagattggatcttcagttgatgccccggcaactattgaggcatctgttctagatgggagcagcattcttttaccatatagattgaaacaactagctcagctaatcaaagaacccaatgcaaggaaccttgggcttaatcactctgtatttggtaaagtaaaaggtgttcaactgtcatcatacctacagcattcgatctcaga

SEQ ID NO: 45685 - DNA, 1501 bp, Oryza sativa
tgcgcgtcgtcgtctgcaccgcggacggcgcaggtggccatgctgcagggagaggctgggctcgacgtggccccgtgccggcgcgcgcccttgcagttgccggctgtgcgtggcactgtatgcaccggagcgcgcgacgctggggcgtccacttcgcgttcggacacgcggttgacatgctcgagagacgagacccggggccgttcgttcgatctgctcggcctcgcccggcgccgccgacgaggcgaggcaaaacgatggtcacgatcgacgcagcgatctcataggctgcactgcagggagcttgcgggtctcgacgtggccgtgcgcgctctcagctgtgctggtgcaaagagcacgacgcgcgcatgcagtagtgccacaccatagagcgcggaggcggtggtggactggtgggtggtcgatcgcacagtggcacaacacttaagtaggatggcaattttacccagggtcccgatatccgcggatacccggctcaatgggcatgggtatgggtgtaatattttgcctatgggcatacccgcccgagacccgagaacatagcgggcagcatccgagtattgttttttacccgcagataacccatgcccaacctaatacatatgtatttgctaattttggcccatctcttattcctcgtacccttttctcttagcccatttgacccactaaccaaggacatatatatactcaactaatagaaaccctaacctaattccccaccctcttctcctaccccaatccccatggcggctggcggcggctgcgcggctgccggtggcggcggcagcggcgcaggctagcgacaatgcagtggtggctggcggcgcacagcgcaggcggcggtgcacggccaagcaggcccgatgggtactcatcgggcatgcccgtgcttgacgggcatgggcacgggcataggattttgcccgatagaccttgcaggcatgagtcaggcacgggcacgtgggtcttgggtcgggcatggaatcgctttacctatgcccgatccgacccgttgccatccctagggctgtattcggcacccgttcttcccaacctctcttccttatttttcgcgcgcacgcttttcaaattgctaaacggtgcgttttttgcaaaaaagtttatatacgaaagttgcttttaaaaaatcaaattaatcaatttttttaaaaaagctaatacttaattaatcatacgctaatgaactgttccgttttccgtacgcactgttaactttgggaaccaggctgtccgaacacagccttaatcaacaacgttttcatggtagagtttgagtttgacgtccacaagctgaaggtcgtcgtgtcgggctcgaaccacatgatgatctggccactagctcactacgcatggcacccgctgctatggtgggccaattgagttctttttaggttattgctagaccggatatccgtttccgtgtctacgtccaacaaaaacagatttattatattcg

SEQ ID NO: 45686 - DNA, 1501 bp, Oryza sativa
cggtgcaggggccccacatgtcggcagagtttgagtggtggtggagcatcggtgcatcagccgtagattcgtaggtggtgagcggcgggtgaaaacccagcccggcgttggccggaccgacaacgatggttaattctccctcctgagggcgttgtcgtgttgtctcacccctcaagggtgattgccgggcgaaagcccagtcttggctcctttgagccctgatggacggcggtggcggttttccgtcgcttctcttcttgaagacatcgttttggcaccctccttgctgtagggcgatctcgtctgtgttcttttgttggtctagcggcggccggtcacgcttagtgacggccggtctggtgctaaccttctcctggccgtagtgggtggtggtatatttttttcctttctcctggttatgaccctccagggttgtaatcttgtatttttttcctgctctatcaatagaacttcgcaccgtctcgtgcgagtcgttaaaaaaagttcttggttctgcacttctgcttaatggatgagtggacatataagcatgcttttctcaaacttttatatatgaatttcttagaatatatattttttttaaaaaatcataatagttaattcatacgtttgtacccttgaataattatcacaaatcatttttctactcggtcattcagtcattggcacaaaagaacacataagcggccaaaactgcaaccccaggacagagcatatttactacagtttcatgtttgctatgagctcaaactcaggacataaaagaacagtcaaactatgaaagaaaacaaatatttgctgaatcttggaaggttggcaatctgctacaagctatggcggatctgagagcacaattccaattaaaaactgagattgaacttccaacaaaaccacttcaggtccaagaataatctgctgctactaatggctaccagggacaccaattgcagtctatatcattcttgattgattcactatcatgcaaaaacacatcttccaaatggttcagcgttattttctcaagtaaaaaggctaaacaaatgagaaaacagagcacagctgcatatattagattcattcagttggtggagagaaaatgttaacacaagatggtaaaagaccctgaaggacacaactgctaaaatctaaggaataagaacattgccccattgttacgcttattcatatgcttatttgaatcgcttattagcaaataaacgatcatttgtgaataaaacttttacatatgtttagaggtgaagatttctggttttgcggttaacggtcataaaaaaaatctcgctgttaaattgagggacctccggtgaacttattccatatccgcgcctacgtggagtcaacaaatcccatgttgggcccagcccaggcccagtttgtttggaggcctggagcgagagagttcgagtcggatccctaccgtctcccacaaatccccaagacccccaactatagatggcca

SEQ ID NO: 45687 - DNA, 230 bp, Oryza sativa
agaaggggcgccacccgccgtcctggaagaagcggcagcccgccgccgtggaggcggaggagcagcgcaggccgagcgacgcggcgaggctctgcgccacgtagccggagtaggacaccgtgattcggatcgccatggcgagcaagcagaggagccgtagcgggatcgagaggagacgaatcgagtagcccccggaagcaggcggagaccaaaggcgccggccgatcaga

SEQ ID NO: 45688 - DNA, 1501 bp, Oryza sativa
tggggaaacgtacactaacactctgttgtagatttgtagtcacactccgtgaggtcgtaatttatccgcagcctccatgattccaggagtgtggatgaacatgggtctagccatcgaccttgtgatctcaaaaaaatatgttgcagaaatctagaaagaaaacaatgtactcctacatttgttggggaaagaaaatgcagaaacctacaacatcaagaacaccttggtgattatggttgagtgtagtttctctctcattcattagtcaaaagaatgtgttaaactaaatttacatagtttaatgttccaattatttgtatattcctgtggaaaaaattgcagctgattagcaccatccctatatttctattttttgaaagaggtcatgaatcatgatttggattatttttgcagaatttaacataagaaagggatacggtttaggcataatagtgtaatacacttttttaagttttgatttagctggttgtgactgaatggttttattggggtggcatgttcccttcaagatatcaaattcttgatggttgcacccatattacatgccattgctacagtattcctcatttcttctgtccaaatatgcttgtatgatctacttctgctgtatactgaggtcccatgttagtcctcacaatccattcacattgttcaataacctggctattcttgtgctaccttttactcatctgaatatctgactaaatcagctcattgatttccctatacatgccatattctattattccagtgagaactatgtatgtttctcttaaaatccacttcgaagttagagctatcgttgtaactttttgtcagcctgttgttttttcctttttggaaggtagggtgaaaactcctgtgagattctaccaaaggcatatggcacactagcactacagtatgatgccttatcaggggcagtcctatgttcagctaccctggtgcaccggacaccgggtagcttggccatttctcactgtgttacgctaccttaatcacaatattactcaataattagcttattagtatgtattggacacctgattttttttttgttctgggttcgcagccttaggaaacccgccttgagaacaacatttgaaccatatttccatgccatgtttgtgaacgtgtttgattcaccacctcaaaagagattacaaaaacaggtgcactgagataagaatcaagcagtgctatgacatgggacagctgaagagaaggagattcaatctgaaaccaatcctttatcccaaacctctgagtaagggttttgagctaaagctgccagacagtggtcctaggtatactcaccaacttatacacaaaagagtagttagaccagtgactcaaatcctgaggttggataatatgtttttgttaatctaagataaagattccatgttggcttggtgatttctatggtcaaccaatatccactgtataacacactatatcaatttcatgtccagtgccc

SEQ ID NO: 45689 - DNA, 1501 bp, Oryza sativa
acgggagtactcagcaagccatgggaaataagtgtttaatgcaggcttcaaggaaaggctgttgtttttacaattgattttatttgaactcctttctgaaacaactaagtgagtgcttctcaaacgacacggatgagacagtgcgtctcgtctggtcggagtaagtgcaatgtatcagtcttttgaattgatcaagattggcacccggccaacagctttcaaacggccacccgggcctggctgatcccatcagccgcagattttccaaatatcaaacctattccacaacagcaaatttcacaaggcagtagtcaagcaaaactacgctaggaatcacctcacatccgcccatgactgtgggcacggctgttcgaacagtttaataacctctgcagagggggttcactttacccacacgatattactaacccggatcatccagcccgtgcagaacagccacgactagagaccttaaggctttcatgacaaggcatttcgaaagccgacacaggttcaccatatgccaacaagaggggtcccagaccaacaccagattaggtcccagaccatactatgccaggaagcccaggggtcctccccgacaccaccccggcgaatccacatgtctcttggcatcatggctcccccgattagctagttactcagtcaggggtgtcccattccacccatgtggtcgtacttgtcttatgttcggatgaaattccaaggaaacggtccttaagtgcaagagcgggaaaccgtacacccggtacgttcctcggtccgcgattttggaaattcatttaggttcgcaagcaccgacccaggagtcgggttttccaagtgttttgtaaaacccaagttttacccaagatgtttctcagattttaagtttgaaggcgaccgtcgatactcgtgctgagtgcacggtttccgaggtgcaactaggtggttactagggaacatggtataacaattacaatggaagggtcaaatgcaacaaattaggtaggtccgccaatctgccttgcagacgggacaagcagattaagtacgatcctatcaatgcataatattttccaagcaacataattaagttcaaatataggctcaagatgttcaaaggtggcttgccttgctcgagatcttgagcttgatcgtcgaaatcctcgcactgcgggtcttcgggctccgaaactatacgcgaaatgggacaactcagcaaacggcgaaaataaagccctattattgacctctaagcgtgccattatatagatctcgagatttgaagaattttgaaagttgaatggagtcaaacggtcttacggttgggaagatattaaatttctaagattattgtatttttggtctaaaggaaaaggatttatttaaatcctttttgaaaaagaaaagaaaagaaaagaaggagggagggaaattagacttcccttgggcggctagggcgcggcccgagagaaaggggcggctcggccgagcttaa

SEQ ID NO: 45690 - DNA, 1501 bp, Oryza sativa
caaacaacatgctagtgacacaaatttaaatatacaacattggtctagatgagactttccatgggatattaaaagagattttccagagtattgaaagcaaagaaaatgaaaggagatcagagggggagattgaattccatgagaaatacttatgaaaataagtggtatagaagataggaatgaataacattacctacgaaggagggttacatgggagcaaaaggaaaaccctctatcccagtcttgcgattgaaaagtcgcaaagggatagaaggcgttaaatagaagttcaaagagctacacgacaacatacaacatatgcatagtattaatagtcacaattaacagttcgtcaagccataatggaatatttacattatcaattgtggcagtgggaagatgtatttttaatcatgcaataggaaccttacgcgatatattccaatgaaaaagatatgattaacaccgacttaaacaatggttcctaggccaaactcttattgaatcggtagcagtcacccataagagactggatgaagatttctcccctctttttttcttcatttttaagccatcaagaaatatagaataaatccaagcttgtctatatatttcatatattcaagccttttttttcagaatttatacaaagtatgctagtaagaaaggctaaaataatatttcgttttcaataattttagaaagtattttataatgaacaagaggaaaagcttaagtactactgtactagtaatggacaatgtcatcagcttctcctagacacatgtagtccctgtgtatattccaaaataaaagcaactcttattccaagacaactttagtaggaggaaaaatgaccaaaatcattaatagaaaagtagttggtggttgagtaggtaaggagtattaaagggataaaacttctcattttacaaatagaggataggtaaaagagagaaaaaacaactattttgagagaaaaattaaaatctagaaattgtttgttttttacagagagaagagaggttcaacacaactcatttgagtgtgtatcaggctttgccaatagaacaaatatatctacgagagttacagcttctccaatgttgtttgattaaccgatgaaactaaccactttacccctcgttagttgaaagcgatggtgaagcttagctcatacatgatgcaagtgaatacttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 45691 - DNA, 1501 bp, Oryza sativa
catccaggcttccagatgaactggttgagtagccttaattccttgaagaggtgcttgcagactacattgaattctggagttggacaaagggaattttcaatccttccctattactagcactatattcaaaggagtagaatatactctctctctctctctcttttggcgaggaaaggagtgaaatatactgggaaccatgtaaacaaatgtgtatctttttttttgacataagcccttagttgtcagtttgtaattgcttttaagcagaggctatggacatgacatgagtaccagattagtagtttgagctaattttctttgcttaattatgatagctgtagaacagtaggagtacagtactaagtactgtagttaatataagcagcatcactccagcccgtacaaactcaagactcaagagggccaatcaggaggcctgatcattgcatcaggatgcggactcttgggaacggcacttgtcatgggagaaaaatatggtcttggagactgaaaccgtacgtacaatacaatactcacctgtgccattcttttatatgcaaggtcggcaaccaacgcttcaatcataatacaatttcggcagacaaggttagcatggtacaaccttgtccatatgcaaaccatgcagcgacagccaattttttttccaaaacgcaaatcttgtctactagtagtactgaactactgatagattttgatcaattcaccatttattaaagatttaatcagacgatgccaaaacaaagacagcgtgagttcaccgtaccggtctctttctgagacaaagaaaaatgaaagaaaaggataaaaaaatgagtaaaacatgcatggagccatggagggagggtgtgaagtgtgaactaggaaaaagattggcatcaagagaatatgggcacatttaagcgtgcactgcctcgtgtgaatgtgtgattgagccattgggtgagttggttcttttgtcgtgctacgtttctttgatctcatcatctttttttcctaactgttttagttgccccggtctgcaggatggtcaggtgaatggtgctagatgttaacagcagcttcagaattgcgtgcaccgttgaatgtaacaagtgatgtttgtttcacctgcagaaccagtggctcaaggaggattgcctgagcctgacgatttctgaatagcccctcatgtctctttcagaaatccaaaagaaaaaaaaaaacttctggtgagaagaaaaattacccgaaggatcgtgaattatctcagagatagcatgtgatgactagtagtccagactccagacatcacatgtcaatgcacatgacaccagagaaaacagttaggtaaaagaaagtgggttagtgaaatcacagattcacagtaacagtcgtacctccagcaaaactgtaatgatataattcatttttttgaccacttgcaggaagttagaggcatgaattttctgctgttataaatgctttgctttaatcactacag

SEQ ID NO: 45692 - DNA, 1501 bp, Oryza sativa
tagagactgagggtgcaattgacaaggaaatgtataaaaaggaccgagttgtaagagttggaatagcggaaggggcgtatctgcaagaaaaactatgggctccagggacctggttggaaatctcaaaaaatttggaccatttctcgatttgtgcgtgtcatccttgcgcaggggccatgctaatcttctctgtatcgttccaattttatcggatgtctccgaagagacaacacaagcggcagcgcgcggggttataaggtgggttcttcattgttcggtaggcgaggtggtactaaacctgtctcccctcaacgctcccgcgacccaccgatccccatccaacggcccccgcagcgcccagcggcatcccgcgcggtagtacacgctcgtcggccgtatcctccgttacggcccaaacaagcagagagcacactaggcttctctcgcctgcggcctcgtagctcaagtctgagccccatcatccatcgtgaccattcatgaataaaaccggtttgtatatgtgctcctttttttttttgtccggcttagttcgttcttgcataacaactgaggttctaagtggcacgaaaaagggataaaacaattaacacatgatgaattaattattaactattataaacttgaaaaatatgttcatttgaatttttaaagaaaattataccgtttaacaagtgtcctaatgaaaaacaagcaagttaagtttaggattgaagtaaactgtaaactatatgtctgaccgcttgcagaactactgattgaccagcttgattgcgtccaaaatcaaatggtagagcgagagccgaaggcaagcccagctggtttaattagcaatcgcctatataatcagctagcgcaacaactgttagttagttggttgttgatgttgtgcttcaagaaatcaattaattaattagtctgttcttattgcttagtgtactacacactcttagctggagccctagccatgggaagaaattaattaaatccccagataaacacatgaccacgaaactgcattgctgtactaaagctctgaactagctagcaacgcgtcttagatatattccaccaagcaaaagccacatcatgctgtgctgtgccgtgccaaattaaaaccacatcgtggccttcaagtttctgctagcttcgtccttcgttgctaatcccagccagttaatcaattaattcgtcagatagatagatatatatacgcgttcatcagcgtacgttcttatagctagaactcatcctgctgtgcaaaacctgcatcactagctagctagctagctctgaatcctctagttgtctgatctcgatcgatcgatcgacaactatctcgtccacatcaagaaagcaaagttttcttgagctacgaatcaatcgatcgatcgatcgccatgggcaacagaaacgaggtgagtgagaaaatctgaattgatcatgcaatttcagagccaaattgaggtagtagcttagctac

SEQ ID NO: 45693 - DNA, 1501 bp, Oryza sativa
ttttttccacaggaatatacaaataattggaacattaaactatgtaaatttagtttaacacattcttttgactaatgaatgagagagaaactacactcaaccataatcaccaaggtgttcttgatgttgtaggtttctgcattttctttccccaacaaatgtaggagtacattgttttctttctagatttctgcaacatatttttttgagatcacaaggtcgatggctagacccatgttcatccacactcctggaatcatggaggctgcggataaattacgacctcacggagtgtgactacaaatctacaacagagtgttagtgtacgtttccccagggaactcttactgtaaccccagggcccagggtgctctgatgagaatacaacactaaatgtagtattatcaacacatacaaatgtaatactacaacacatattaatgagcaatgactacccttaagcagttatgcttactacgttagcaacaacaaaatctgtgataaatttctcccaatagttatgctaagtcctaaatctgcaggatacgcccgaggcaatgcatagcattagtaatcagttaatcaccgaacctaacttcaactatcatctcaactacaccgaggttatcctgatcaacacttccaggaagcactgccagccacaaagctacacatccaagagtacgcaagcgtaaccacacacgacactcccagtaaaatctcagccacagaaatctcagaaccacagagggagacagagagagagatagcaatcaagctaccagtgggggggggggggggatcgcgaattcacctgcacaggctgctgctgctgcttctccgccgccgccttggcggcgccgttctcggcggcgacggtggacgcggaggccatgggggagagcgccgcggccgccgccggcgaggccttccggagcgacgcgacgagcgagcggcggagcgaggagaggaggaaggaggcggaggaggagggatttaacggcatctcatgccgcgtcgcggtcgcggtcgcgggcgtggcgagaaagccggccagattcatgaggggggccgagcagcagcagcgggtcgagtcgcgccgccacgggtgggcgccggaggaggcgtcgcgaacttggcgagacacgcgagaccgcacgcgtggcgtgggtactagtacagagtcagtgacgagtgggccatggaaatcatggagcccgcatgtctgtgagttaaagggtggggtttcgcgtggaaagtgtgcgttcgaatatgcccggttttttggaagtgaggggagatggcactgcaaagtgtgtgtgtggcatcggcgtgcgtgttgtcatgtgccattgaacctggacatgtttttttagtggaccggagcgacttccggcccaatcaatttgctctcttcatgggccggaaagcccagaacaaatcgcctaaccaaaaaccctcacctaaacctccaccaccacaagccgctctcccaaccggc

SEQ ID NO: 45694 - DNA, 1501 bp, Oryza sativa; identical to SEQ ID NO: 45660

SEQ ID NO: 45695 - DNA, 1501 bp, Oryza sativa
  unsure (1)..(1501): unsure at all n locations
tggcgtttcccgtcactggctgcgccccctctcgatcggattagggttttgtggggtggagttgncgncgncggtgaacttcgtaccttgtgccgtgccggcctcccaccccctctttaatggcgcagtgtgacgggggcccaccagccattgggctgggcgccccccgatcagggcgcggtcaaggccctcttgagccgttgggctcaaggggagggagatctatctaacatcagttactgcgagatttcatcagatggaacttagagcttcgtttttgtcttctggttttcattcttcagttaatctgtgataaattgaacttctacgcatctcaatttatattagttatgagtatcaatatggtcctccagatactcttttgacgtcttcaatgtggatccgtgaccaaaccttcgtttttttttccataatggtaatctttttttttgaggacattcataatggtaatcagagtataatttttccttgtgaaaaggtattgctggtggtatattaaggatttgtagcataattgtcaccatgatttttaaatgtttcgagctacgtttttgttgttttggataatttgaaatagaaaaaggtgagtacaaaggagctttgattccaacctttccaaagtgaaatttaagcaaaatttgttgtttgggtattgcgttttagcttcatggttttagctgtagagatttttgtagaattggatctttggagaaatacacttataaattgcagcgtttttgccactacacaccgttaccaatattttattatattggcatggtgaggagtgaggagacgcgtgaaggtttgaaatacccttgagttattccaattaggccaagtgaaatgttattggagtatactcttggtacccgtctttgcgaggtgagcgtaacgctaaaataaatgttgggtcaagcatgtttagttgtagtcaggatgatatcattgctcacccaacgaagtgtaatggctcagtacgctcgatgagacaagcggtggcaaacaggtgtaggagcatgccatggcacacattgagcacctttgggaaatgacgcatgatctcggtagggaggtccgaatctagctctaccactgcgtggaccatcttaccatcgcgtggagcaaaagctgacaatgtgtgataaggactttacctcacttaaccacatttcaagtgactggcttttgctgcgccaactacatgtaaacctataaagtcagagtatgcattggtaaaaaatatctaaaatgtaatgttccttgcaaaataaaacggcaaaaacttacagtatgtagaaatttccttagtaagaaaacaatggaaaggacaaacgtgaaattcaattttgaaattcttccgacccgttttgcctccaggggtaaagccgtcatcttaacactgccctctcaaaccttttcggttttttagggtttaataactcttcgagcccaccgtgtccggcccagagcccactag

SEQ ID NO: 45696 - DNA, 1501 bp, Oryza sativa; identical to SEQ ID NO: 45669

SEQ ID NO: 45697 - DNA, 257 bp, Oryza sativa
attataatgtggaatgaggtgataaattgataggatcaggaagaagccatgaatgtccttgatgcccaatcaaaatttctccttttgttatgtcaatgcagtgatagcagtagtcatatgtacgaggtcagtttgatggcacagtcattgttgccagtgatcattttgttgatgtcagcgtccctccaggagtcacctactcaggccaggaatgctcctttaggtccttccaacacttcttagcgtcgggaccatta

SEQ ID NO: 45698 - DNA, 165 bp, Oryza sativa
tctggtgcaggcgctgccgctagctcccccccatctcttcgatctcctagctgagctgatcagatcagctgatactgctagcttcctcgccatgattgtgcagtgctgcttacacgtgaggcctccacagggcaccggcgctgattggaggcccgaaagcaagca

SEQ ID NO: 45699 - DNA, 1501 bp, Oryza sativa
gctcagtaaaagatatagattcaggccaccaagatatagatcataattatcccagtaacttcagcaatactaatggtagaaatcaagatataaatcctacagagggccagaggcatcacaaaaaacagaggggagtctgaatttttcatattagggtgccggaacactgaaaaatactggaacacccagaaatgatgttattttcttctttgtgtttgcagtattaccttgaaaggaatcttgaggccagagagagggaacttgcacgtgaggaagagctcgaggagaaagcccccaaagtaaaggccaagtcaaaaatgtcaaaggtgaatatctctactgtcttttcacgatgtgaatttggatgcgaactacaattaattgggtttagcttctataactgacagttcttttttctaactgtaatacaggcagagaaaattgccagaaagaagcagaagatgcaggcattccagcaaagcaagcaaaaatcgaaatcgctgaaaaacgcgaagaggtggaagtgagaatcctgattcatggtatcatccacggtgccatacacctcatttgcgacaccagtgacaaggcaggcgcatggcctgctgtaatgctattatactccatatatcactagcaactggtgtacatacatcagaaaggaagtaatcctagcagtagcatcataggaggaccaaatgctgtaactaaagcaggaaatgatacatgaccttgtacataatgcaggcagtttctgatggaggcatgctttattttgtatcaagtagcaataccaattcatgttcttccagctttcacccatacggaggaaccacacattgtaaaaagttactgcagctgggcaattatatcatggtgtaaaacctatactgattggttatactgaagataaaggaagcagatcaaaatgctctgtttttgtctatcctaagaatcacatgaatgaactacaggaagccctatttatgctgttggagaagttttcaatgatgaactaccgtgcagctacatattgtcatatacaaccgaaaatcagaaacacagaaaaccctgtgaattaacgattactcctgttacatggcaaggaagattggcacaacaaagattttccttttttccctgaaaaaggagctaaaatttgtaccctttcatggcaaggtgtagctatacatcgcaataagagcacggcaaatgcaaatgcccaaatatcccaaaacatatttggagtgctaacaggtcaggtgaatacaagccaataaactgggattgaatttccaacgggaaaaaatagttcaggtccaaggatgatctcctgttagatcctctactcagatggctacttgggaattgaacactaactgcagtctatatcatctcttgattgcttattaacattttaaaaaagcatgttcattgatttagggtgtgttttctcaagataacatccagcaatagctaaacaaatgagaaaccaagacag

SEQ ID NO: 45700 - DNA, 1501 bp, Oryza sativa
atgctttactgttttctaaatttaaagttatgtgaaaaaagaacatgatttgctatatatcggaggcgcttctaaaaaaatatatagttgttttacaaacgattgaggcattcaaattaacatcatggtgtgtgtgagaataaaaaaaaaagcacctcttagccaaaatatttagataacaataaatgatactactatgatatttggtcataaattgctatcctcccttgtcacgaatctaccgtgcgatatcttttctaagttagaggaaggagctttttaatgtactaaatatggcataccatatatagatatacgcatacaaattaaggcgatggaccaccgaaaaccaattcgtgtatggaagctgatccccgataacggatcctttggatttaaggattttttggaaaaaaaatcgggagaaattgaatgcaaatgaaaattcatatgatatgaaaatgaaaattcctccatatttagatgatttttaccataaagtcttaacctcatgttttcaaattcttttttactatatggtatataaaaatactttattattattgtttttaatataaatcatctttcacacactacataagatatttttatgctatcatctcttgtataagaaaattctcacttatatacacgtaaagaaaaactaaatataccggaaaaaaaattaaaacctatatacaaacttccatattgtgtaaggagggcacataaaaattttcatagtattttttttggaaaattgtaaccatgccattataattttgctaaatttcagatatgccatcctgacccatatgctattttaaaacttctaatgagataaatcgattgtttatcttgtatgtctctaaagatattttgggtgtttttgaaaagaaggtccagcccaagacatctcgtagaacaatggttaaagtcgccagtatgttatagaaagatacaatatcgatagtaaatcattgaactcgaacaaactcggtggtatagagtagattctctctcattttttgacatcaaagtgaacaaacccttattcttttatctttttcatttcacggtaagtgtaaggttgtgttcggcagccatagttcccaactcctctccctcgtgtttgcacgcacacttttcaaacagctacgggtgcgttttttttgcaaaaagtttctatacgaaagttgcttaaaaaattcatattgatccatttgttaaaaaagctaaaacttaattaatcacgtactaatagactgctccgtgcataatagatgttttcccaacacaggtgccgaacatagtctaagtgtgtaactaggcctgtggtgtacatagacgtgaaaaacgatcggaattggtagcatatcttcgaaaacgacgctcgatcagtcattaatagaccatattattcattcaaactactcagtgtcaatattaattcgatgtagaaagttattaaaaaagaattatagataacttaaaaatggta

SEQ ID NO: 45701 - DNA, 1501 bp, Oryza sativa
cgtgaaggtccgaagaacagtttgtgaaggtccattgtcatcatcatcatcaacaacatcttcgaatcaatgaagagccgaagaacggttcgtgaaggcttcaaggtaccgagggccgaaaaacagtttgtgaaggctccaaggtgcgcttcattgagaaggggatacatcttttcttctttatcatccaagaattggcacacttcgacgacatcatcaagactttggagataggctaatatttagtttgtgttctcatgtttagtttacactccaaatgcaatatgattgtatacacattgtatttgagtgggggtgttaagatattaggggtagtttagtatttttgcatctcttttgtacacatttatatttgggtccctttatattttaggggtagatcaatcagttgttgaatccccaatttcattatagaattcacaaaaaattggaacataaagcgtaagctaattgattggaagtctggaactctctctcatggaagtcataggagatagttctctgcatcaattacaagttacattaaattgcatgatatagcacttttctgacgacgcagatagtcggtcacggaagcatgtcaagtaattaggtgtcttgatcacctctttttttttttagagcaagggcaaggatgactccatttccattactagaaatgtgacttgctacagaggttcttacatccatcagattttaaagataaaaaaaagctgaatgtcaatataggtccctttactgaatgtcttaaaactatgttaacatatacaaaaatgctcactatagctcatatatgttctcttccacagggtttagaatgtactccctctatcccaaaaagaccgtttgaccgtccgtcttatatgaaatttttttatgattagtattttcattattgttagatgataaaacatgaataatactttatgcatgacttatctttttaaatttttttcatattttttttaaataagatgaacagtcaaacgttagacatggaaacctaagaattgagttactaaaaagattcaaaccagcaatggagaagctgcaaatattgaaccactgcatctttttgtactctatctctatagttcttccctgtaaattgcggtgtaaaagaagacataagcttactgactaaaataatgtgttgtaaaagtcatataaaattgttccctgagggaaatttacactaatttttttcactgagataaatccctttttatatatgatagacagcagatcactgatcaaagtttcttcagatgattaggaagtttctgttataaaaccggccccgaaatcacattagaaacaaaacgcggaagaaacaccataggagatctaaacatgaagacgacaccgaggcacgatatttgataacggagtgcagccgaggcctacatctccggggcactgattacgggcgcttctccccgatccagcatacacagtgtattagagttacaacgactca

SEQ ID NO: 45702 - DNA, 1501 bp, Oryza sativa
ccttttgaaaaacttatttcacaactagacccctgaaaaaacttatcccagaaatggtccttttttggcgccagagtggctggcgccgtcatccaacgggacggcgccagagaggctggcgccgtccttctgccactgtggcgcacgcgaaccgacgtggcaggaggagggcgccagccatgctagcgccgccgcctccattcctgtttctctatatggagttgcaacggtgtcatttttattttattttttcggatgttttttcacacttaggatcacgatacaaccaaccacaaaaaaaatttaaactcgaactaccacttagctaagtctgaaaatagctagcataccacttagtctactttgcaccttcactaaaattagaccataattcctttagtaaaaccctttgatcagcatgttaaacataatgcactctaccactatatgaaattacttaatataattcaaaatataaccacatgaaatgacatatataagttaaacagtatatagagatgcaattttttttatttttatttcatttttttgatatttttttcacacttaggagaacataggaaccaaccgtataaaaaataaactcaaacgaacaaaatatgtcatctattaaaataggcgtaactttctcatacggacttggaatcaggcaaataatatatgcacggacatctacagaaaaagttatatccaattctcccccgctctgccgggttcagaaatattaaaacctccaaattccacttgcaagattgtgttttcgaggagagaagtttttcggtagaactttggaaaattccacatgccacatatttcgtccgtttgagtttattttttacatggttgattcctgtgagttcctaagtgtgaaaaaaatataaaaaaattaaataaaaataaaaaagttgcacatctctcctttgcactagttcggagagagaggagaggagaggaaaaattctacaggtcacatattacgtccatttgagttcaatttttctatggttggttcttgtgtgtccctaagcgtgaaaaaaatatcaaacaaataaaacaaaaataaaaaaatttccggggggggggggaggcgccagccactctggcgcactccctagccacctcagcatcgccccgccacgtcggcagggggacggcgccagagaggctggcaccgtccactctggcgcccccaaaaggactatttttgggataagtttttctaggggtctatttgcgaaataagttttttaaaaggaccaaaatatgaaaaatccagttgcacagactgacctcccaatgcttaccatgcctacagggtttttacatccatcagagcaaaaaaatagtttgtctccaagcattatatgaaagtgatcaacctaggaatgatagaagccaatagtgagaatgcataaactatgatcaattgttcatatatgatcgatgcatttacaatctctaaccaaaaagattcaatgtt

SEQ ID NO: 45703 - DNA, 1501 bp, Oryza sativa
tagctcttccttgtaaattgcagtgtaaaagaagacataagcttactgactaaaataatgtcttgtacaagtcataaaattgctctttgagggaaatttacactaattttttgcactgggatatccctttttgtatgtgatagacaacagatcactgatcgaagttcttcagatgattagaaattcttagagagcaccaagataatttaatcatgcatcccgctttgggccagatgcttttccatccagttgaatcattgctgattttccttactgattctgagattgcttgtacagtatctgtttgagagcatttctgctcaatccgaaccacacgcccaattttggtgtcacaggtatctctcagagtgaccagttgcacagacctggatttttcacattttggtccttttgaaaaacttatttcacaactagacccctgaaaaaacttatcccagaaatggtccttttttggcgccagagtggctggcgccgtcatccaacgggacggcgccagagaggctggcgccgtccttctgccactgtggcgcacgcgaaccgacgtggcaggaggagggcgccagccatgctagcgccgccgcctccattcctgtttctctatatggagttgcaacggtgtcatttttattttattttttcggatgttttttcacacttaggatcacgatacaaccaaccacaaaaaaaatttaaactcgaactaccacttagctaagtctgaaaatagctagcataccacttagtctactttgcaccttcactaaaattagaccataattcctttagtaaaaccctttgatcagcatgttaaacataatgcactctaccactatatgaaattacttaatataattcaaaatataaccacatgaaatgacatatataagttaaacagtatatagagatgcaattttttttatttttatttcatttttttgatatttttttcacacttaggagaacataggaaccaaccgtataaaaaataaactcaaacgaacaaaatatgtcatctattaaaataggcgtaactttctcatacggacttggaatcaggcaaataatatatgcacggacatctacagaaaaagttatatccaattctcccccgctctgccgggttcagaaatattaaaacctccaaattccacttgcaagattgtgttttcgaggagagaagtttttcggtagaactttggaaaattccacatgccacatatttcgtccgtttgagtttattttttacatggttgattcctgtgagttcctaagtgtgaaaaaaatataaaaaaattaaataaaaataaaaaagttgcacatctctcctttgcactagttcggagagagaggagaggagaggaaaaattctacaggtcacatattacgtccatttgagttcaatttttctatggttggttcttgtgtgtccctaagcgtgaaaaaaatatcaaacaaataaaacaaaaataaaaaaatttcc

SEQ ID NO: 45704 - DNA, 1501 bp, Oryza sativa
ggaggtcaatctgtgcgatgggtcactctgagggatgcctgccacaccaaaattgggcccatgtttacggttgagcaaaaatgctctcaaacagacactgtacaagcaatggcagaatcagcgaggaaaatcagcaaagattcaacaggatggaagagcacctggtgcaaagtgggatccacaactatatcatcaacctaggcttcttgatttagatcagcttggtgctctctaagaaactattagagtttgtgtcaaatatgtgtatgtagtcggttatagtttaggacttggagttgtactaggtataggattatagtaagagtcagactctatcctaggatctctcataaatagagaggcatgcctgctgtaaccgcatggcgacttagcatagcgagagggagcggctgccggcggcgaccggccgtgagtcgttgtaactctaatacactgtgtatgctggatcggggagaagcgcccgtaatcagtgccccggagatgtaggcctcggctgcactccgttatcaaatatcgtgcctcggtgtcgtcttcatgtttagatctcctatggtgtttcttccgcgttttgtttctaatgtgatttcggggccggttttataacagaaacttcctaatcatctgaagaaactttgatcagtgatctgctgtctatcatatataaaaagggatttatctcagtgaaaaaaattagtgtaaatttccctcagggaacaattttatatgacttttacaacacattattttagtcagtaagcttatgtcttcttttacaccgcaatttacagggaagaactatagagatagagtacaaaaagatgcagtggttcaatatttgcagcttctccattgctggtttgaatctttttagtaactcaattcttaggtttccatgtctaacgtttgactgttcatcttatttaaaaaaaatatgaaaaaaatttaaaaagataagtcatgcataaagtattattcatgttttatcatctaacaataatgaaaatactaatcataaaaaaatttcatataagacggacggtcaaacggtctttttgggatagagggagtacattctaaaccctgtggaagagaacatatatgagctatagtgagcatttttgtatatgttaacatagttttaagacattcagtaaagggacctatattgacattcagcttttttttatctttaaaatctgatggatgtaagaacctctgtagcaagtcacatttctagtaatggaaatggagtcatccttgcccttgctctaaaaaaaaaaagaggtgatcaagacacctaattacttgacatgcttccgtgaccgactatctgcgtcgtcagaaaagtgctatatcatgcaatttaatgtaacttgtaattgatgcagagaactatctcctatgacttccatgagagagagttccagacttccaatcaattagcttacgctttatgttccaattttttgtgaattctata

SEQ ID NO: 45705 - DNA, 268 bp, Oryza sativa
cgtccggtcggagtatgtgcaatgtttcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgagcagtttaataacctctgcagagggggtacactttacccaca

SEQ ID NO: 45706 - DNA, 1501 bp, Oryza sativa
agtgatccagttttgatgcacgtgatgagccgtgccatcttctctaatgacatgttcaccaagtatgcccaacgctctcatttcgtcttatgcaaaagcactagtatagatattaaaatacaagtcatgcttaattgacattctaattaatgataaaacaagtcacaataaaataaatgatggttatggttttgtatagtaatttttccttttgcattgccaataattgcaaccgtattcaccatccaaaatttgcatgcacttctctcttttaccacttttctgttaagttaggtgcattgttgttttgctattgtcatcaaagcagtggcagttgacctttaacatgaatactaaaagatcattatgccctttagatgttcctaagcaaagcgacacttaaaattttagcaaataccataaaatatctgaaaaaaataaactgcagatacttaaatatattaaacattcagaaaaaaaataggcaggggaattatgattaatagtttgttctttgattatcattttgcccacgcggtttggtctttaatcaagtttgcttcgaatattagtttacctaatagtacaactcatatgtttgggcattggataagaagacaaccgcacaatttgagatctttggtcttattaaggacaactaccactatttggtctatttggctttgcagaaatgatgtggtttttcaaaggaaaaacatatcttctcctttacaggttattttttttattacacattggctctgctcatgggctatccttcagaaggtcaatttgcggggtactatcattgcggcttgtcaacaattggagctagtggccatggagttttctaccccggcacatgggtggcgttctaggctacggttagagggctcctgaagttctttttgttccttctattttggatgatgagtttatcttttgtttcttttttgttggctgtgtgcactctttgcgtgcaaaagccggaggtgctctcagaataattgtatcacttgatgaaatttactgagatcaataatgcttccattatcttaaaaaaagaagaggacaagtactgagtggtgcaatacttgcagttgcaggtgtttaattacaacattgaatctttttggttagagattgtaaatgcatcgatcatatatgaacaattgatcatagtttatgcattctcactattggcttctatcattcctaggttgatcactttcatataatgcttggagacaaactatttttttgctctgatggatgtaaaaaccctgtaggcatggtaagcattgggaggtcagtctgtgcaactggatttttcatattttggtccttttaaaaaacttatttcgcaaatagacccctagaaaaacttatcccaaaaatagtccttttgggggcgccagagtggacggtgccagcctctctggcgccgtccccctgccgacgtggcggggcgatgctgaggtggctagggagtgcgccagag

SEQ ID NO: 45707 - DNA, 267 bp, Oryza sativa
gttcccgctgcagtttagtcaaggcttagctccaggtatcttttgtttccgctgcatttttgtaagacttttatgatgtttgtaagacgtggatctgaatgtcaacattgtcgtttgtgtaccccggctggtcctggacggggattttaatgcacattctgcttggaattctattcgggaatttctgggcgtgacaggtgatggacactgggcttggacaaagggagtgtatgtggactttgtttgtcttacttatcaggccgagga

SEQ ID NO: 45708 - DNA, 1501 bp, Oryza sativa
gaagcatgagagttaagaacagcgacaactgaaggagaggaaagaatgctctgtgatcactctagctcagatgcagtagttcctgatacctccaaagcctgttgcttcagacaattgggtgataggcaagacattcagaaagtattactatcttcttcgttctttgtagtctgcacatgcaccagacttcatagctacagctctaggggaaagatcaatatctcgaccacgttatgttatagctagctctgttccaatattattttcttcattacttagattgtggcatatgtggaggtacatatgaacctatgcactgactgtcatgtgtgtaatgtgtcatttttctttcttgagaggatgtgtgcaatgtgtcagcagaactacgaacaatggtttgcataaacagtcacggatcaccattaattccagtaaaaaccgaccggtttcaacagaaaaccgtgattccaggctgttttaggaatatattccgctagcaaatccgaattatttcgatccaattcaaatttgaactaagaaaattggaaatggcaaaaacaaatcctataatactactccttccactagaaaatataatacttgtacgcaatttcaagattaaagtctcagagtgaaccacaatttggtccaccatttattaccaaaatttcattttaaaccataatctactcaatattttcactttggactaggtaataaaggatggtccaaagtgttggtaataaaaggtgacccaaactgcatgcaattcattataaatattttaactagcaattggcttaacaatatataaatctagtgacataaaagttaaaagttgtatatttgaattttgcctcaaatgtactttcatatttgatctcactgccaatgataatatactttaggaaaaagtgatagccaaagttggatgttcaacaccgtgccttctatattccatagataatgtaaataaatttagcctttgctcaaaagagctacaatcacttattacacaaaattgctcaactgcgatcacacaccacagagttcacaagacacaatccaaatttaacaaaactccaacacaaactaatagacaccaacacaagataaataaaccacaattattggagcctatattccaatggaggcagtaagatattatagaacctattgtcatgtttttgtaaaaaaaaaagaatttccatgtagtggttgtactacaaagttggaaagaaaaggaaaatgtattgaaaaaacaaagagaaatgacttcatgggccatcagcctgcctccattctttgccaatcagactctctccttttccccattttccagctagctagtgtttttaattgtctgtgactgtgagggaagtattagtggtttcctaattttgatttgagagaacttaatggcgttaagtctcaacatttcactgtgctatgcaagtacttgtactatgatcttacccaaaattatgtcgtgttatctgca

SEQ ID NO: 45709 - DNA, 1501 bp, Oryza sativa
ctttacagctgtccgaaagacttccaaacatcaaaatttgtttgtggtgaaaaaagttacagcaagcattagattacacttgcatgtagacaattttttttttgtgaaaaatatgagaggcttgaaataagtgctgtgccactggtatataggttatcactgaattcctgaacctcggtgagtcacaggcaatcaggcactatgtcacgttggtatcgcaaagcaccgatgaattctttctcgttttttgttcaggcaatgtccatgcaatgaacttgacatttctttgaaaaggatgagctgattgagaaagattgtgattgacatgtaaacaagaggtgcatactggatgacaccacacgaaatatatgcgcaaatgcatcgcggaaatttaagagggaagaaaaaatgaaacggaagatgacggtaaaaactcaaattttactttgtcagcttataggatcttgacttgttcagtcattggcagggcaggttttaccttctcaagttcttcaagaaacatatggcttctttgataattagacacatatgattcaataaaaaacagatgcacatgtgcatggtattaattcctaacattttagcaaagaacaagtctttatcaaaccagaatcaaaattgataagtatgaacttccagtcgatctacagtagtacggttgacattaaattaaaggaagaagcatttaaaccaaagatacgaatgagttagtttgcatccttctacacttcctctcaagtcttgagtctctattgaaaatgcttataaggtcttgagtcttgttcttctttccgacagcatttataggcttccctgaaatttcggtgcaacctccatgcttattctacctgaaaaattttcagagactgattctcctacttgggacttaataaaagttcagattaacatatactacatgacctaaaagaaatggattgctagccttgcctggcccatgatgagtccatgtaaatttcagaccgttttcaccctaagtacccaaaatggcctccactgacaacccatctccagtcagagttgatctgataagtttgtgcattccaacttgaaatacccagttcggaccggtacagcccggcccaagaattagtacccagttcatacaatttccttttgggtggatttcattcaacaacttttgaataatttatttctttcattcaatattcgtcagatattcagacattaaccttgaatatttaaccactgaccattttcagtctgttccccaacatgtacacagttaaggagccaatagtttctgaaaactactgcatcataacatagagcatcatcaagtagactactgtttgtaattgaaagagagaatcaaactctctgactcccctcctttccaggcaagttccaattttgtaaaagaaaattgcaagaaccaaacggaggcaaggcaagaccaaccagagtagactcttgaatctgtcagacaaagcagccatct

SEQ ID NO: 45710 - DNA, 1501 bp, Oryza sativa
aggtccttgtatttctcaactacttatagttaatcaagagtgtagatcacaaatcagaaggaaatcgtaacgccattcgtcagcctcagctttgtgacaggtcactccacgctgcctaacacgaaatcttcagcctagtcgtctccaataaatcaaaccgaaatcaacgaactggcaaaaatgttctagatgagaacatcagattgcattaatacttttatccttcaccacacgcaacatataattgaatcgatcaaagcaaagattcagatattactagaacagaaaaattacagtagaacaaacacgcctagaaagttaattaaacaaataacaactttgactaaaaaacttactagaaatgttataattaattgttataatattatggtgccggcgactgattatcagtcgttaattaactcccaaatcctctctttcatgttacacagggtgtagaaacactgtaacagttgtgtagaaaatagtagagataattaagtatacatgatatggtacaggtacaaagtctgaattttctctctgaagaaagtgaccatggatgaagttttctctgaagattttttgctgctgctgctcagtttctcctctcctgcccccatggcgagtgccgatcgttggcgccggagcccgggtaatcggtgagctccagttccatcctgccgttgacctcgccggcctccggttctccggcgatgacggcggcagccttatggatcatggttgagattgagcagacagttttgcaattgcagctaaacagaacatgttctgaaaagtagctactagtactacttgaaaacatggtgaacatgaacagttattacttatctgaatatataggttctaaaaaaagtgtaagctgatctctctctttttttttcaaaaaaaaaacttgatttaatcaaagttatgagatggaaaagagagctggacccggatcacctgatcatctcctctgctagagactggagttgcttcaaaacgctgcatcaccttgagggctggttgtgactcaaacatcaatattcagtcagaatgttcagatctcattatgttttactatgaatttctgaaaaaacaatatgccacgaagaagatacggaggcgaggaaccgagaagattaccaggtgggagtggagtttcagcacttgatgatgcatggatgaggcagcagaaggccaggagcaccactgccagatgaactgcaggaactctctccatcttgaagtacttttctactattcttctgcatccatgagggggtcatatggagcttcagaattgagctattttatagctcatttgtcatggagcatggagtcatagaggactctgaaacatcctccacaatcatgtgtttaggctagctgtagcccaatctctaatctgctataaaaattgactttttcttgaagtgcttcattagctcatatgatgggtttatttttatatctacaaaagtaggtgagcattttc

SEQ ID NO: 45711 - DNA, 1501 bp, Oryza sativa
  unsure (1)..(1501): unsure at all n locations
atacttagattgggacagtacgtaagatttggctgatttccgggtggctagtactgtctcaatcaatataagttttaccagatacttatgttgaacgaacgagtacgaccgcagtttctagaatagggacagacctagttattatgttaattagcaatatggcacctctgtatagtggttcttatttttaagtcctcgtgcaggaggcaactatagccgcgaagggaaactttaaccattaccatgtacaggtaaatggtttgtgatactcgagtataaactatatggtatatttctaaaccctgatcgagatgacgtggtgtcatacgatcagttccccttaaataccttgggaacgccagaactcctcttgctgctgttaacattacattcagagcatatgaggatatgagttcatggaacaggtgccacaattgttaatgacttaatactggaccatgactaaagccgatgattatcagcaagtcatggactgcgggtaaagcgtacatctgctacagtagaatatctttgaaactattcgaatagccgtactcatggagttgagtactgggactcatatggtaccctggttagaaatctaaagtttatatgttttataaattcttgctataacttttccagattgtctagtactgctttttgcaaagaaccctattatatgtcaatgcataacatattcccatgataacttgctgagtattgtaaatactcacccttgctcttataacccctttttcagatctgggtcaagaggaggacccttatgactattactacgaacatcccgataacttagagaatccctaaaggttatacctcactagtcagaatgtatagaaacttctgctgtgtattaattagttaggtgagtacctattattgtaaaacccttagtattgtaagactttttaacatatgcaatgaagaaccggttatattgtatgtatcaatatttactgatccagggattgattcattaatctcagtcggattcaagttattagttttgggctccgacaccatatgtgcctttttcctctataattattccatcgcaacacagggcttctcaggtctcagctacactggtggagaaactgtttgtagtctcggttggtaaccccctttagtcccggttgtccaaccgggactacgaatccgggactaaagataactatctttagtcccaggtgaaataaccgggactaaagatcgatatttattcccggttcgtgttaccaaccgggactaaagattgatcagccacgtggccggccaaaccatctttagtcccggtttgtgttaccaaccaggactaaagatcggtgcaccatttttttttatttgcaaggccctgtttgctgcatggttgattatatatatatatacatatatatgcataatatataggcatatatatatatatacatatgtctcnntncatatatatacatantatatagacatatatatatat

SEQ ID NO: 45712 - DNA, 1501 bp, Oryza sativa
ggaggagagagagagccggcaagacctcatcctggctgcgttgtttgcgggagagtgattggcatgatgaatcacacgaagaaagctagtaagcagcagtacaagatatttaataatttgatccttcccaagtcgggctcccattatttaatatatcttagcccgcttatggtcccatatatctgtttacatctaaatttggcacctaaaaataaaataggaaaaattgtcaaagtttgaaagtccgccggttttcttctaagagggttggtctgaccgccgtatgtcggccggtcagaccgctgctagtagactagtcagaccgacagtgtgtagtcagtcttaccggtagaatccgagtccagttctgtttttgtcgggactcgagtttccttgctcggaaagacatattttgggtttccattggtttttagcccgagttggacgtggaggagagcctgtagagggcaagaccaacccctatataagagacaagtccggttcattgtaaaaagacaatcaaccatcaatcaatcgaatcgttcttttacttttgcttctaattctagtttagtttgtccatctttgttgatttgcgctgtaaatcatccgccgtcgctgcgagagtgcgacacatctttgtaggtttatcctgaaaaccttccgttttgcccacgagacgggtagttatctatcgttctatctagatcggctccggtagccagtttagtttatcaaaacccatcttgatttagcttttgctagattgaggtggttggcgactctaggatcaccgcaaagctttaggtgctgtgatcgtgcttatcaaattgtcaaaaaagttaccaacaatatcatcctcacacgtgttagttaaagtaaattggaaactaaaaagtgtccaattattgaatttctccgtgtttcacatagctcgaacaaacaaaaaatatctacaatgattacttttttaatatataacgccattgaatttttaagatacgtctaatcattcatcttattaaaaaaatataattattatttattttattgtgatttgatttatcatcaaatgttcttgaagcataacttaaatatttttatatttacacaaacattttgaataagataaatgtttaaatgtttgtaaaaaagtcaacgacgccatatattaaaaaacgggggtagtataaggggtgttccgtactactgtggttaccggacccgggtaatttttaatacttggatgttttagcttatattaactatattgtattagttaaaaattaaagtattatatgtgttatgacaggttaaggaccctggataatttccgttctaggtttgccactgtgtagtactccctccgtcctaaaatataagaagttttggttggatagaacacatcctagtatgataaatctagactgacaatctatctaaatctgccatgtgtcccatcgattcaaaactatttatattttaggatggagagagagag

SEQ ID NO: 45713 - DNA, 1501 bp, Oryza sativa
attataacatttctagtaagttttttagtcaaagttgttatttgtttaattaactttctaggcgtgtttgttctactgtaatttttctgttctagtaatatctgaatctttgctttgatcgattcaattatatgttgcgtgtggtgaaggataaaagtattaatgcaatctgatgttctcatctagaacatttttgccagttcgttgatttcggtttgatttattggagacgactaggctgaagatttcgtgttaggcagcgtggagtgacctgtcacaaagctgaggctgacgaatggcgttacgatttccttctgatttgtgatctacactcttgattaactataagtagttgagaaatacaaggacctgatttttctttttttttaaaaaaaacatttgcttcaggtaaaatgcatctatttcaaatctaaattgtttagaatttttttttactttgaaaatagagtgcgtgtcacctaaacgatctcgtactttcatttctggtgatagaagtggaggagacttctctttttttaaaaaaaaaaatctcactaaatgatttacttacattacacgctagtgacatgaaacctttgtaaatcactaaatcttatgaaatccgataaaacctaaataatacctcgagaagcatcaccgatcattaaaaataactccctctataccataacatttaacgttggttagtttattttttaaccatcaccaacaaaaagaaccaaagaagtagtacaaggttaattttgacttcacgatattggatcaaacctagtgcaatgcaaaagcgaaggttctcgtcggtaaccctacagctttggctaatcagctaaattggccttttcaattcagcataatcagccataaaaaggtgtccacaaagatcaaatacactaccaatagctggtacttattcagcacaataagctaactgatgggcttgtgctaaatatcagcctcagccacagcaaaccgatgaggtccgaaaacatttaccagcataacataaattacttctcactcgaaatttagtcgaaaaagagaggaaattaaaatacaactcgagatttagtcgaaaagacaggaaattaaaaatacagtatacatttgattcgcttcgatccagcgtgtcacgcggaatccgcccgttgcctttgccggctgcgaaaaccacgagcgggtgtaacgccgtcaacccgagaccccgagaccatcgatcccgcgccgtccgatcctgatcgcgcggctcccgtgccgcacgacggcagacggccgccgtgctgtggccgttgcaccgcgtcggcttccgatttattgataataataatccagatttaatttaatattttattgtttaccacacagctgctcctcctcgggcttgactcgtctcgtctcgactccacgaacgaacgaaacacgccttcttccccaacgaccaaaccaaagtttgggtgaagaaaaaaaaatatcgccgcgtttt

SEQ ID NO: 45714 - DNA, 1501 bp, Oryza sativa
  unsure (1)..(1501): unsure at all n locations
agttaatataaagagtatattaaatctctcatcgtttctcatgtagtgtgcaaagcaggaccagggaactaacttatgcggctactacgtatgcgagtatgcccactgcctatcaaaccaaatatgcacaacacgagagctcgatgtacgtatacataaaccattcaaaatttcattgcgtatcgatttgttaagttgtttattaatttcatatattcatacgtcattatttttcgaacgatagcgtattcacatgagggataatctcccacacaaggattttatcacggctgttcaagaacaactgatgggattcatcaacgaagaagtccttaatctcgacggtgaattctactacgacggatcgacaattcataacgtcggtccttcctcttctgacataacaccggcgtcaaagtcgtagctatagctaccgagcaaatgaattgtactatatatgcatgtatatatatatttatatatgtacacatttacttttgtgttaatatatattttggtaacatatatatatgcacataaaatgttaagtgctttaaattatacatatgtctgtgtaatatatgatttatacatacacacacacacacacacacacacacacacacatatatatatatatatatatatatatatatatatatatatatatatatatatatatatatatatatatatatatatatatatatatatatatatgtctatatantatgtatatatatgnanngagacatatgtatatatatatatatgcctatatattatgcatatatatgtatatatatatataatcaaccatgcagcaaacagggccttgcaaataaaaaaaaatggtgcaccgatctttagtcctggttggtaacacaaaccgggactaaagatggtttggccggccacgtggctgatcaatctttagtcccggttggtaacacgaaccgggaataaatatcgatctttagtcccggttatttcacctgggactaaagatagttatctttagtcccggattcgtagtcccggttggacaaccgggactaaagggggttaccaaccgagactacaaacagtttctccaccagtgtagctgagacctgagaagccctgtgttgcgatggaataattatagaggaaaaaggcacatatggtgtcggagcccaaaactaataacttgaatccgactgagattaatgaatcaatccctggatcagtaaatattgatacatacaatataaccggttcttcattgcatatgttaaaaagtcttacaatactaagggttttacaataataggtactcacctaactaattaatacacagcagaagtttctatacattctgactagtgaggtataacctttagggattctctaagttatcgggatgttcgtagtaatagtcataagggtcctcctcttgacccagatctgaaaaaggggttataagagcaagggtgagtatttacaatactcagcaagttat

SEQ ID NO: 45715 - DNA, 1501 bp, Oryza sativa
aagatcatttgatgaaggatcaacgatgaagttcttcgcagatgaactatcaccaattccctgatccgtcttaaaccataggcttgggaggcaccaggaaatactccatctgcttgacaaatagctcgtgtttttcttggctcattctatcatggtagttactctccatcggagaagaacctgcacgaaaatcttcagatgatccaccgagtgcgaaaactgattgccatagtgttcatggcaaccgctcatttggcgaaattgtatctgtgattcttcacctgtgcatttcacgcatgtggtgaatttcaatgtgcttacgtttttatgttgttccaatatttttcttctcacactccatacacaaagatgaacatttctagttgctgcagagatatacttccattggctaaaaacaaattatacttagtttgcacccctagacatgcattcaaggtcatttctagttgatgcagagactaggggatatacttccatttgctaaaaataaattatatttagttgcaccctagacattcaagtccagctagagccataacttggtccataaattgcccatagcccaattctgccccttgtatttattgtgcctttacgttttggagcagggagccctgaaacaacactcaggtatagcaccatttttttacaaatcggtccttttggaaaacttatttcagaactagaccctgctaaaatacttcaaccataaataggccacgctggcgcggaggttagatggatcagcaccagggacgttggcgctgaccccatgctaatgcggcggctgagccgattccctcaccagcgtggcagggctcaacgccaattactctaatgctgagctcttggacttagccactcgcgacggggccgccaaacatagctcctgtgttgagtggtgtcacaccctgaagttctcctcctaagcctaaaattgaatttataaatcaccctaagaaaatgccggtgcaaatcaagagaaaaccttaataaattaatgcaaataataataggaattggcatgtggaatttttcttgagttctacatgtcgaaatacgctaacaagatttttagtggaattttcagagctctcaaaataattttaaccaattaaaattgagcacatgcaattttaatcccaggaaaaatcctttttccttctttttcctttttctttcttttcttttctctttttcctttgaatgggccgccggcccattcctcctttttctccccctcctcccgctgggccggccgaaggccaaggcccagctaggccgcgcgggccggtcggccgcctcctctcacccgggtcgccgacaggtggggcccacctatcggacccgtctcccacctcgcgccgcgccgccgcgcccacgcctccgcctcctccgggccacatcggccacgcccgcgcatgcgccgcaccttccgcgcccactcccctctctctcccacccgcgcctgcgcccgaga

SEQ ID NO: 45716 - DNA, 1501 bp, Oryza sativa
gagggcgctaatccgggcgcgacgcgcggcggcggcgagggtgaaaacggctggctcaggggtgaatggtttgaattgtgagaggagataccaccgtctatcttcaatctaaccgtgcggcaagaattggcgcgattcaccctgggtagaagcgaaatcgtactcggcggcagctttggacgggcgcgcacggcgtcgagcggcgatttcttgcggcggtcgtcgtcccggctttgtcgtcgtcaagattggtgcggcggcggtgggctgagggcgtcggacgggcgacggtgcgccaaggcggtcaggcacgcgcaagcggccctgaggccgacgcgcggcgacacggcgcgtggctaagtcggatgctcgggcggtgcgcgtgaaggggaggatgaggcaaagaaagccacggttttgagtgggttgtggtcccctaggaccaaatctagactttgcacaagattgggtaggagttgggctgctctagttgggctagacatttcatcgagcaccttgtgtgcgatgaacagtgaatttcagaatttttgaatatttcctataaaaagaatgaatttaatctatgaatttgaaagagtttcactagggtttgaagtatagcaaatcttcgatgaactaagaaaataatctatggtttgaaatttgagagaatttgctcaaattcactagggtttggaataaagggaattattagggtaaattagtagggctctaagaaataaatacttgaaccaatttaagaatcaaatagatttttaaaccaaacaaatttaatcaaaagccagcatgatgcagtcaaattttagtttaaaatttgaggatgttaaatatggttgccattaaaaatattacaccactaagttgtactccctccttttcacttataaaacactttaatttttctcattgtcaaacctttaaatttatttaagtttatagaaaattttagcaacatctaaaattctaaattagtttattaaatctaacattaaatatattttaatagtgcgcttgctttatattgaaaatattgctatgttttaaatataaatttagtagaacgtaaaaaaaagtttgactaaaatttttttaaagcgtcttctaatataaagcagagagagtaagaaccagagaaaataatattaattaatcaaacaatgcatgaccaactcttcagtctatttttttactttttttagaggaacttaccttttcagttatgtgaactcatcaatttccaccactctagaacgaggcagtccggcctagcacacctccaaacatgtaaaagcccttaccacccagcctaggctcgtgcaacccaggcagactaatagggctggctcgagtgggccggattgtagagtaggcccatccatgggcaaggcccagcacaggtctacggtgtctagcggcatgatcttgtgatatccttcatgatctcctatcctctcactacatgctctctctctctccatcc

SEQ ID NO: 45717 - DNA, 1501 bp, Oryza sativa
acctgtcataacacatataatactttaatttttaactaatacaatatagttaatataagctaaaacatccaagtattaaaaattacccgggtccggtaaccacagtagtacggaacaccccttatactacccccgttttttaatatatggcgtcgttgacttttttacaaacatttaaacatttatcttattcaaaatgtttgtgtaaatataaaaatatttaagttatgcttcaagaacatttgatgataaatcaaatcacaataaaataaataataattatatttttttaataagatgaatgattagacgtatcttaaaaattcaatggcgttatatattaaaaaagtaatcattgtagatattttttgtttgttcgagctatgtgaaacacggagaaattcaataattggacactttttagtttccaatttactttaactaacacgtgtgaggatgatattgttggtaacttttttgacaatttgataagcacgatcacagcacctaaagctttgcggtgatcctagagtcgccaaccacctcaatctagcaaaagctaaatcaagatgggttttgataaactaaactggctaccggagccgatctagatagaacgatagataactacccgtctcgtgggcaaaacggaaggttttcaggataaacctacaaagatgtgtcgcactctcgcagcgacggcggatgatttacagcgcaaatcaacaaagatggacaaactaaactagaattagaagcaaaagtaaaagaacgattcgattgattgatggttgattgtctttttacaatgaaccggacttgtctcttatataggggttggtcttgccctctacaggctctcctccacgtccaactcgggctaaaaaccaatggaaacccaaaatatgtctttccgagcaaggaaactcgagtcccgacaaaaacagaactggactcggattctaccggtaagactgactacacactgtcggtctgactagtctactagcagcggtctgaccggccgacatacggcggtcagaccaaccctcttagaagaaaaccggcggactttcaaactttgacaatttttcctattttatttttaggtgccaaatttagatgtaaacagatatatgggaccataagcgggctaagatatattaaataatgggagcccgacttgggaaggatcaaattattaaatatcttgtactgctgcttactagctttcttcgtgtgattcatcatgccaatcactctcccgcaaacaacgcagccaggatgaggtcttgccggctctctctctcctcctccttgcgcttgcgctgcccactcggcaggcgttttccaacaagcaaccgctccaacccacttcaatcaatacaagaaaattgcaataaccacaacatttgagtatttgagaaaccatttgtagtattagcccttgtactatactcctacatatttatatttgggttttgactaaaacgaatggtca

SEQ ID NO: 45718 - DNA, 881 bp, Oryza sativa
tgcacgcctcgttggcgaggttgaactgcgaccggcacaacacctgggcgctcgccgtcacggcgagcagcggaagcagaagcagcgccattgttagtgctgatctctccatgcttgctttgttcttgtcttcttgtctttgctgatgatccagtgagctaccagtcatcatatcaagcggcttaaatagccacggatcctactaaactgtctcgtgatttaatttcaagatgcatggaaaatggggtcaaggagaatcagtgttttttagtgtgattttcaagatggattcgaggagaatcagtgttgttttgtggatcgcaaatgcttgttggtagaagttaggaggagaggaagttttcctatgacattagattgaaatttcccatgcttttctttggctgtaatgacgttttgaagaagatttaattccatcttggaaacaagaacacgaaggctagtttcgaatgatattcagctttcaaggatggaagataagcattgctcgacacgtgaattatgtaatcaattgatcaatataatagttagtagtttagtaccaggttagtttgccttgctgctgcataatgtatctttggaggtcaaaagtaggtagattcagagacttaatttaattttggcgtggattaacaccaaatcaagtaattgtaaattcgctatggttccatttttcaagcatttttcagagtaggcatacaaagaatatgggaacattttcatttcccaagacaattttacaatggtgacaggagaaattttgtcgtgtggcaccatacatctcaattatgaagcttattttctagttagctttagcaagttatagatttttttcaccaaattgccatgaaacgcacgacaac

SEQ ID NO: 45719 - DNA, 1501 bp, Oryza sativa
ttgcaacgcatgggtattttttcagtctctactattataaaaattgaagatgtttctgtcggaattttggtacgtcattcgtattgagttagtttttaagttcgtacacttttggaaatacataaggagtcgtataagaaatcattttagtaaactcacatatcaactttacaatgatttttttctattcataaagaaaaaagatttggaatcgcaatgctactatacgcacccggaggaatattcggaattatattcttatataatccatttttgtgcggggtcttactaacaggacttcgctacacgagatgaggattcattgaaaagctaaggtcatccggtattttcataccctttgggggtggtatatggctttacaaaggacgagagtcggactcataattgctttagaattcttgccagataattagaaagcaacttactggatatgactatcatcccaataagattcccaaattagatatcaatactatcaaaataaaatcgcatatactttttagacaaaaaaaattctaacaataattgattaaaatagccttcacccgttgtaactcaagtatattttttatagtatagaaaaagtatgaattaccccctatggattcctaattgggtggatatgcgtcgctggaggcgaccatgaggagttggggtttcgttcctcaccttcgcctgaggagagatgccgtcattggggttaaatcactatcacgtagcaagagctgttgccattgggtttcatttccatcgtcggggagctgtgcagtggccaccgtggtattgatgagctcgcgaatcgcgcagctccgcggcacaaatctctctaccatcatacgattgagatggtgcagcacatcgatcggggcagcggcgattatgtaggggcagctgaggttgagcttgtcagtcgtgggtgttctgttctttgccatcgctcgctcacgatagcactgcagcattgggggagacgaagttcacgaaggataaaaaagacatttcgtgcaaaccttaattttatcaaacttgtcggaaacgtcaaataaaagaggatggagagagtattctgatgaaaaaattttttatagctgatttgttatgaaaatgtttctcttcgaacgtccgatcagataaaaaacgtcggacgcctacggcagctcactccgttacgtcatccatggatgcacgcatgcacaacatgcaagcaagcacatatatacggtcacaccgatgtgtaaatgaaacgtggtctttaaaattatttttcttcaaaactatttatccgatccaagctctaattatatcgaagtattcgttgtaattaaatcttcaaaacaagatatcacatgattatatttcgataacatatatttatatgtttcaaccattaaaactcgatgtttcactcggtgagaagagaatgtttcatttaaaattagactatgttgcacgtttaattttttttaatgttgcatatggt

SEQ ID NO: 45720 - DNA, 1501 bp, Oryza sativa
gaggacggccgtcgctgccgctcgtctgcctgtcgacgcgccaatccacccgccatcgtgctcctctcgcctttgccgccgctcgccatcgcgcctgctgtcacccgccccatcgcccccgcccaaggtcaagggcggtggatccgtcatcaccaaccctccgtagtgctgtcactgtcacccgcccaaccaccgcccgtccgtcgttagtagctgccgccaccggtcgtgcgggcgccaagcccaccgtcggctgccgagagagagagagagaggagaggaggaggttatagagagaggactgagaagtggtggagagggaagaggataagaagagaagtggtggagagagagagaggaccgagaagagaagataaggttgcctgtgaaaattttttgaagtggtggagagggaagaggagaagaggagaagtggtggagagagagaggaccgagaagagaagataaggctgcttgtgaaatttttttttgaagtagtggagagggaagatgagacaaatcagacttagcagacccttacgagacccgcattcaaaaatgattttcttatgcggacctcttaagggtccacatgcaaaatgagcatacggcccctaaagagacccgcatacaaaaatgaatttttgcgggcctattaaggagtcgtatgcggaaatgcctgctcgatttttacaggtgcgggttgttatggtctgtctgcaatctaacgaggatctcgttcagaaaaatcatttctgtagtggtgatattatgtgaagtattttgcccaaatgttagttttttttaatatgtgttgtcgtgcgtttcatggcaatttggtgaaaaaaatctataacttgctaaagctaactagaaaataagcttcataattgagatgtatggtgccacacgacaaaatttctcctgtcaccattgtaaaattgtcttgggaaatgaaaatgttcccatattctttgtatgcctactctgaaaaatgcttgaaaaatggaaccatagcgaatttacaattacttgatttggtgttaatccacgccaaaattaaattaagtctctgaatctacctacttttgacctccaaagatacattatgcagcagcaaggcaaactaacctggtactaaactactaactattatattgatcaattgattacataattcacgtgtcgagcaatgcttatcttccatccttgaaagctgaatatcattcgaaactagccttcgtgttcttgtttccaagatggaattaaatcttcttcaaaacgtcattacagccaaagaaaagcatgggaaatttcaatctaatgtcataggaaaacttcctctcctcctaacttctaccaacaagcatttgcgatccacaaaacaacactgattctcctcgaatccatcttgaaaatcacactaaaaaacactgattctccttgaccccattttccatgcatcttgaaattaaatcacgagacagtttagtaggatccg

SEQ ID NO: 45721 - DNA, 1017 bp, Oryza sativa
  unsure (1)..(1017): unsure at all n locations
agattagtcaaacttggaaccaggtaatttgaaaaaaaatcaaacgacttttaaacttgactggagagagcagaatataaacctttttacttatgaatctgaatatgtctatattccttgtaaaaatactactccctccatctctaaatgtttcacgccgttgactttttttanacatgtttgactgttcgtcttattcaaaaagtttaagtaattattaattcttttttctatcatttgattcattattaaatatatttttatgtatacatatggttttacatatttcacaaaagtttttgaataagacgaatggtcaaacatatttaacaaagttaacggtgttaaacatttagggaatgagggagtatatattttgggatagaggtagcatatccattccattataagtttttttatttatttagcaaacactaagattaaaaaaatcatttcagtcatctaaatggttaatttttttataaaaaagagtaaatttaagcatacctaggttttatggtcaaaattgcaaaaaagaaatcataggtattattacatgagccacttaaccccaaatattatggtttgaaagttttacaaaatgccaccttaagcattttgagcacaaaattaatatataaaatttttaatggtgaagttctttactaaggttgatagtttaattctttcctattttcaaaattttgtttaaaatatgctgacatttatcaagattttaattaaggtggggttttatacaacattgagacattatgtgtcatacatcatataagcattggttttctacaactttaaccataaaaacacgagattttccgaaattttttagttaaaagaaaatagaattgcttaaattcctccttgccagcacctgattggcgcaaattgtatgtattttgatgcatgcattgtaagaacctgtggcatataaatgtctatatcgtggtatgaattcccaattttatatgtctacaacgacaaaactttactttgggt

SEQ ID NO: 45722 - DNA, 1501 bp, Oryza sativa
atccaattcccatttattaagcttcataacaataaccaatgtctttttattgctatggacaattaggctattgtcgtcgcgttagacacttttaggttgtatttatgctctaattttggctaacgtgcttacattctcatttctaatatcctgccgaatctgaatgtatttatcaccacattttctgtactacttgttttgggctattgttgtggaacaatgataacgactgtgtttagttcctgaaattggggagaagtttggggaaagttggtagtttgaaaaaaaagttaggagtttatgtgtgtagaaagttttggatgtgatgtgatggaaagttgggagttggggggaagtttgatgtgaactaaacagggccaacatctacccgtcaatcataatatctctctcttttttttatctccatggtttggttcccacattgaaactagctgtaatttgtaaatatccattgcaaaagtgcatgaaagcgtaatttggccagtagttcaagcacaagaaacttgccttcatcatgatcaaccaactgaggaaaaagctacacataaagaaaatgttactgaatttttacaaacacagatgtggcacactatgattgaatcttgattttctataacttccaagaattttgttggtaagatttttttttagtatgtatagcactgctcatcatctatttcgtcttagttctccttttcatgcatatattcttttgctaaccatagctccgtatgcttgagacttgttctctgaagtcactttgaaagagaaaggttatatacaatgcacaaatggacaaatccaagacgatagagtttcctttattagaaacatagttgacaagaaaccttcttgagatagagactgtttaggaattatgacaagagtaaccactaaacacaggatcgtgcagttgggtccattctcctttaccctgtgatcctgtcatatgacgggggagtgagctcactatggatgatagatttgaagttatttatctgttatatgtgctgtaatgattttcgcataaagagtagatattaaaaattattgcccatagtaagttgctgacagagtagcaataatattaaatattcaaaacatcaattcagttgacaattggtatcatttaaggagcttacgttacatgatatttgataatcaaaatatgtatgatgcttagtttcatattcagatatccaccatgattcagaattgcttcgccttttaagtttatcagtgagttaaaattgacctatgtttacatgtgcactttcagattattctgaatcttgttgctgttcatgctttccgcacatttatttcccatagcagtgcaattcctaccatgatgtacttctatttccgtgatgcttatttttgttctgtgcaggtctcttgacaaaagatctcaggaaaaggctccaaagaaaactcataaagctgaacgagagaaacttaagcgtgaccagttgaatga

SEQ ID NO: 45723 - DNA, 243 bp, Oryza sativa
ccccgcgctgacaccgccgtcgtctctcgccgtcgcttggcggtcctcgccgcctccgccgcagactccgccgccgcatctcttgggtgagagccaccgctgcctctctctctctcgatctcgatctcgatatatctctctctccacggccaacgaccgacttcgacgcggccgccgccgccgacggcgccaccgccactgccactccgccgcccccgcctcgagctcgccacgccgccgcga

SEQ ID NO: 45724 - DNA, 1437 bp, Oryza sativa
agaacgtgctacgttagccttacgttctgcacgcgcgacgaaacaacgactacatatacgtagacctctttcactgagtgatcgccctgcaccagaagatctgcgccacaaaaacagccgtgagtgccatgagtccatcgatgtggatccatccaaactcttgagtccccaaacatatactgctccggtgcaatttatgaattaagatttggttcaaactttgatctgcaaactacttttgctgttttttttaagaaaaatgccgttcaaacttccatgttgtttcggttctgatatgaaacgacatcaactaattaagggctcatcttagccatcggatgacccctaagttcacttgcaccagggtagatatgatttaacatggcactctataaacactcataagtcgaggaatcctatagtatcaatattatagcccgtgcaatgtaaatttgaagaatgggctagccaaaaaataaatatattattatatattatatactaaaggtccattaaactttctacaaacgctctcaaaccggcacgtgggattcctacaaaagcttctaaaccgccacgtgacgctctaataatttctgagaaaaaaagaaaaatatctagctgttatttttaagtaaaacaggagacccggtaatactaaccattacattaaatccaccgatccgatcacccttttctcttggagctacaggtacgtataaaacgtacgaaccaccacatctgctcctcccactcagtattctctctcttcttctattatcgtattaagggtatgcaccataatttgttactataaaaattattagatctatttttacatggaactttaatttatatatgaatgatcttggcgacataaataaataatgacttttttaagccaatctacacattcaatttatgacacgcttaagcgaagccatccttgacaaatcatttatgatagctctcatactaacgaacggatcaaaacgttgaatgtttgagatatgtctgtacggataatccatctaagaagtaagatcatctatgacaagagtagtgttgatgaatcacgcatatgacctaactgatgatgagtctccgatctcctcacttgctctattaggtttctagctcaagagttaaaaaaaatcaatgattagatggctttatattttttaacatatttgattttttttgtttgatccatattgaccatgttttggtacataatattatacattaaaagtcatgaaactttctacaaacgcttctaagctgccacgtataacctataaatgctcctaagccaccacgtggcactctgataaattagagaaattcttaaaatctcttagaaaaaggcaaaaactattgaatttcatttaatccggtggacccaatatttttaaccattagatcaatctctaaaag

SEQ ID NO: 45725 - DNA, 1501 bp, Oryza sativa
agcctgtcacgtttttctgttgtttcctagcgatgcaacacatgtcgttcaccatccgttagcaatcttatacgaggatcgatatcgtacataaaaaacgtacgcatagcattttcatttaatcatatgcatgccatgtcgatatggactggatatggtgacaaggaatcgaggagatcgccgccggctggcctgcatccctgcccctacgtttgtgtcgtgcaaacaagccgttcaatcaaacttaacgacttgttggtgacatttctctaatgtgagaaatgtcatgccatcatgttatttttcacaattaatacacgccaaaaacatgcatgttgttcttggacaaactatagaagagccgtataaatataaacctaattgcatagatgagtcattactatcgaaattggttggttgttaatgtataactctaactgagattaatagtcctgattttttagggaacgaggtgtacgaagtcgatgaaacatgatcttgagcatgcaagtgacatgttggtggaagctgaaattaagaagacaatagttttgaaggaaacaactttagttccttccattagttagaatttaatttgttgttttctatactctataataggtgttgaatttgaatttgcatgtttgtaagttccccgttttaatcaaaagttttaatcttttttcataactaattgcatgacatcctctaaataggacatagacaatcccacaataaataaacaatctaaaatagtttgtttgctatacatatatgatatatccacatgttttctgcccttgcatcacagcctctaaataggacatagacaatcccacaataaataaacaatctaacatagtttgtttgctatacatatatgatatatcacataatttccgggcagaagaagtccaatttttatccgttggatttggtccaaatgtgttatgagacttttgatgtcttccaactagtttaactaaatatctatgacacactaaactgcataaagcaaaatagttgaaacactttgtagataactaaaccatcaaaatagttctaaaaaaatataaaaacttttttaaaaaaagggtaaaaaatggttcgttttttaccactcagattatttttccataaatcggatttcaaaacatttgcatttttcaagcttaattttatcgagcaaacactcccctttttttccatagactcctcttctctgttcgtgaatccaagatccgcttctttctcctgcggttgctctgcgctctcagcaccaaccaaatccccctccaattcctcatctttcttgaccaattcttgaaatcaatcagacgcaataatcaaccactattcttattatagttggatcataattaatcaaggttccgtgcgtcgccactgtgatttgtgcacttgcatttgatcgaattcgttgccgttgattgcgtttcttgatgttgtgtgttgcaggtttgaggtggatccatggcgatca

SEQ ID NO: 45726 - DNA, 359 bp, Oryza sativa
cgaatgcgcgggctaccttcctagtttatttaaattgtgattagttttagcatatatgaaatactatcaaggaactcagtttaaaattttatatccaccatggtttaaaatttgaagtatagtcatactcaatatatataggagtagagttttgtgaaacttgataattataataatatctgagaaaaggttaaaataactaggttttatgatactttgttttttaaaaaaaaaaaagaagtaggagctcaagtggccgttcccaaattgatttctcgcctccactcgtttgtgggggtgatccagtcgcgcgctcctccttccacgcgccaaaaccccagccaccaccaccatctccc

SEQ ID NO: 45727 - DNA, 1501 bp, Oryza sativa
gatctgcacataatcccaccaagaaaccgttttcttctctttcttttcccccacatcaagaacaagaagccagcatgattagttaaccaggaggggggctgacctcacttggggcatggggaggggggttcacccccgaacccccaaaatctttctttcttggaccctcaaccaacccagccacccgatccggcaggtgtggaaggggaaggaagccagtcaggcggggtcagcaagaagaggaggagaaggcgacgccgccgcctaccaccaccaacaccaccaacaccagcttgagctgcagatttgtaagaaggaggaaggagaggggagggagacgaagaccgagagggaggggagggtggaaagtggaaaaggtgggggaagaaggcgagcacgcggcgagcgtgtggcggccacccacccgcacacttgggtgatccggacgccagcgagctgacacatggcgacgacgacgacgaatcccgtcgccatcggtcccacggggaattcgcggatcgagaacaaaagctgagctcccgttggattgggatgatggatcatggatgggatggcggaggaggattgggatgatgacaactttctttgcttgcttcttcgtcacctctcttggtgataaaaattcgatctttattcgttctgtccttgctgtaaattgttgatgccattcttctttttttactacttcctcagtttaggttatacatctatgtaagtaaatatgagcattgctagtaagaaaacttgaaacagagatagtactacctttatcggtagtatattatttatgggttaaatccgatttatcttcttaactattcaaaagtttaaattatccttttaacttttatattatacattttacaccacataattatttaattcgaacaaattaccccttttctagctattaggtggttttggctctcatatgtatgtgcaaagccaaaaccaaatgtgagactagtcacctccttcctcgtgcatctaccctcctcactcgatcgtgcaaagcaaacctcaccaaccacctccaactctaaggcaatgtttggctaatgggaaatggaaatgatttcccacccaccaaaaggcatctttaaatactaaccattcattctccctctttcatttaatcctaacccttcattcatttcccaatcccaatcccaccctctattttccattatccaaacacactctaagttcttaaagaaaaaaaaaactccaaaactagctacacacgggccatccagccccatcatttggtatattggagtaaaaagcaaaacaacatatttatcgaatgaaaaataatttgtgaatataacttttatatacgtgttcttaataacgatttaaaaacaaatgaaaaaaaataaactacgataaaaataccttaaaatcgactctaaatttacggttgaaaattcacgaagccgccaccgccgtttcgcatctcatcctgaagctggtgctg

SEQ ID NO: 45728 - DNA, 362 bp, Oryza sativa
ttttgtatatgcatggtactgttcatctagattaaaatattgtggctagattaccattgtgattagcctaatgacctacttggcttagttatttatgccttgtttgatatctagcatgatagaatttatgagtttttcttgtcctatcatgtcgcaagtaggttatgcttgctgtatatgctttcaaataataatgcttggaataaaattaatggctaagtatgtattatttccaacattccagaaacctttagaaccattggtcatggctgctcatgctgttgatctgatgaggcctgagaagtttgctggtgaaaactttaagcgttggcaatccaaagttcgtcattatctggtgtcgc

SEQ ID NO: 45729 - DNA, 1501 bp, Oryza sativa
aggagatcatcttggccccaaataagcaggctttggagtcagcgagtcagagtaaagataagatgatccacgctaatcccaagaccttgccagcgacgggggctagcgacacctactcaactgggccgggtgcatacacagaaggagatgtggaggaggaggatgatgaagcggtggaggtactgctagaagatgatgaagtacaactagctgggcagtggacagttttgtcgagattctactcgcttcgatcacccaatcaagcggctctatttgatgacatgaagcgtgcatggagattgcgagctaacatgaaggtcaagtccctgagagataacatgtttatcatcaccttcagctcggaaggggattacaactttgtgctccagggcggtccatggcttcaccgtggagacgctctgcttgttgcaaaattcgatggcctgacgagcccgtccatggttccccttgagtttgtgccaatctgggtcaggatttatgacctccccttggtgcttatgacaaagaggaggggagaactgtatggcagcaaacttggacatgtgagggaagtagatgttggtgaagatggcagaaacaagcatgacttcttccggatcctggttgatttatcagtcaagaagccgctgaaaacctcgcttgctataaaattaatgtgcagggaagtgaagctgtctgacgtttcgagctacgatatgagagggtgccctttttctactttatttgtggttacatcgggcactctgataaagactgtgacaaaagaattgccaatattgatcaaccttttcgttactcagctgagctacgttgttctccgctgaagccttttgagagaagaatgagcacaatccatggccaacaaaagtcaggagtggcacgcaatctggccttccgtggagcagggagtgcaagctcgtcatcctccaaacaggggaaaggtaaaagcagggaggagattattcctgacagggtcgatgctcaggatggctttgagggaagagaagatgtgggggacggggtggtggatgaactgctagctagtcagactagcaatctgaacatgtcaggtgagaatatggtgcagaaaggagaaccggtgggtatggaggaggaacaacgccatcagctgtcaacatctaaccttgtttctgatactgatatgattctagcaatacagaacctgcagcaaccggcatcctttggaggagagtcttccgaggacatcagtgataccaaccggaaaagagtgcaaccacagagcgggagcaagatatccgacagagttcaacaggccttagtattgtatggtcaaggatctggtagagaacaggctaagcaggtggacccaaaggagccagcgagagctctcaaacggtttcggaagacggaggtggaaagtatggaagttttggaagcaaccagtcctggggctactggtaaactgacgggacccgctctcagggcccgtcaggagcaa

SEQ ID NO: 45730 - DNA, 431 bp, Oryza sativa
atttgaaatttatttacgaagtggttttggagatgattggaatttgcaagtgaataggaactgctgcttttgatgtggtccggtcagaccgggcatgtgctgccggtcagaccggcgtgtattacgcagtcagaccagcgcgggcgactctgtgtcggttttggtttcaggttgtttatttggaaatccatgattgtttcatgattatggcttctagatggatactatgcatatgtaatactgtagtttgctaccaatgaatcaagttggagatagcttggtctcggaatatggtttctttgtttgtttcacgtgtaggtgacttgatgcctcgggatagtattgccggtgatggatcgggagtcgactggatggtaaggcgatgtccgtgatggtcagatatcatgcggaatacttaggcttgagttcaa

SEQ ID NO: 45731 - DNA, 1501 bp, Oryza sativa
acttattgctctccgctaaattcctccactaccttgcagtcgactgatcacttattgagctttacagtgtgacaacttgtatatatctactaattcgtatacattgagcctttcatgcatgtttcttataattgaactcatcaccatctgtttaatctgctatcccttggaactaaattttaataaataattttatattattgatgaggacatcactgtctcggatataaccatgcttatgttaaggtttacttaacaatataaaagtgcatataatctatataaggtttacttattatatgtttgaacaaacttactacaccatgagttttgtatcttctcatttacaaaaatacttgtgtgggtgaagcaaagaagatcagcctcacgaagtacttggatgatcaaagaagttgattggagatcaaaccaagattttccccaagtctactcctatatcaccatatcacttttggtctatagaagtcaaaagattaagttttacacgttttggatttagattcgggtctcctaaaagtatcaacttcaaatggacctagccattaatctgaaaagaatcttgagttccatgagtactagttggaaagtttatggagtttactttccaatggttttggtctcatatcaaaatttctcctcagctgtcgagaatccgcaaaacaagccacatacctcatccagttcgagtctgatttggacattcaaccctataattgtgtcgtggctaagcctaaggagtgaataccctagggctaatcctacgatgtccctaattatatttattcagtagcctgtcatcgtttagagtcgggttttccttagattatttatacaattgcagtttcactgttagtttggttcgtggaacccgaactttgagatcttaatcattcatctacatattgagttgcaatctgacttgtttctgctagtgttctttgattcgcatgctgaaattaaccttctcggcaaggccaactaggcagtgcacagttgatagagaagacatgatgctacgattgcaggatttggatcgtgttgatcggaagccggattgtgtgtatcaagttttcccaaatcgagagttatcaatacctatcaaaagatcgagacctagttactcatcagttaatctccctcattgatactaattatatgattatcacttatgcatgcaaacattactctaacatgcactaattaaccctaaagcatgctaattatcactcatcaaagctaatttgtcacttgatacccttatcaatccttcttcttgtaccttcactaggcatatttctcagtacaaaatctaaggggaatatttctcaagttctccaaacagtggccacgcaccatctatgtttcatcctaccacccaaacgtatggatgagacctgctctgtccccagctggtgccatgaaccaaatcataacttagataggctgggttggcatataaactatgcattttaactgtagt

SEQ ID NO: 45732 - DNA, 157 bp, Oryza sativa
agagagagagggaaaagtggggggaaagggagagggaatcacggggagtgatttccccctctttattgcgcgcggggacgccgggatgcggcggaatccgcggcgtcggcggcgctagggcacggactaggcggcgggttcggcgcgaggacaggga

SEQ ID NO: 45733 - DNA, 1501 bp, Oryza sativa
gtcgtcctctacgtgttcatgtcctccaaatccgcagcgggtcgctctatctcgggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagctcacgatggttaatcgtgattggctaattaattacttgccaactaaaacttgataatggtgggttgtgagcacatggttttgagagtcgtgctcatgacaattaaggaccggttcacgagctactgttgtgaaacattaaccgtaccaaccacaagccagcgtgggcaacggctttacctgttgtatagcatggttcattatggagcaccagactgagaagtggcgagataagcccatgggggtcactggggagtccatgccttgtttataagggggtgattatgatccaggaacggtgcgctgtggtggattgtgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgcttttgcaaatgagcctatattatgccatcctttggaatccttgtgcacttgcatatttgctgtgtggcttgttgagtatgtcatatgctcatttttgcaataatcaatcaacctcag

SEQ ID NO: 45734 - DNA, 333 bp, Oryza sativa
gtcgtttggcacgagggtgagtatcgttgggttcgtctcgtcgtcctctacgtgttcatgtcctccaaatccgcagcgggtcgctctatctcgggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagc

SEQ ID NO: 45735 - DNA, 1389 bp, Oryza sativa
cgcccggccagagggcggcaaggggccgcctgcaaaatggccgacccagactggcttttttgcattcgggccccttgctgccccaacagagggcggcaagggctttactgcaaaaaaccctccctccgtcaccgcccatccctcccccgtttgccacgtcagcttgccaccctagaggtgggcggcagggtctatttttgcaatttttttagccgatagattatttctgtaaatattttttaaaaaaaatctaaaaatgaaaaaaattccttgagtgaaagcaatgcaaaacacattaagcccgttaccagcccattggttaatatccttgcaaagtgaccacgggaaggcctcggtagtggcagctgtcctggtttagatttattggttgtgagtatgttaagttgtggttttagttttgttgattaactatgtatggtttgtctcattcctctttaaaatgaggtatataaaatacaatgttaacggcttggtctgtatgggtaaaaaaggtattaccaattaccatatagctacactaaacaagctaaaaaggatagattacagtactgcaatttatttttgaaaacaaatacaaaagtgcaattttggaaaagaaaattgaggtaacatttttttaaaaagtataaggtatcatactttgcatttaaacaaccatccccttgagatatactctgttctttcataggtatattaaaggatggaggtagccttttgaatttattggtttcatatacagggagaaagagtatgtttctagacgagagggggtgattgtgatatttttttttatatgctctcatgagctcaaattaacttgacagattttctattcagtctcccctcatcaatccccaaacatgaaacaaatataggtgagaactgacactgcgtgccactgatggtaatgaataattaacatactgcagagtggtaatatatataagtattttcatacggttacctgcaatgcaacacagattcccctagatcaccaattgctgtggcgacctgacagacatatacatgtttagttcagcacgacaacaattggtaattaagttatattatcattgttccattagccttgaccacattttaatcatgcctaatttaagagggatcatggacatccatcaagcaaacgaacggatctttcttgaatgcttgatacctacgacaggcatggtcctaaacctacataaaaatattgtttcaattctctagtgattactcacataggaccagctaagcaataatctcctactaattttttcatgcatggtcccttgcctgtctaattgtctatctatctactatcaattaatccccctcaaatgctgacaagcatatctgcatatgcacagg

SEQ ID NO: 45736 - DNA, 1501 bp, Oryza sativa; identical to SEQ ID NO: 45731

SEQ ID NO: 45737 - DNA, 1501 bp, Oryza sativa
aatttaaggttgaaaatttaaattttagctaataggtataagcataagtgaaaagatgaggcctttcgtatcaaaatatatccaatgttaaatttaatgaaactaatttagtatcgtagatattgctaacttttgctataaactttgtcaaacctaaagaattttgactaagaaaaaaatcaaatgacttataatatgaaacggtggaagtaatctctttaaaagtatgttaataacattaaatatttatcttatattagaagaatgcccgtgcgttgcaacaggtgaacactattttaatcttattattgttatatggtttagttaagatgtaatttactataggaatttgattagatatatttttttagaaaattatgagctacaattaggagtcctttctatatttaaaaaatgaacgaacttaaaaatctactcaaatacggatatgtatttccaaaagcgaacgaaattaaaactaactcatacatggatgacgtaccaaagtaccgacacaaacatctttaatttttataatagtaaaaaatatatgtaatgaaattataatcaaagatatattctagcaaccgtgttgctgtctaaaatatcgagaaattatatatgtaatcggagggagtactatcacatcatcaatgatctctatgtgtgtgtactgtagagaactagacagagatgtggatgcatgcatgatggatggatgggtggctctagttaagctctagctaggtacattgttggtagatggcagtgagccatcgatcgagtgagtgatgcgtcacatagctagcttcctttcgatctgatgcatgtgtacgtgctctccagcgatggagatcgatggagctatatgtgcttaatttggagcctattggttgtaccatgcatgcatgcagatgctggcagtatatagtcttcagggatgcaggtcctctgcagtactgcacagaggatctcaattgagtctttagatacatgtttgcctgcgtgtactgtggtctgtggagaggatgtgtgaagaagcctcccatgcaattgagctcgaaattctagtgtttcatcaaccattttgtaaaaaagtactactccctccgtttttttatacaagaatccattaacttttaagatacatttgaccattcattttactcaaaatatttatgtaattatttttttattgcgacttgatttattgtctaatgtatttttaagtatgacttaattttttttatattcacacaaaaagttgaataagacaaatatttaaacgtttatccaaaagtcaacgacgtcatatatttaaaaatggatgtagtagtagctactctctccgttccataatattataacctaggactggacgggatgtttcatatagtacaatgaatctcattgcactatgaaacgtctcatccagtcataggttttaatattataggacggagggagtagctacttagctagttaggtttcagaatgcatg

SEQ ID NO: 45738 - DNA, 1501 bp, Oryza sativa
atatacctgttcaactgaataatcgctgaatgaaccagcaacaataatcatgcctgttctgtcttttggtttcttcaagtactcactcaattaaccaagatattaattaatcgcctcagatattaatcatccggtggaaatcgaagggtcagattaaaaatcgcctgcttttttcggacgcatccagtcggttcacaccatatcatttctctgaagaactagtatatggataagatcgtattgatccagttcgttatggtaggatagaattattttccatctctatctcttcaagtttacttaagttccaatcgtccctaaggcttattcgcagtatctctctccctatactatctaacactggagcataacagcagcatatatacatgctttccggcgtggtctgatttgccatgaacagctgctgcgttctttgtgtgatggatctgcctaagtttgtggcgaatttgataggtttcttccgcaggtatgcgtcgaattttctctggttcgttgctgtaaattagattcaaaccacttttgccaatcaggtttttgttgttcattatttggcaaaaagtttttgctcaaaaagtttgacagaaagaaaaagaattgccatgcaatgcaggtgcgtctcttctgattgtgatgttcaacgagttacagtgagttgaattactgctaattttgtttggaaggcaagaattattttacaagatcttctataatgtacatgtaaaaatcatagaatttttttcttcttcaaaatatttttttcactcaattttacatgaatataccgtttacacgattctatctgaattacacgattttacatgagtatagccatgccattcggtggcggcaaggtgctcatcgcgaattcaacaggcaatatagcaatatgaatgtattcttgcaaaattgtgtgaaaaaatatatattgaataaaaatctgataaataaagttcttcaagaacaaaaacttccgaaatttttctagtgcttaaatttatttacttgccaattgggatcttggagaagggagttggtgaagggattggtcattggtgtttaacttttactcccaatctcttctctttttttttaaatttttaaaacacaatacaaatacagacgctaacaacgcagttacacccaccccctatgaacgaacacacaccctatctctattagagtacggatgtagataaatctaattcgaagtgatgatgtacggtaagatttaggcaaaatttgctacaggacacgcaaaaaacgcgtaattagctgagggacaccgagaaaacgtgaaactgcccgaggacactgcaaaaattgtgtaattgggcatatgacactggtcgcattattttattatttccaggtcaaaagaggtgagatacttttctaaatgcacggattgccccttctctttccttctttccctttcccgttgactttaccgggaacgcgtgatgcggcgaggtcggcgcga

SEQ ID NO: 45739 - DNA, 1501 bp, Oryza sativa
ccaacctctttgaaccgggactaaaaatgatctttattcccggttggtgttaccaaccgggactaaagatcaaaatttttttaaccggaactaaaaatgatctttagtcccggttttattgcaaccgagactattgtgaaatttagtcgaccgaccaaatatgatttctccaccagtggtagcaagtatacaccgtatactccgtggacatggtaccggagatagaggtggatgatatgatattaatgttaatttcatgggatttaattactggtaagacatgctgataatgaccacaatatgttcagcccctcgtagatccttaatcagacattttcaacgacacgaattggttaaactttcgagtgatggccaaccgccgcttagtgcagtcgagtaggtaagtgaaaccatgactatcaatatcgctgcttgagtttaccagagatgaaagattaaacacgcattagtgtaattaagttttaattatattaaacataaaaatagatttatatgatagtttagtaattgttacataaaatgttttcacacaaagtacacagttttgtagtttaaaaaatggtaaaaaaaccaaaataaaatctatatcttaataaaaaacagagcagaagccttgtgttcacttcttcaacttgtgacaccacattttagattgccacacctccttagcgttgtatttgatggcttgccatacgttctgagcacctagcctcacgtatcataaacttaattatttacctaactctaccacaagtatacaagtatagcttgtaatttataggcctaaaaaatataacatgccacacttacctaaagtgaatcctgacaatgttagttagggtgtgtttagttcacgctaaaatttaaagtttggttgaaaatggaacgatatgacggaaaagttaaaagtttgtgtgtaggaaagttttgatgtgattaaaaagttagaagtttgaagtaaaatttttgaactaaactcggccttaaaaacaaagagcactatttgctattttgttccttttgtgtaactttatttcaactttcttttaaagtagtactagcccaacttcaacttcaccttcccaaactgttaaactgtgtaattttttttaaaaaaatccatatagaagttgtttaagaaaaaataaataaatatattttcataactaacacttaattaattaattatatgttaataaacttcttcatttttacatgaagtggaaatatttcttcctaagcatgcatgaaaatcgaacgagtccttaataaagttccccaaaatgccctcacgcttcccctccctctaccccacccacagagccacttcccggtgggtcccacacccccacctctcataactgcatcagaaaaatgggagggcgtgcgcgggtcccacctccccatgtgtccctccctccccgcacgccacgccatacaaagcctcgccattcccccccaaccatctctcctccatctc

SEQ ID NO: 45740 - DNA, 546 bp, Oryza sativa
atctctacccctgtctctctatgtaaaggtttgtatacatacgagcactactatagaaaacccttttggtgccggttgccagccctacataggtgccggatttgacaaccggcacctcgcaggcggcacttatgagtattgtcaatggtgccggttcaaaaaccggcacctttgagttgtatggatcgcaagaaaaaaaatacggcttggctcgtgtcggagccgggaactaacaacttggatccgactatgattaatgtatcaatccctggatcagtaaatattgatacatacaatatatctggttcttcattgcatatgttaaagttttacaatactaagggttttacattaataggtactcacctaactaattaatacacagcggaagtttctatacattctaactgggaggtataacctttagggattctctaagttatcggggtcatcgtagtaatagtcataagggtcatcctcttgacccaaatctgaaaaagaggttataagagcaaggatgagtattcacaatacttagcaagttat

SEQ ID NO: 45741 - DNA, 1501 bp, Oryza sativa
tgagggactcaatgtggactttttcctgcaaggagttcctacatgcaattgcaatgcaaaataggccacccacaacccggcccattgataacaatgtcgcctggtgtccaagatgagggacagaggcctctttctccgatgactcgaccaaaacaatcacagatatgctaaacaatgcatacatatgtacacctcaagaacaataatcacagatatgtagaagaatactgacgtggcacaattagttgataaataatctgcacaaccaccaccaccaccaccaccatcaaccagaggacctgagctgttatttatctacaattttcaccagcctgaattctgcaggctcacacaatcaaaaaaaaagcctcagtcattttcaccagcaactctgcaggaacagcaaaatcacagcctctgctctacacctgccaagagaatggcattgcttgggaaggatcttcatatgtgacagcaggaaccaagacatggtcaccggcaactgatcctccatctgatgcgaatgcggtggttacggcttgcgacgaggcggcgattctgctgaaagaagagggggcgaactgcggtggagctgttgcgctggagatgccggcagcgggggagggatgcagcgacgatgacagaagagagagagcacactccgggtccagcccgtgggggacgccgttgcatgcgctgcgggttgtggtaatgttggctccatcttctggggaagagaagggccgcaggagatcgtggcgcgctgcgccgaggccgctcccgccatcttgcataaaggggaactgcttcggttcccggaaggtccctgagaatgagatggagaagggagggtgacgatcaagcggacgcattaaggcgtcggcgttctgatcagctatcggaaatgtttgcgggtagactgaaaactgattcgctgcaaagacaaaatagttttagtcaagagaatatattggatacatttcttgtgcaagcaattcaagaaaaagttgatagctctagtgaatgaacatgagaaaaatcttagtttaatagaggtccatcgaaatctactcatcttgacttagtattattgtgctatggtttactagaaattttctaataagctaatggggaaagactgagcatgattgggttccatttgacatcgattattttcagcttctaacaacctaacaagcatatcgaagcaatgttcaattcttcaagcacagtaagcatgcctttttctgccagacctaaaagatacataatatgtacattatttcctgtgacaatataagtaggtaaagatgtagtttgttataactgcagacagagaatgaacagctaaccaattctacatacagtaacggtaatacagtatcgaaatgtaatcaagaaacagccaggaaaaggatcactacaatttttcaacatatataactcagtagttgcaatgtacaaaccttgatgatacggaaggaaactcctagggttcaat

SEQ ID NO: 45742 - DNA, 1501 bp, Oryza sativa
cttaccaccaaaccttggggtggtaggattcaatctcacgatcggatgcttaccatgtacaacgcttagccaattgagcatggaggagaatttggctgtatagataaaataatatttacattgtaatataaaactacagtcctatataactaaaattacatttgtaaattcagttaatataacatataagtgcactataattttgataaaaataatctgtaagtaaatatgtatttattattttcttttgtagtccgttggatgtaaatgtaatggtagaaaaaatctgattgatttctaacattcgacaaatggattgattttagaatatccttagtattttaaccagcaaatattggacatgtgtattgatggatattctactaaaatatttgtagataataatacaataaatgcattagccttgtcaatatatacctcttaactttaatttttttaaaaaaactagatgaactagaataatttacttaaaaactctagtacaaacgactgacaatctgaaatagctgacacagatgtagtcaacttcttttagtggtcacacacaagactcatcacataaatgatgaattatgaagagttcatataactcgatcgagaggggaacaactaaagtgaaagtcgatgcattgttacatccgattgcaaactgacaggacaaacaaactaccaatatcaatcactcaagatagtacccatattgaagacgacaaaatagcacgattgatccaccatctttccacgtatgtaagattcatgcaactaaaatgccacaatcgaaactaaaacggcacatatactacgtaaatttaaacaaaaacgaataatatcgcacatagcaaagcataacagagtgtcctagttacacgactaattaatcttagatatatatatatatatatatatatatatatatatgcgagataacattgtacatgtgtaaccttaatgaaagatagtgacgtatccatataagtgtattttattatattcgatatatatatatatacataacaaacacatgcgcgcgagatacatatagcaccaccgtacccctctaataaaataaaaccaacaccatcaatccatcaattgccaagagcaaaaacaaacccacaccatgaccaatcaaacaaacttccatagaggatcatcctccctttgctatccccacaaccccatttgccctctcctctacttattccctcactccaaaaggccatatatacaccccctccccactgccattggtcctaccacaacaaaaggagagagactccaagtcttccaagctgagtgtgtgtgtgaaagagagagacctacttagtacaagaatcacatctgcatatcttccctgcaaccgtgtgaagaaggatcacaactcattcttctcttctgtcagtagagagagagagagagagagagagatcaagaactagagagagaaaggtaggtagctagagagagagtaggcgatcga

SEQ ID NO: 45743 - DNA, 261 bp, Oryza sativa
tatatgatagagagaaagtaattacgtaagaaaaaacgtggcaccgtatttttcacaataatgggaaaatttagacaaaatttgctctaggacattctagatttgtgacatttgttctaaattttataaattgcaatttttttaattcttttttgcacggttcatggtatctcgattttttaacctagtagagtaatttctcatatattgaacgtaaattttgccaaaaataattatggtgcgtgaccttgtcggtgagga

SEQ ID NO: 45744 - DNA, 1501 bp, Oryza sativa
ccggcggtgaagtcgtagacgcccaacagcggcagcataatagaccagccgtgtaggcggagcaccactcggcggcgacggaggcaggctggcggtgaagtcgtagacgcccaacagcggcggcataatagaccagccgtgtaggcagagacaccagtcggcggcggcgaaggccagctggcggtgaagtcgtagacgcccaacagcggcagcataatagaccagccgtgtaggcagagacaccagtcggcggcggtcgaggcggccggtcggtgaagacgtagacgcccaacagcggcggcataataggccagccgtgtaggcggaggcaccactcggcggcgacggaggcaggccggcggtgaagtcgtagacgcccaacagcggcggcataataggccagccgtgtaggcggagacaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataatagaccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcttaataggccagccatgcagacggaaacaccagtcggcaagagtagtgccgcggcgttacatgcaaacagcagaaaataccaagagagattaattctgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcaactcataaagttgattccatcgcactcgtcgtcaggaaactcggcgtttacccctacctggcgcgccaactgtcgaaacttgatttcggcaataataaaacggggtagcgcacgagacctaaaagtggatggatgcggagacaaaggatttagacaggttcaggccctctcaatgagaggtaataccctactcctgtt

SEQ ID NO: 45745 - DNA, 727 bp, Oryza sativa
ttttgttccttcctgctcggccttgtttgaccctcttttctctgtattgatgcaactcaatatacctgggttactgtagttgttgtatacttcttccatcctaaaataaaaaaaaaaaaccctcatacgtgatgtgacacatactaatattacgaatctggacatgtgtatgtctagattcgtagtaatagaatgtattacatcacgtataatgttggtttattttgggacggagagagtacagggaacacatagcaacaaggtttcagagttttttgtggagcaaaacaccgattgagatcctatgctcaaagtcaaatcactttgagtcactgaacatgtcagtgactctaaaaacacattacttaagttagaggataattcgtgaaacacgtactatcgtaataatttgatctgagccttgatcatgactcggacgattacgacataatgtgtcctaatgcaccttattggtatcctcctctacagtacagtttatacgcttagggcatgtataaaggtagagcttagaatggtctctttgttaatacatatcacttagagactattctcctacaatagttaagataacaaaaactcttaaccattaatgcaccaaaatattttttttagtaccattctttccttttctccacctccatgcaacaaaatttcctttaataaacgttaagagtcgactctgacccgttgtcatgcgtagcaacca

SEQ ID NO: 45746 - DNA, 162 bp, Oryza sativa
aaaattagcaccatagcgtatgacgcagattccatatatccccatcatgcaaaccccgcagatcctggatatatcctgtactgccagacagcccgttgatgctctcaacgattttcacccgttgttgcccgggactttttgaattaccctattcaaatcaga

SEQ ID NO: 45747 - DNA, 1501 bp, Oryza sativa
gaataactcgcttaggtccaatgttggagatcggcccctccaatcctctatcattccccagtccaaatcccctctccaaatcatgcctttatccaccaaactctattctcatctgtcccctcaatgccgcctcttcctcgccccgtcggcctcctccccacccactagccagcctgcccaaagaagagtgagagacaggagggagataggaggggaaagagagagtgatgacgtggtcaccctgacatgtggaacccatgtggtttccatgctgacttaactgccacattgaacaaaaccatctaaggacctcccatttttgttagttgaaggatgacatatatccgtggtttcggtatgattttgtaatccgatgacaaggtaagggacctcatatatactttttctctcggtgcatcctgcgcggctgcacccacgtgctacctctgctttccggcctagcccgtaaacctaaagggccgcctctactcccattggatatagggcgggccaagagcgagagtgtacgagtacgagaagtagagttttccacttctccttttcccttgtactccctccgtcccaaaataagtgcagttttacactatcacattcaacgtttgaccattcatcttatttaattttttttatgattactatttttattgctattagatgataaaacgtgaatagtactttatgtgtgactaaatattttcaaaattttcataaattttttaaataagacggacgatcaaacgttgggcacgaatatctacggctgcacttatttttgggaaggaggtagtacgagaggaaagcaaaagcacagaactgggcaacatatactactacgggacaaacttgcaattgaccagttctcattcacgaggacagacaagagatagagcgcgcgcgcgcaaagaacatatagatgcagattatttttcccttagtttttagttagctaaatttttaaagtgttaaacagtatgtttcgtgtgtatatatatatatatatatatatatatagttttaaaatagtaaataaatcaatttcaaaatatgtaataattaaaacttaattaattatacgttaatgaatacgaactggccatatcatagtagagtgatagcaacatattccaacatccaggtgtgaaaaaaaaatccaatgtcggcacctaatactaccagtaagcgagtttaagttaactactggagtacttagtactaatcctacataggactataggagtgcctgtaattattactaggacgagtattgaggagaatatcaagtggtttctgtgtgttttgttttcaaaggggaataaagttattcttcttttaaagttgatcttgtactttctaaaagctgaatccaaaagatagttgatgagatcgagtagcagcgagccaaccctgactagtaactccggagaggaaggccaagaatccaatcatgtgtctcgtctcgtctcactctcgcctccaatca

SEQ ID NO: 45748 - DNA, 1501 bp, Oryza sativa
atatatatcggaggagtgccttactttctgtgctcggttcttcaaagatgttagtacaaaggtgaataggccagaacgtcaagaaaatagccaagtcagtgcaccacctgctggcctaagtatttttgggagcatgcagtacagtaagaacaaatttcatatcgagactgcatcttattcagacttgcataggatgaggcactacataatatccaaatgtgatgaggccatgccatgggtaaagtaagatatatttatgtctgttatgagtgcagagtgactaaggaactcatcattctgctaatattttcaatgttgttgcagtgagcatatggagaaattgaaaaaaaacccaacaggggtaatgttgataaaaggcacaaggaacaatttgtatcatggtttgagcataaagtgagtgtttttttattaatttcatcaaactaattgaaaatgtgactgatcatatgatcgaaatttttctgagtgcagatgaacattcttcatgcagatggaaaaacagatgaagatgtatattctctatctcgtggtccagatcatcgagttcatgtagctaacaggtgctccatcaatggatttctcttccgcacaaccaatgtagagaaaaacctaaccacacagaacagtggtgttgttgttcagggcgaaggcatggactggtacggagtgattaaaaaaatcatcgcccttgatttccccaacgacaaagaagtcttgttgtttgagtgcgactggtttgatgttccgggagcaaccacgaacaaatccagagggtacagtaaagatcaatatgggattattgatattgacaccactcggtttcgctttaaagacgagccttacatactggcgtcacaagctcaacaggtgtgttatgtgaaatgcgcaaagaaaaataattggtgcagtgttcttagaatgaaacctcggaacctgtttgccatgcctgaaagggaagacggtgataataatgttgaccatgctgatgttgactcacttgttgtaggagtggagcagatgaatgtacaacaccgacatgacgatttcacaaactggagaaggtctgacattgaaggtgttggtgacatggagccgggggtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgaccccctgtggttttggcgccccgtgtgtgggttaggtgagcccagcggggctcacctaaccgcatttatagcaggttggacgagcgcaccacgccgcattcatgcggcgcagcgcacgcttatccggtccgtgaccagtcgcggtgtgtgaccggtcacagaccggttagatcgcgggttaggtggcaacaggcggcctgtcacacgcctcgccccgtcccgtcggaa

SEQ ID NO: 45749 - DNA, 1501 bp, Oryza sativa
gaatgttcatctgcactcagaaaaatttcgatcatatgatcagtcacattttcaattagtttgatgaaattaataaaaaaacactcactttatgctcaaaccatgatacaaattgttccttgtgccttttatcaacattacccctgttgggttttttttcaatttctccatatgctcactgcaacaacattgaaaatattagcagaatgatgagttccttagtcactctgcactcataacagacataaatatatcttactttacccatggcatggcctcatcacatttggatattatgtagtgcctcatcctatgcaagtctgaataagatgcagtctcgatatgaaatttgttcttactgtactgcatgctcccaaaaatacttaggccagcaggtggtgcactgacttggctattttcttgacgttctggcctattcacctttgtactaacatctttgaagaaccgagcacagaaagtaaggcactcctccgatatatatccctttgctattgatccttctggacacgctttgttcctcacatagcctttaagggtacataggtacctctcaatgggatacatccatctataacaaacagggcctccaattctagcctccaaagcaatatgaactggtaagtgcatcataatatcaaaaaatgatggagggaatatcatctcaagccgacaaagggtctctccaatcgaattgcatagtttttcaatttcagtcacctcaagctcctttgaacatagttcgttaaaaaacctgctgagctcgattaatgggatcacaacatcttcaggcaaaatatggcgtaccaccaatggtaaaaatttttgtaataaaacatggtagtcatgacttttaagtccactaaccttccaaccattttcatcaacacatctcctgatatttgaggcataaccatctggcatcttgacatgttgtagaaatctgcacagaatttccttttgacttggacttaacgtgtacaaggctgccggcaaagtgtattttcctatatggaccaataaattttgatccttcctaatacccaattcttgcaaatcaagtcgagccttctcactatccttagatttacctgttaaatcaagtaaagtacctagcaagctctcacatatgttcttctcagtatgcatcacatctagattatgccgtataagcaatgattcccagtatggaagataaaaaaaaatactcttcttcctcctgttgtgccatctagtatcttcatctcgttgcttcctcttccttgacgtcatgccaaatttgacttgctcaaaactctcgtactgcttcaatacttcgtcaccattgagtgccactggaggccccctcatttcaaccttgttattgaagctaaccttgttctttcgccacctgtggtatgaagccaaaaagcggcgatggcctatatagagtgcttcttgccgtattttaaccacaagtattcagtatcattgtgcaataagg

SEQ ID NO: 45750 - DNA, 1501 bp, Oryza sativa
  unsure (1)..(1501): unsure at all n locations
atcaaagcaaacctcgtaaccgaaaaaggagaaagtacgtgtagatttggttttttaacagaagatcaacgctaatcatgattaggggcgtaattagacgtattaggcatggagaacgatggaaacttatcggttcgtgagattgtcttgtcgcgaacattcgtgggctagacccacccgcaggaaggcggaggaaaacaagaaagaaattgctagactcgtagctcttgaggggcttgagcttatatacagatgaaagtgagaagaaaaagttctcaagtaaaatgtatgcaacattcttttagagattccatccacttttttcccggcatatacttcaacgtttcaccgaagttccatataattaagaagattaacagcacgaaacgtagcaggcaaaaacagagaattgagttaattaattaactaaccccaaccaaacaacagagagaatagtagatcctggatcactgctaaaaatgtatccagataaggtgcaacagcattttatcttgttgcagtcaattcacaccagaatcgatcgaagcaaattagaggcaatcccatactggcaacccaacaaaatctcatgaacagtaaaaactcggtcgagcaaagagaaatatttgcaaaaccgaatctcttggattggaatactagatatcttaaaggtgctagattaaccggcctcccagcgatttggctactgttgaccaaccgccttgcgacacgttgctgttggctgggcgtcttgcgggccgtccgattctgcgtctgggcttcatccatccgtccgtgcctccctgttggtcgtccttgccgaggcgtcgatttggtggccgctgagcctcccacgtcgcccattcctcctctctcgccgtctcgcgcaatcgcactcgcacacacgcgccgcctgaattaaatttaaaaatatactgttcattcaatttttttcccataaatatccgggatacaaaactttttgtgtaaatataccgtcgatctcgcacaaccgttgcgtgaaaccgaggtgggtgtgacgccatgggcggtatctcgcggcgaaggcacgagagcgcgcggtttcgcgcaatggaagagcgagaccggggggnctttttgaancagacagcgaaactgtccaccggctccatcaattagtgcttaattacttaattagcaattaactaataataattatcaactaattatcctaattaataattaattaattgctatcaagataattagtccctaattgaatcagcatggcaccggtctcgctcagtgcttgcgcgagaccgttctgtctcgctgtaccattttccgcgagaccgcgcggtctcgcgccttcgtcacgcgataccgtccacgacgttattccccgtcattctcgcgcaacggttgtgcgagatcgacgctatatttacgcaaaaaattttacatcctaaatatttataagaaaaaattgaataaacagtatattttcaaatttaattcc

SEQ ID NO: 45751 - DNA, 1501 bp, Oryza sativa
gtcggaccggccgccggcgcgggactgtcgtctgccctcccctgcctcgcgcgagtccatggacatcgcatagccacgggagccaagggcgatacatccaaagaacagctggtatgccaggtacgtgcatcactgcgtctcctctggttcgagggctgtctaagctgatggtctaggcctccccaccggtggatttggctacccttgctccgggctctggcgccggggatggtgctcgtgctccctctcgacttgtccgtacaccctttaccctatcctctgcacgatgcggtggcggcgggagggcggagagaagcagctatgccgcattagctcttcgctggtttcagaaactcaacttgttccaggtatagttccaggtgctccgtgctcgtcaggactgaaagagattatagatcttatttggtgattcgcaggtatgataggctttctcccacttttgttttcctgtcatgacatagaattagtgaagagaaaaataatgcatggcggataaatgattgcaacttgcaaggcagcatgctgaacatgcacagctcagctctctcttgcctaggaaattcttggactaggagatgtgtttacggtgcagttggcacatgcgttcagttgtcaacgcacctaaactcttcacctttcgtctggatcaaatgaaggattgaaaatatgtgactcttcctatcttaattccatcggttggctagctccttctagccaacatatttttaaaaaaaaaaaattcttggactggcgttcccagccttgagtacactgaatcgcatagaaagtactcatctcatattttcatgtcatgtagcatcaaatcctctctatgactttatggatctacggtttttgtttaggtttcctgttggtacttaattagagttgtttcttgcatattttacttcagattcagtcaagatttgaagagatcttatgtgataattaacaggtctgatgaccttgctcccagttttgtttttgtgtaatccgtttactgaaaagtaatgcatggtggatgaattgttgcaagaaagcatgctaaatacgcactgtactgtgcagaagttctgcagtgcaggacattcctgccgctagtcgtgccttggacagccagagctctcgaattctcagccttaagtacattggatcacatacaaggtactcacctcatgccatgtatcatcaatcctctttatggacctggagttaggtgcaccttatcagcttaagctctcaaggttggcctgctcctcatcagctttctatcttctatatatgctgtgcatgttaatttcgatggtttgtctcgtgcaggtctggcttcttggagtccatatgggcctcgtgccattctctctttgcactgaggtctgctgagcgcctggatgcttatagcatactctctctctctctctctacttgtcaacactgaaatatgttttctcgggacctgacgagccccaagactatgatc

SEQ ID NO: 45752 - DNA, 1501 bp, Oryza sativa
cgaaggcacgatgggctattgtgctgcctcacagaaagagtttatatttggtccctcaactctgtgggctgtgtttaaatggctggaaataagtctatttttgatccctcaactctgtgggctgtgtttaaatggctggaaataagtctatttttggtccctcaactctgtgggttgtgtttaaatggctggaaaataagtctattttgtatacctattttcttgggccatgccttatacgattatataagtctattttttgtccctatattttttttatttgatcgggccgtgccgggccggcccaccgtgccgagggtgcagcccaggcacggcccggctgtcgggccgggccggcacgggcacgaccctagtcgggccgagccgtgcttgggccgggccaaaattgcgggcttcgtgccgggccgtgggcctcgggccatatggccatctatagcggcaggtgtggccgcaggttttaggtgatttggtaattgaggttagagtctaagtggaactaggaattatattcctattttgtgtaggatgttgtcggtataaatagagagagaggctatgccttgagggtaagccaagtttgaaagattagagagggtttcatgagaaacttgtaagaggtgttgtggctgcaccttgtgaacaatatacttgaacaataaatatcatatttaatcatcaaggcatagacgatctattccagttttgtaagttttacgtttatgtttggttttggcattagcttgtgattgttcgttttgctacgattttgttcaagttaatctattcaaaatctttctaatactttatagatcagatttggaaagttttggtgattgattcttgttagatttgaatttgtttaagttttaggtttagtttagatttgctaaaattccgagacagctgactttcgaggatgttttctcttaaaccgtttattactttgcaaatccctccggtggaattgttccttggtttgtctagtttattctgtcaagtttgcaattcgatccaacggttggtttaagagaaatcaagtttttacagaagcattatcaggctgtttttagggctaacggtcactgccgagtgacctgcagtcagaccggctaggctcggtcagaacgactctagtaggtcggatagtgtcgaaacatgaattcggcaataataaaagggggtagcgtacgagacctaaagtggatggatgcagagacaaaggatttagacaggttcaggccctctcaatgagaggtaataccctactcctgtttggggatttgaatccgccgggtgtagtatagatctgacgatcaggttgtctcatgccctctagagggcctcctgcccaccttatatagaatggggggcaggattacaagatagaaaccttatccaatacggtatcggtttcctaactctactttacaatcttatcaaaccaggactttaggccgttccgtaatatacaaggaaacgt

SEQ ID NO: 45753 - DNA, 164 bp, Oryza sativa
taggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggaaactcaatctgat

SEQ ID NO: 45754 - DNA, 1501 bp, Oryza sativa
attatattttcgactgtgaaggtctcaggggctactgtggagattatgggtaccccatacccacacggcatggttatccgactagttataggggataacttatatatatgaaatatgtaacagatcatgacttgggtattacgtttccttgtatattacggaacggcctaaagtcctggtttgataagattgtaaagtagagttaggaaaccgataccgtattggataaggtttctatcttgtaatcctgccccccattctatataaggtgggcaggaggccctctagagggcatgagacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaattcatgtttcgacactatccgacctactagagtcgttctgaccgagcctagccggtctgactgcaggtcactcggcagtgaccgttagccctaaaaacagcctgataatgcttctgtaaaaacttgatttctcttaaaccaaccgttggatcgaattgcaaacttgacagaataaactagacaaaccaaggaacaattccaccggagggatttgcaaagtaataaacggtttaagagaaaacatcctcgaaagtcagctgtctcggaattttagcaaatctaaactaaacctaaaacttaaacaaattcaaatctaacaagaatcaatcaccaaaactttccaaatctgatctataaagtattagaaagattttgaatagattaacttgaacaaaatcgtagcaaaacgaacaatcacaagctaatgccaaaaccaaacataaacgtaaaacttacaaaactggaatagatcgtctatgccttgatgattaaatatgatatttattgttcaagtatattgttcacaaggtgcagccacaacacctcttacaagtttctcatgaaaccctctctaatctttcaaacttggcttaccctcaaggcatagcctctctctctatttataccgacaacatcctacacaaaataggaatataattcctagttccacttagactctaacctcaattaccaaatcacctaaaacctgcggccacacctgccgctatagatggccatatggcccgaggcccacggcccggcacgaagcccgcaattttggcccggcccaagcacggctcggcccgactagggtcgtgcccgtgccggcccggcccgacagccgggccgtgcctgggctgcaccctcggcacggtgggccggcccggcacggcccgatcaaataaaaaaaatatagggacaaaaaatagacttatataatcgtataaggcatggcccaagaaaataggtatacaaaatagacttattttccagccatttaaacacaacccacagagttgagggaccaaaaatagacttatt

SEQ ID NO: 45755 - DNA, 1501 bp, Oryza sativa
atagaaacttctagtacttgtctccttagcagcttcttcttcttcttcttcttcttcttcttcttcttcttcttcttcttcttcttcaattccaccatcaaacactgagagttgagtgaatattgttgtgattcgaattagggattcgggttgctaacaatctggtatcagagctgtcgattcgtgggatttctagcatggagtcgatgggggagtattgcagcaacgccccatgcaagtggttgccagatttgggcaagggtggtgctcatggcaccaatgcccacaacatgttcgatggaatgcctagccaacctgagatgtccaaggaagatcagaggatatctgaccctattcccattaattccaccatgaacaaagaggaaaaatggctagacgatgctctagattggatattggagaagtttgaataaatggaggccaagtgcatgcaagaggaaaagatcaatcagatatttcaaaagttggaggagatcgaggttcgtaggagcaaggctttcgaggaaatgattgtagctatcagggcaaccaccgctatcatcaagggtgcatcatctccaacacccatggcaccacctcctccagcgcccaccaactgtttgatggaatgacccaacaacaacatcagttgggtggcaacgaattcaagtctcattggtgaggtgctttatctgacagctacctgggagctaggagacagaaaggacatggaccaagctccctacattgtcaccaaggacctccccaaggtcacgcccaccaagtgttcaacgctatgttctagctccgacatcaagcctgatcttatcgtggatgtggtgcttacgtgtgccaccactgctgtagcctccagggagtttgtattggctgatggtaccatcgataccatcaacattagcaccccagttgttccaaagagatgcacaccaagtgttcgacgttgggccttgacatcaagggagactctaaccaagttgtgctcgcgttccagaccatgatgggtatatctaaggttgttccatcatctgttcagccagtggagaatttctcatcaagaacagtcaccgacataaagctggatacaccaatgctcaacacgtgttcgttgaaatgccccagtagtgataagaggccgctgatagagcatactgagagaaatccatggccacctccttggtcagctggagtgactagaaggtggaggtgtggcatgtaccttggtccgtattcaatttcttttggaaaagagtatattttttgaaagaaatttgaaaagagtatattggaaaccaccatggcctccacctaataggaatgatattatgcacctcctgactaattcacacacatttgtaaattagagaaggcaaatttggctaaatttaaagcaagggaatgtgaaatattattagtgactgagctgtcttaatctgatgagcctattcaagttgggtgctgggaacattttgcatgcgctgca

SEQ ID NO: 45756 - DNA, 1501 bp, Oryza sativa
aatattaaaatatacctttctcctatgattttataggaatatacttatttttgaaggtgattattttgcatcctaatagtaatatatagagaaaaacgtgcattgcacgtatatgtactagtatactcatgattttacagcctgacttgaaaaccgtgccatgaaccaaaaataactagcaaacaacagtgcaacacatgttgacacgagatagattatcactttcaaccacatatgactcgttcttccagcacacgtcgcgcctatggcttctcctgcaaacataaaaggaacatagacgagtaggaaataccaccactcctacaaacagacaaaaaaaaataatgtcatgaagtttggccacgcataaattagataacctttgtgtatttgtaatttgtaaattaaagattcggaaaatttattttatttattttgtaaaggatgtgcagtaatggcgtttattatactgtaaaggttcataaatttcatttatttatcgtatattttgtataacaagaccacaaatcgaagtgattaacttttccatattattagttagcagaagtgctaaacaaagattaattagtgattaatctttcattaattactatctcaacaacaatttaaaggacgtaccttgggcttataaaaggactttttaacgcaagcaatcctcgccaccttgaattgctgctcatcggcgaagtaggccgccgtgtcgacgttgaaccagaagttgtccactctaccctgtctagttatcatggacggtgatgatggcagctcagcgaggatatcggcgccgttgatgcagtgccccttgatgacgacgacgagaggacagggggctctgcacacgtgacagcgcctgtcctcgctgacgaagcggacctggacaatgcatctcgcgcaaacacagcggtggccgcatggcccgatcgccacccactctaatggctccacacacaccgcgcagcagttggtagtagtagcagcagtgccgccgcgggctacgtcttggagctcgatgtcgacgacgacatggcacactgccttggtgctcatagtattgggtggttgtttcacgtggtatatgttggatcgaacacaagtaaccaagtctatgagagagatgttgaatggtagattacatcagcggaagtcaaataattgaatcttaatagatcaaaacacaccccaaccttaaaaaccaatggaacacacgtaatccagtctatctgtggagattatgggtaccccatacccacacggcatggttatccgactagttataggggataacttatatatatgaaatatgtaacagatcatgacttgggtattacgtttccttgtatattacggaacggcctaaagtcctggtttgataagattgtaaagtagagttaggaaaccgataccgtattggataaggtttctatcttgtaatcctgccccccattctatataaggtgggcaggaggccctctagagggca

SEQ ID NO: 45757 - DNA, 249 bp, Oryza sativa
gcaaaagaggaagacaacttcacttgcaacgcataacagaattgaagtcaaggtttctttatgtgactttttttttgttcagttaaaggatgtccttctttctatacatatattcttgtacttctattgacaaggacactacagacacacaaacagtagcttcccatatgattggtgcaaaagaacaggaaaatgacaaaccatggaactgtatgaggatactgaactgtagtactggatagagaggta

SEQ ID NO: 45758 - DNA, 1089 bp, Oryza sativa
gatataacatctgtagcccccgactcactactcaatggaagaccaattggtgtagtgaggcagaggaaaaggaaaaatatcatataaagaataaaataaatgatgacttagctttgtaatattccccttggtgatggcggaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgatggaggcaggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtagtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggtaggccggcggtgaagtcgttgttgctatcagcaatggcggtggcgaggacaagccggcggagtggactcgcggccgatc

SEQ ID NO: 45759 - DNA, 1501 bp, Oryza sativa
aacaattctttaagcaatgcaactgcttgaaagtctatcagaatatcatgaaaatggataccctacactcctacagacagggaaaattcataatatcaagtaatttaactcagatcatccaaagtaaatacaagcagaataaataccattgtgctttatggactctagctgaaattcataacagatagtcaggcccacagaattggttccttttccaatctagtaatgcaatctaggtccatgtggtgaaattcattttgctggtggtacgttccacatttcagacagcacaaaaatgggtgaaaagaatagcagagggtaaaaaaaaagagatggcaaactgtagttttcatccaggacaaaccataagcccaaaactgtcttataatttcaaatcctcattatgtaatctaactttgcaaatgagagtaacaatcccctggagagagaaatgtactatgccttcatgtccttgcagtttgatattcttcattgaaatgccacccgctgcatagcttaacatccaatgctcgttgaatcaacttcgataaacacctcttccaatttatgaaggaccacgtaacttgttataagatttcataggcctgtttagatcattaagattgaactaggtagttccctttcttctgctaccagtctacaactacagatccagataccaaaccaaatcatagtaagaagtaagaactggcagagttcaagtacccaggtttaaattaaatgcacaataatactgcatactcctggaactctggaaccactagtattacatttcaactgcattcagctaaataatcagaacatatgagctcatgcaaccatgcacaaacagattcaagaatagccttatacatatcacatatgcgagggcaaacatgcacctatgatatagcttaaacatttgtaacaaggtaccaggttcaagtaacaaacatcaattcatcatctcaagcacacattcctaatacttatataaaggtactagtgatcataagcggaggaaatcatgaataatctccaaggaaatgccaaaatagcagcagttctttggtggatctaagcgcagggccaaaccaaacaccttactcctccgctggagcaggagcagcagcagcctccgactcggacgcggccccctccgcgggcgccgccgctgccggagacggagcggcgcgggacttggcgagctcgaggaggcggcggctgacctccttggagtacgcctgcagcacctcgatcccgtcctcgacggaggccggggcggcggcggcggacgacgactcggtgacggcggcgtaggcctcggcctcgaccgcggcggcggcgcgcccggcctcggcctccgggacggccccgtagcgctgggagaggatgctgggcgcgaccagcgtctgcacgaggcggcgcaccacggcgtcccgcgtgcgctgcgacgggggccagatgctgagcgacgggagcagcgcctccgcggccttgg

SEQ ID NO: 45760 - DNA, 1501 bp, Oryza sativa
taatttctacccacaaacaccagccgaatgctaagatatgggtctgaatggaaaaaaaaatccatcattgttgcaggcttgcagccctgaaaaaaatatggttgtacttagaagtcagaaaaatatagctaccaaaaagcagcaccgctagcaatgactttcttaactcagtgtatcacgtgacaaacaatacatactgatcagataaaattaacaaacaacacatactgttcatttaagaaaaacaagggtgtgggcaatatatattgtgaaggttaggaccttttgtacctgaaactcacagtaattaaaagcaagtgcgggcaatatgcatgtttcaaaatagttttttctttcaaaggaagattactgtgatctcattaagaaattcagcatgcgcatatttttctcaaatttttagtttgcatgataattatcagttataaatgttgataattcaaaaccacaaacagaactatatatttatgccgtacggctgccctatcaggtcacttcttgctacttcttgggtttaaaaagaatcaacaaatgcatggagggtctatatccttattattatgtgaatctggaatgtgtttcttatcctacaaattattggatataaagcattttatttgcagtgtacctcaactatgtagccaagttaaacaaagcaggcaactaaagaagtagttcagacagcaatgaccttctcaatctcagagcttcgagtacaggagtatttcagatagcaatgaccttgtcaatctcagtgggaatggtggaagctgaactccttgtggacaccacacttgcaggtgcgcaccaccagctcgccgctggcaagcaaactcggcctgggtatctctctctcctcactcgatactcaacctctagctcctgaaaggtacaaaatgttcaggttttttttgaatgaacacaaaaatgttcaggtttcagaatggcagattgccaaatgacaatgacatgcagagaagctgaataaaacatcaatcgccagtaacagaggtgtccaggcaatcacagagatgtgattcagatgctgaatgtgaatttgtggttcatatgaaacaaattttgctaaaatttgggtgtaaacaatgcaggtattttggtgcgtcaaaatgtgcaagcagagcatgtgaattcgttcttctttctttcgatttcatattatgctaaggacgaaaatggactggggagaggaggctttaccggcgtgatcgtcttctacccatctccactgaggaggacggcctcgccggtggtgtagccccggagcgggatgcctcgctggaagaattcttggattcctgctgcgactaaatcggagcatgagatgcgcaagaattgtcgacagaaataaagaactgggtggtgattcagataaagaagagtaaggcggaagaaatagaggaggaatacctgcttggccgccttggccggcgaagcgaagaacgtgcagcacggcctgtccgcg

SEQ ID NO: 45761 - DNA, 1501 bp, Oryza sativa
ggagagggacctgctcgtgctgctctcgcaggagaaggataaggtttgaatctctatataattctataggttttctggtttaatttcatcgtcggtattctggtatcatgaacaattacgctagagaattgggtgatgaggcgaggaacatgtgggttttagatgtcttgtagatattcaactacatcttccaagtatgatccgtgcgcaatatctatcggaactttagaagttaaacaacgatgtgataattcgagcttgttactgtggtcatcaagaaattgatttttttttctgaagttaagatgatcattttttagggaatacgatctgtaattggcaaaatttgtacagttacatgttgtatcactggaatttgggtatacggttcagtaagcgagtatcatgttctatcatcgcagaggttgattcggaacatacagaatgagaacagggttaaatatttggttttcctatagttaaggtttcaactttttagggaatacgatcagtaattggcaacatttgtacagttgctacttgctattctgtttagttacatgtatcactggaatttcagtatacagttcagtgaatgagttataactctttgtggtgatcatagagaagatttgagatattatggaaatgttttgttttactgctgtcatgctgtagcagtagtaccagcagtgtcttttgatagtttcaccattagagtgttaggaaacccatcaatgatgttcttttcacttgtcgtatcctcttgatgttctttaaattagtgtcttttgatagtttcgccataacatgttgtatcctcttgatgttcttttcacatactgatactgtttcttgaggttggagaatgttaattggctactctttgttagtgtaggtactgatggtgtaccattgtcaagtagccttgaattgaaaatccatcaatttgttatacttttcatgcattaggttgagtgaaagaaattggatgctgcacattgtacttgaattctaaaaatataaattggatagtttcttgctctaatttgtctttgccctttagtgttttgcatttctaattattacaatatgcattagttctcaacaattttttagtcatcgtcttatgaggcaatgtttttacatggggaaattatgttcaaaacacaaaaaatcttgtctaaattggagaaaagtagtatatctttgtactcatatatatagatgttagtcttgtgtcatgtaagctacgtagtattatgttcaggcgtgcattgagcaacagtaaatattcacaagacagtttatgcattgatgttctctcattagatccttgttttgccttttgcagaggattgcccaacttctgcatcaaattgctttaatgagtgacatgagaagtggaggggaagcaattaaaattatcaggaccccgtgattattttttcactgcagaagaggtttcgttgcattgtcgtaccaaatgtgtcatgtagtt

SEQ ID NO: 45762 - DNA, 163 bp, Oryza sativa
tattggaagctataggagcaaaacatgtataagtttttggtggctcggaattgatagtgcaacaagttgccggggtgcataagtgttttgatgggtcattaaatagatatttagatcaatgcttagacacattatcaccaatttttatgattttgttattaga

SEQ ID NO: 45763 - DNA, 1220 bp, Oryza sativa
aataaagtaaactaatcttgcaagataagttgaaacagttgaaaacaggatcacaaattttgcacttttgaataacaggtttcaaaagacataaaataaaagagtgttataaaatcaacatgctaagtttatgatatttcaacatgattgaatgaaaataaataatgttgtaaaacttttgctggtaaatgggccattagtacagtaatagatgtacaataccaacaacacaggaataatgagtaaattttgaatgagaacaattgaagagactataatctgcatgtgccattagcttggtttaattaaaagagaaagagaggagaataattctactttttcaatatttttagagggcttctataggtaaccatttggcataacctagggttaaggaggctctgataccaacttgtcacgcccggaatttctatccaaaactccaaacgcttacatgtgtgtaaaccctcgtccaggaatcagctgaggcacacaataacaaattgataatagagtgcaattattaatctaattaagaggcgaataaaaagtcattacagagatggatagttcctctcaaacaataaagatctaagcagcggaaaataaaataaagagcacaggcgactccatcccacaagcagcttgaccagggctacgcctaatcctccacaccttcagcatcactgtagaactccttctctgatgaatgattgcaagatgagtatatgacatactcaacaagccacgcagcaaatatgcaagtgcaggggataataaaggatggcataatatagtctcatttgcataaatggcattcaataaatacttcagaatttagaaaaacagtaaaggatttaattaaacaatattattcaacgctacacaacatacccgttgcataggcccaacatttctagacaaccattcccggctgcacagttctatctccaaaccaggagctaagcaagttattaccaattacagcatcatttattatggtgagaggtgtgagactaatcacgaaagacattgttagacccgcccataactgcgggcacggctattcggatagtttttactctggctagaggtgtaccactatacccacaagacacaacctcaacatcatgtcaaccatgcgtcgcgatacttgacaagtacccgaatagagattgtgacaataccctccgcataacacaattcaaagtagtgcacca

SEQ ID NO: 45764 - DNA, 1501 bp, Oryza sativa
gacgaattggacgatgtcgatgatcagacgataaatcaactcagacgataaatcaatcggacgatgtcgacgatcagacttatgtatgaatgggccaagaactcagaattgacacgatgaattgggccaaaattcacaagtctacgaagtgaagcaacggaggaggccactagcaaaaacttgggctggttggtccggcccctggttcggccgaaccagtgggtttgacctaacctcccgtggcgctgatggatgcagggttttgatggacagctgggattgatcaccaatgacggttgcaggatattaccgaccattccaaccatataaccgtcattacctgcctataaaaggagttgccattcttacatcacacacacacctcaagcaagagctctctcatattctctcaagttagtttagtgttattaagctagtggaatagaaatagagtagaaatcgggagtccgaaagcctttggaagagttcgggaatggctctagtatctttccttttctcttttgtaagctttgtactattattagaatactcttctttatacatttatgatattgaaatactttccaagtatattaatgcctactttaaattatgttcatgttatactgaatatgttgctagcttatatgggagatgctttggtgcgggtataatgtttgcttacgcaattactctatgtcatgacgatgatattagagtagtatctggtagtttagacgtcgcgtctggattacgggatattattatttggagttatatgctgcggatgagaggtgggccactgatggtgatagctcagtacgggtattcctccgcgcgcgtatataatcctaagttaattccctggggagggtactcctccgtatttagccccggttgtatggtcatgacgggctgtcgtaaggaactcggcagtcaggggcggcttctctccacatgatcttcccacgggataaaataaatacgatacccttggaaaactctcgggtgaaatgctacaatggtatatccgtgcgcttgcggatgaactctgtaaccataatataccaggagtaattctgcgccattgctgggaattatatttctagtaatatcattaagaaatactaacaagcttttctggcgctgttgccagggaagattcataatagagattacctgacctaatactttctaattacctttgtataatcatttccctttgcaagctaaccttggttgtttttacttttgttgtgaaagcagggtagtacatgactgatttcaacttgccggaaaatttcaaagaaaatccagaagctttcttccagagcgtcaggccgtgagccactgctctgcagaaaactctactgacaaagaaaccagccgtaccagcgccaccgactttcaagactatagctgacaagactctccatgagttcgctgctccctctgctgagaatgtggccattggaccacagatcaacatgggagacatgga

SEQ ID NO: 45765 - DNA, 1314 bp, Oryza sativa
cctgcgccctctatagtatatgtgtgtgtgtgtgtgtttgatgattttatggcagttaagtttatggatcgatcgtgacagatacagaatggtagtttcgcatgcacttacagatgtttgcaaacttggcttttagatcgaccaagtgattgctattggtaatctcaaagtaataatcagggaatgacttctgctcatacacatgcaccggcacagccgtgccgattcccaagattgttggcttgttgctctcccgccggcacgaggattgttgctcaattcatgtgtcaactccggtgcccccgaggatcccatcaggcagtattggagtggacggcaactactctaagaggaaatgatgtagctatagctttgagatctctggctaccaaagctcggtcttatataggcattctttgatgatgacgggctactgtatatcttttttacaactagctaggacctcgatgctacaagaaaccatctataattaaatcgttttgattaagacgctttagagcaagtttaatactatagctaactactaactctaaattatctatatttaatttaatagccaatttatccaatagttacctataacatatagtacacaattaatacctagtcccacgtgtcatacatatatttatcttagagcacatgttgcacagctggctgtaacccactacttttctctctcatcatttatcttctcaaaatatgtttatagctggcttatagtctgctattgtacctgctgttatatattccccctccatctaaaaaatttgttagaaatattatttcagtcgctaaaacaaaaaaaaataaattaattaacttactatgtggccatattcttttctgattaattaagatttagattttatctcgactttcgttagcacgttttttaaattattaaacggtgtgttatgtgcgaagactttttatatagaagttgttttaaaagaattaaatatatcaatttgtcaagtttgtaatagttaaaacttaattaatcgtgggctaattgctttctattttgcctatactaattgcatacgcgtcaatcaaccgatccgacacaaaatataaaatcttaacaaaaacgaaaacaacccgataaagaaataaagtaaagactatctccgataagtaaagactagtatctccgataagtaaagactaactccaataccacgcgcgccgctgcatgcgcccaccatatatacaggtctcagctcttccatgcaactagcaaactagtaccaaatccattgtctaatcacatcctgcacatggctcaga

SEQ ID NO: 45766 - DNA, 1501 bp, Oryza sativa
ggctcacggcctgacgctctggaagaaagcttctggattttctttgaaattttccggcaagttgaaatcagtcatgtactaccctgctttcacaacaaaagtaaaaacaaccaaggttagcttgcaaagggaaatgattatacaaaggtaattagaaagtattaggtcaggtaatctctattatgaatcttccctggcaacagcgccagaaaagcttgttagtatttcttaatgatattactagaaatataattcccagcaatggcgcagaattactcctggtatattatggttacagagttcatccgcaagcgcacggatataccattgtagcatttcacccgagagttttccaagggtatcgtatttattttatcccgtgggaagatcatgtggagagaagccgcccctgactgccgagttccttacgacagcccgtcatgaccatacaaccggggctaaatacggaggagtaccctccccagggaattaacttaggattatatacgcgcgcggaggaatacccgtactgagctatcaccatcagtggcccacctctcatccgcagcatataactccaaataataatatcccgtaatccagacgcgacgtctaaactaccagatactactctaatatcatcgtcatgacatagagtaattgcgtaagcaaacattatacccgcaccaaagcatctcccatataagctagcaacatattcagtataacatgaacataatttaaagtaggcattaatatacttggaaagtatttcaatatcataaatgtataaagaagagtattctaataatagtacaaagcttacaaaagagaaaaggaaagatactagagccattcccgaactcttccaaaggctttcggactcccgatttctactctatttctattccactagcttaataacactaaactaacttgagagaatatgagagagctcttgcttgaggtgtgtgtgtgatgtaagaatggcaactccttttataggcaggtaatgacggttatatggttggaatggtcggtaatatcctgcaaccgtcattggtgatcaatcccagctgtccatcaaaaccctgcatccatcagcgccacgggaggttaggtcaaacccactggttcggccgaaccaggggccggaccaaccagcccaagtttttgctagtggcctcctccgttgcttcacttcgtagacttgtgaattttggcccaattcatcgtgtcaattctgagttcttggcccattcatacataagtctgatcgtcgacatcgtccgattgatttatcgtctgagttgatttatcgtctgatcatcgacatcgtccaattcgtctgactcattgttattctctgcaaaaggttagtaaacctaatactagtggaatattattattcttacatgtatatgcattgcaagcatcactagttctcctctattttggtaatattaacgatcaaaattgatcgataacgaccgtcaacagc

SEQ ID NO: 45767 - DNA, 1501 bp, Oryza sativa
ccctcctgagggcgttgtcgtgctatctcaccccttaagggtgattgccaggcgaaagcccagtcttagctcctttgagtcccgacggacggcggcggcggtttttccgtcgcctttcttcttgaagacgtcattttggcatcccctagggggcgatctcctctgtgtccctttattggtctagtggcggtcagtcatgcttagtgacagccggtccgatgctagccttcttctgggctggtgtgttggcgatatcggtgtgtgggtggtggtatatttttttcctttttcctggttacgaccttacagggttgtaatcttataatttttttctgctctatcaatataacttcgcacagtttcgtacgggtcgttaaaaagaaagatgatgcatatgcagtctcgatgtggttgtagctgtgataaagaagcttgctgtgcagagttttggtactcgagctcttgcttggtggagatactctctgagccatgtgcaggatgtgattagacaatggatttggtactagtttgctagttgcatggaagagctgagacctgtatatatggtgggcgcatgcagcggcgcgcgtggtattggagttagtctttacttatcggagatactagtctttacttatcggagatagtctttactttatttctttatcgggttgttttcgtttttgttaagattttatattttgtgtcggatcggttgattgacgcgtatgcaattagtataggcaaaatagaaagcaattagcccacgattaattaagttttaactattacaaacttgacaaattgatatatttaattcttttaaaacaacttctatataaaaagtcttcgcacataacacaccgtttaataatttaaaaaacgtgctaacgaaagtcgagataaaatctaaatcttaattaatcagaaaagaatatggccacatagtaagttaattaatttatttttttttgttttagcgactgaaataatatttctaacaaattttttagatggagggggaatatataacagcaggtacaatagcagactataagccagctataaacatattttgagaagataaatgatgagagagaaaagtagtgggttacagccagctgtgcaacatgtgctctaagataaatatatgtatgacacgtgggactaggtattaattgtgtactatatgttataggtaactattggataaattggctattaaattaaatatagataatttagagttagtagttagctatagtattaaacttgctctaaagcgtcttaatcaaaacgatttaattatagatggtttcttgtagcatcgaggtcctagctagttgtaaaaaagatatacagtagcccgtcatcatcaaagaatgcctatataagaccgagctttggtagccagagatctcaaagctatagctacatcatttcctcttagagtagttgccgtccactccaatactgcctgatgggatcctcgggggcaccg

SEQ ID NO: 45768 - DNA, 683 bp, Oryza sativa
cttgcgcgcacgagagatcggaaggagcagggcctccggaaccacaccttcgcctgagatctgcaccgggtaggcgggtgatcaggtttttggggagtgcttcccgcacgactgctcgtcctcgcccaccatgtctgcgcctggagccggcgccgctgctgctgctggaggagatggcggaggtggtgcgccaccaggagctggagctggaggtggtgcgccaggagctggagcctgtgccgcgaacaacaacaccaacggagtcaattctgcctcgcaatccagtggagggccattctcggggtatatccttctcctgttcctgttcccgttgttagcgctttactgctatgttcctgttcctgatattcatgatgtctctagcatgctactgcgttactgctatgttcttgttcctgatattcataatgcgcatgatgccattagtatgctactggttatgttacatgttgtcactagatcaccctacactgtttatgccatgattattgtcttaacattttggattaaaatatgccgatttatgaccatatttctaacaatccaaaaacctgataggttattttcggtagttggctttgctgctgcactgaaaccacatgcttttgatggttctaactataagagatggaaagcacgtgtactattgtggttgacagcga

SEQ ID NO: 45769 - DNA, 205 bp, Oryza sativa
cctgtcattgtaccgttttctctctatttgcaaaggtggtgggctgtcatgatgactgatggtgccatggtgttgtcatccctgacagcacacttgataaattaagtagagagagcattactataatgtgagaaccaacagtattattttcctcgacttctgcaacaagtacattgttttattaagctattctattatctaaagc

SEQ ID NO: 45770 - DNA, 564 bp, Oryza sativa
tacttcgcgaagccacccctgactaccgagttccttacgacagcccgtcatgaccatacaaccggggctaaatatggaggagtaccctccctagagaattaacttaggatcatatacacgcgtggaggaatacccttattgagctatcaatatcagcggcccacctctcatccgcagcatataaccccaaataatgagatatcccgtaatctagatgccacgtctaaactatcagatagtactctaatatcatcgttatgacatagagtaattgcataagcaaacattatacccgcaccaaagcatctcccagaaaagctagcagcatattcagtataacatgaacataatgtaaagttggcattaatatactcggacagtatttcaataccataaatgtataaagaagagtattctaataatagtacaaagcttacaaaagagaaaaggaaagctactagagccatacccgaactcttccaaaggcttgagagaatatgagagagctcttgcttgaggtgtgtgtgtgaagtgagaatggcaactccttttataggcaagtaa

SEQ ID NO: 45771 - DNA, 237 bp, Oryza sativa
atgattatcacaagtaatatataaattattagtcaagttctctctacaagatcatcctatgggataaaataaatacgatacccttggaatactctcggtgaaatgctacaatggtatatccgtgcgcttgcggatgaactctgtaaccataatatactaggagtatttttgcgccattgctgggaattatatttctagtaatgtcgttaagaaacaccaacaccggccagatgcagc

SEQ ID NO: 45772 - DNA, 1501 bp, Oryza sativa
gatctaattttaatttgctaaatctcaatataaatttgggctagataaaatttcattaaatactttgcttaattctataattcctagatttttctgggatttatttgagctaaggaagtatttttaataaatggaattgcatttcatgaataatttaaattgaaaaaggttttaaaagtcttcttttggctttgggccgaaagccggcccaacacctctcttctctctctccccggcccaagttggcccagtccgccgagccgccgctctcctctctctctcagccgctgacaggtgggccccacttgtcggtttcgtcttcctcctccggccgccgccgcccgaaaccctagccgagcagctccgccgccgctttccaaaattcggtcgatcctttccttctccggccgaattgatagaggggaaataatctcctcgatctcctcttccttttctcttatagaaactccggtcaatttcctttggaaataggcggattcgagtttgattcggattcgtttttccccgaagtttccttctcgccgccggccgccgtgggccttcgccgccgcctccttgcacctataaaaggacccccgagctctcctctacccgccgcctccctcgccttcgtctctagtcgtctgtagcgccctagcgccgtgccgcctcgcgccgccgtcgtcgccgtcgctccagccgtgcgccgccgtcgctccagtcggtcgccgtcgccaccatcgggttcgcaaggtcgtcgccgtccccgtccaccgcttcgccgccgccgaagaccgccggagcgccatcaccatcgtcgacccgatctccgccgccgcttcttcctcgtcgccggcgtcgtccattgatcttccgccgctcctttggtcaccggtgagttcgccgtgccgtccgctacccgttggtgccctccgttcgtgccgaagtgccgccgttcgccggcgagcatgcgagcttgcgcctcccgagccgccgccggtggtgacgtcatcgctgacgtcatcgtcgccctctcccgtgagccggtcgtggaccgatcgatctcggccgttcgtcccgtgaaccgctgccgtgcacccggtccaccgcaaaccctagccgctgacacaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtcttttt

SEQ ID NO: 45773 - DNA, 1295 bp, Oryza sativa
cctgtgggagtggagccggagcttcctagattttatttttcgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagtttggaaattacgagtgaatttccgggcgtgacaagtatgcacgcccgagccgccgccggtggtgacgtcaccgctgacgtcatcgtcgtcgttccccgtggcctggtcgtggaccgttggatcttggccgtccgttttggataggatcgatctcggccgttcgtttccgtgagccaccgccgtgcacccggtccaccgcaaaccctagccgctgacgcaataaacccctttttccttttcaaaaataattcattattgcgtcataattcaattaaaatccatataagtgttttaatccgatttaatctttaaaaattcataactaattcatcttagctcggatttagttggttcaagtctctaaatttttctcaaattgagatctacatgttaaaaatatccacatgtactgttcatgcttgtttatgtgctgttttggtattttgctcttttctgtttagattccgacgtttccggagagtccgttttcgcaggagaagaatttgaagagttccaaggccagtaaggcaagtcacccagatcctaaacacaatcctttgagcatgttgatcctatatttatattctctatttatttcaactgtgcatttatttttggatgtcactgggtggtgtgaatctattcctttgttatggcctgtttgcattgattactttattccttgataccttgggttattataacttgactagttgggctatatatattggttcagctagatattagatatgattgcttagccatgcttagaaacattagcacactcttgggataacttatgactcactattatttaatgatggcttaatgatagttcacgatggtcaatcatgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctagggagtccatgccttatttataagg

SEQ ID NO: 45774 - DNA, 1501 bp, Oryza sativa; identical to SEQ ID NO: 24918

SEQ ID NO: 45775 - DNA, 1501 bp, Oryza sativa
ttttctgtgggaaatgcacttgttgtagcttcaaagctttgtagaaagagttcacggttccatccttagttaaattccatcgtagtttgttattgcagttatcttttaattgcacatcaccccaactagtacaaattttgtgccaatctctcaatctccctccactcaggtctctcgtaaacttgatgcaatttatccctttttgtttcagttttgccacagttatatgttttgtcaaagtgatgttgtaaaggttggggaattgttcatttaaaggtttgccccctatccagctgtcctcccagaaaagtgtcttttcaccattgcctatcaccttggagcagaatttcagaaagatgtttttgatctccatgagcccatgccagaaatgggagtctccatttttaaatttcaataaagatatgggtttgcaacccatgtatttactggtcaaaaagctttaccaccaaccttcctcattttccaatctccagatccatttccttaacaaagctttgttcattgtttccaaatctaggatccccaggcccctttgatctttgggtgaacataccaccggccattgtaccagatgataaccttgtatatatgatatgacacattttagtgctatgaatctgggcatgactcgattggtatattttacaaacgaggtagtaaaagcagtaccacatgaaggcaagaaacagcgatgactgttcagatgggcctctcaagctcattcattcaaatccattttctctatgggtttccggaccagtatatttcttccaattgggctcgcagggaaaccactactctcataagagaaaaaaagaaaaaaaagaaggccacagcccacagcaacacatcgtattccttcccccgttacacttacacaggaagaaaattttctgttaggagtaaattgcatcgccggtacacgaacttgttaggtggggcaatctagtgcacgaatttgtaaaacacttgttttggtgcatgaacttatctggtgcgtgcggaggaaggcaaaaaggacattacatggctaatcttattgatttaggggatgattaggatactatgtaaacatatatctgagaaggttactattagatatacacctcttcaataaaaaaaatagaataggatatagtgatagtagaaaaattttaaaaaagcaagcaataatataaatgttagaaatatatgaaattcatcatttccataatgagggataaagtagataccaaatttataaatatggcatgtcttatgcatgcttactacacgtatacacgtcacatcctaatcaacatcaacttcgtaaaattaacatttataagttattttggtccttgtccgcatgaagtagacaagttcatgtaatgaaacgagcgttttacaagtttatgtactaaattgtacccacctaacaagtttgtgtatcaccaatacaatttactctttctgttagtatataaaattaatataagcc

SEQ ID NO: 45776 - DNA, 563 bp, Oryza sativa
tccttatgtgattcctgaagctattaatactgctgctgaaaaaaccgcttttgaacaaaattgcaaagctcgcaatattcttttgagtggtatttctcgttcggattatgatcgtgttgcccatcttcaaactgttcatgagatttggactactttgagtaattttcatcaaggaacaaataatattaaagaacttcgtcgtgatcttttcaaaaaggagtatattaaatttgagatgaaacctggagaagctttggatgactatctttctcagtttaataaaattttgagtaatcttagatccgttgattcttcttgtgatgctaattatccacaatctgagatttctcgccactttttgaatggtcttgacatgtctatttgggagatgaaagttacatctattcaggagtctgttaacatgtctactttgactttgaattcactttatacaaaattgaaaacacatgagatggatgttctttctcgaaaagttgattctaaatcgagtgctttagttttttcttcttcctctttggatgttgatgcttcttcatctaagc

SEQ ID NO: 45777 - DNA, 1083 bp, Oryza sativa
ctcacctgtgccgagataccaaaggaagggctcgggaatgtgccgctcaaccttgacctcgcctgcgccaagctgccggagagtgaggcgtagttcgttctgctccagtagagagaaggaagaaaggaaaaatgacaggtggtcctaggttgactggattgcctcctaagaaaaaaccagagcggtttggatgaggggtataaattgcatggttttaagagatgaggggcgtctaatacccgattttaaagttaagggtgtattttagataaatataatagttgaggggtgtaaaatggacttatcccgatttgaacggactattataccatggattgtctacaaattaattatttttataaatagaattttcagaaatagcttagaacaaatgctctaaatagtgcagtagaataatgatttcgaggaaatgttattttctgtgagtttttgaagttaccagcttttagtgttttttaagataaggggaagagttttgttaaaaataaaattaaatccgacccaactagggatgcacaaaagtctagaaaaataaaatagaaaaaaacactaagacaaacctaaacatatcatgttgtcttgtagcagctcactcaaatagaaccaagacaagaggttaatcctagttatttactccgaaacaacgccctcgagaaatacatgacattttgtctgccgctgctattggaacacaaggctagattgttattcgaagcctgacatcacaccttcaacaaaggaataacacacaagcagcgatgttgtggaatcattaggttttcactctggagtgattgctagtactctgtgccatcatctggatggacttagcacaatccactcacaatctgatcataaccacaattccacaaaaccgcctttagcattcgctgaccaagcaaccaatatatcagattgctaactatacagaccaagcagtaccaatgtgtagccaccaaggacaaagtactagcctactggatctgccaccaccaagcgaatgaaagaagccatcatcgaaccggactaccgaaaacatgaataaaattatcgctgaacaga

SEQ ID NO: 45778 - DNA, 1501 bp, Oryza sativa
agcgaatgaaagaagccatcatcgaaccggactaccgaaaacatgaataaaattatcgctgaacagatcagtatggaacttattggcacaaccggataagagggtgccattgcgcccttcatcagctagaccaatatcccttcttggatcacgttcggattgatgtgatgtcctccgcattgcatgtttatcgacccaaacaaagcggattgccggttggaagagaggatcagcggtgaaggggtgtccttgctaactaccgattcaactcctccgacatccatggcgagcacggtcacaacagcgatcgaccgatcttcctgctaattcgcacatggtgttgatctctccgatctacttcatcgtggtgttgggcggtaaaaaaaactaccaccatcgtcaccaacggcggcggcggaggcagaacaggcgttgaggcagctggcgacgactagggctgctgaggctcctttggagtcacccacgggaggcaacctgagaggtccgcgtgtgccagattttactgtgacaggggtattaaggatatgttaaactagggaattttaatgtgccagatttagaccagtgcgtgtttttcgcgtcaacacatgggaattttaagagctctaatccaatgtttaaaatagcgggtctaataatttaagtaaaaattcaaggttggatggttttctttttttactctaaatttctaggatttctctaattttattagagcgtcacgcgataatgtagtagtgtttacaagacatttaatagaattttagtatataatagatttctagggtttctctaatttatttgagagaaagtttaatgtaattttagtatataacagatagatttagaagatggtttaaaagaacattgattggatatttcttatagttcttaatttaactaaatatatttatatttgggaagtaatatattttatctttatattgtagaaattcatatttgaatgtatgttttttctgtctgttttatgtacatgtatatgttttttcttccagcgaagattaggaaaattttgttttcaatcatgtacaacgtttgtacgtacggaaagaaagcagtggcatttgtaacgtgcaaactcattcgtacatgaggaagttattattttttaatctaatgatgtaaaataatggatccatcaatttaagtgaaaattaacgatgagattagatagtgcatgtggtgacttaggagcgttcgtaggagtgccatgtagcggcttaagatcgtttgtaagaagtttaatggatttttagtatataaaagattataggggaggttcattactttcgattggtcaacaacgcaagcaactaactaacaaactaacaatagagtcataacatgcaatgcaaattaatgtatggatcacctgattaattgggtcgtcgttccattcccagccgatcgatcgcttcaaccattcgatatatatagctgccctaagcaggatcggttattt

SEQ ID NO: 45779 - DNA, 1501 bp, Oryza sativa
aatcatccactcggtcctcttcgtagcgttcttcacggaaatttcgaaagcgcaaagactcgaattcaacttcactcggcaacattgcttctgccccatagacaaggaaaaaaggtgactggcctgtggcccgactgggtgtagttcgcaaagaccaaagtactgatggcagctgttgcacccatttgccggcatagggtcttagccggtcaaaaacacgcgctttaatcccttgaagtatcatgccattggctcgctccacctgtccattgctcatggggtgtgccactgaggcatagcaaatcttaattccaaagtcttcacaaaagtctttaaaaactccaccggtgaattgtgtgccattatcggtaatgatccgattgggcactccaaatctatgcacaatgttgatgaagaagtctcgagcattatctgctgtgattgtgacaaccggtttagcttcaatccacttggagaatttgtcaatggccacaaagagatgcgtgtaaccgccaactgcctttttaaacgggccaaccatgtcgagcccccaaaccgcaaacggccaagacagcgggatagtctgcaactcttgagctggtagatgaatttgtctggcgaaaaattggcaaccttcacatgtgcgcacaattttgtcggcgtcggacactgcagtaggccagaaaaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcatgagggatgtcacaccccgaagttttcctcccaagtcaaaattgtaatttataattgaccctaagaaaatgctggtgaaatcaggagaaaaccctaagaaagtaatgcaaataataatcggatttgacatgtggaatttttcttgagttctacatgtcaaaattcattaacaggatttttagtggaattttcagagctctagaaataatttttaaccaattaaaaatcactaaagtgcaattgttaattccagggaaaatcctttttccttttcttttcctttttcctctcttttccctcctttttgtcaagtgggccgtcggcccacttctcccttccttcccctcccttactgggccggcccaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgcattccccgcgcccgttcccctccctctcccgctcgcgcccgcgcccgaga

SEQ ID NO: 45780 - DNA, 510 bp, Oryza sativa
ctcgcattgtgaatgtaagtcttctaggtgactgcctttgatgactttattgtctcgttagcaaaactaatccatgaaccaccgtgcagaggatccatcttcgcaatgaggccaagaccacaaccttagaaaagctggttccacatttgggaactcttgaagccgttagggaacagctacacgaggccaaggagcatgccaagaaaacggagaaggaattaagggatcgaattgcacagcttcaggactccaacttcgagctgatggttcatcaaaaggtaatctctagatctgtcccatttgtgctgtcataactggatcctcaaacatttggatttcaaacagcgcaagccaccaggatggctcaaatggagaagcaaatagaagccttgaaaaaagacaaagcagaactggctgcagaaagggactcagccttgaaggaggttgaaggtactgccagctgacaatctgaactttcctctttttaatgcagcaaattcttattataaa

SEQ ID NO: 45781 - DNA, 1501 bp, Oryza sativa; identical to SEQ ID NO: 24893

SEQ ID NO: 45782 - DNA, 375 bp, Oryza sativa
ccccgagcggataactccttacgtttaaacactctgcccgactagtcatagtccccaagcaccgggagtcggtctaggcacttcccaagcatgcatacgagtgacatgagttcgtcattaatggaacaaagtttcacggatcagagtttactactcgggtacttttgcaattgttaagagcagaaaataaattatcttatctctatgcttttgaatttttttgagtaatacttagcacctttactcggtccatccaacgagcccccgggtgctaggaatcggcccgaaggcaaccatccatcgacaaaccaaacggaaagcataggaagatagaactccataactcgataggcacttttgtactcagattatatc

SEQ ID NO: 45783 - DNA, 285 bp, Oryza sativa
attcctgcagccttattatggctaaaaagcagtcggctagaatgcctctttaggcgccgcgtatgcttttgccatctgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttgacatgaaaagtttgaagcactcggactatttttgagatggctacga

SEQ ID NO: 45784 - DNA, 1501 bp, Oryza sativa
tcctggttgtggaacaaggaatcactagcaccctcctccctctctgctctactcttcttcttgcaaatggctgcttctggattcctgtgtcctgcctgatgcttgcttgcttgtgctttgcaaaggattaacgcctagacgtcgtgcattggatctggcaggagtgcaattgaattcctcatgctactcatttcagatgattcagccacctgtagaaaatgttgagtgcatgataaaaaaaaactaaattttcctgttgtttacttgtaaattgggatttgcactacagcaatctacaaaatctacatttttcttatctgttggaatggggcggtgtggatttttggttaatttttccaacggcaggattttagctcgatgatacatcacggcagatgcacttggttctgttcaggaaagattaactatgcattctttatttactgattaatattagtatgctttacattctagcgtgtgaaactgttaatgttagtactgcatttcctttacttggttgtaggattcatgtggtctcacttgtgttgatgttttagcaattataattcagattgccctggatggcatagcatatgaatgatctgagatgtcttatacccctaatatttacatgcaggattatcattacttatttgcgtttgttgcaccgtcatttcatttatgtaggtattgcctcgtgatgaagcaacatttcggtttgtcaatgaagccaacaagaccaagagcggtagttctctgtgtcacaaggtagctgaccattattagatcgaacaatggttttatcaggacctagcatacatattcagacaggtggtctacggcgtggcagcggtgcggtcacaagttccaccacggtgagtgcctttctgcgttcatatctctctgtactgaattgatcttgactagcataattatatgctatcatgtttgtacacactgcaattatttctcatatttttacctccaatcgtatggcagcaggttcatggtagcacatgggtttggtaaatctattccaacgaaaaatggtagtgtttgatcattcccttcgttttgtatagctttggttaaccttctgggtgaggtgcactacaattccttgtatgccattgaagttgagtgcttctgcttttttgtgatatatgggagtgaagaaaaggtttcctacaattcctctacttggcctcagatcaaatgatttgaggggcagaaaacgaaacatgatggtattcagtatcaaagctaagtttttttattctttttgcagtcataaaatttgatggaatactaatgcctgttgcagggtaatttgccctcaatctgaggtattgccatgagtattatcattttctccctgcaaattgcaacaaggtaatttgctgctagaaactttgcgcatctatttttttaggaaaaagtacgaattaccccatcgaactatcgtggtcgtccgaattacccccttgaaccacaaaacaag

SEQ ID NO: 45785 - DNA, 1501 bp, Oryza sativa; identical to SEQ ID NO: 23709

SEQ ID NO: 45786 - DNA, 1501 bp, Oryza sativa
atgggacctcctggatgacatcttcaaggagaaacgcaacacacggagcgatgctgatgtctgtccagatctcaaggggatactatacaaggttttcacccgatggtctcatcaaagagggaaagagacacttccaagagggaaaacgacgcccaaaggcatcgccattgtctgccacaagactgggctagacttttgccttccacccaccccggttgttctacagctactgctccaaagccccgataccaagtagcgactatcaacgtgtagacaccgctgtaccaacgtccccctcccccgttagccagcccctacatgccttcatgtgccaatgctgcaactataactgtatcacgctatcatcgttgcaagcctccaccttagggcgtcatcattgccggtcaccatccccgagcatctagacctcagggggcctggaacttccgacattctttgacagcacaccagaaaaacggtcataactctttgctccggagtccgttttcaacaaagttgggctctgcggaaggcttattgagagggttattgtcgacgggggatacccgtaggccggatatagagggtactggggtacgctggtacgaagatttacgtaatacaacatcaagcagacagaaaacaaagattatactggttcaggccccttgataggtaatagccctaatccagttgatatgggattatatgatggaaaccacagattacagagggaaaaacagaactcgatgataccgacgagatcgtaatcaaacaggttcgattagatctctcgtcgacttggctcctgtaggcttcaactccgtaggctgtggtggatgtgctgactatgagatttgatgccttaggtcctcccggggggtcccttttatatcgcaggtcaactggtctccaagtaggactcggagacatcagacccggcatgatacaatgacgacccagttttgtccgagtaggactccttccatctgtgaactccatgatgaatttccttaacgtataccgaaaacgtccgtatacacgcaagtatatcatatcgatatgtgacgtatatcgtagggtagagggtataccttacccgtaaccctgacagtagcccccgacttctgcataactgaactcgtgtaaccgatcgtgacttctgatgttgaggttgttgtcgttctcggtgtgaggaccgagagacaaggagtaattgacaacgccaagtgaaactcaacagtcatgagtgaatttaaattaaagtccgaaaaactgccgcgcgtaacggacccagaaatttccggcggccatctctctcctttccttggaatccgcaccatcggaagtgcgactatttaagggagttttggggatccattttgaagtccgcctgttgtgaaaaaactctccagcctccaagcgtacctcgtcttctccgctcccgcaaaaaccctagctagctcatctcggtcctttctccggcgatccccggcggcaa

SEQ ID NO: 45787 - DNA, 1501 bp, Oryza sativa; identical to SEQ ID NO: 23711

SEQ ID NO: 45788 - DNA, 1501 bp, Oryza sativa
gtttgctgtacgattcaccagtagtcaccacgcttcatcgctgtggctgtgcagtgtaggacgtgcccgtcttttcgctggcataatcgatagcctgtgttagcctgtggtgtgacaagccagtgtggaggtaaaaaagtaccgggttgtttgggctttggacaccaacacgtgctctatgagcatcgtgctgttacttgcgtaggggccgtcggctgttacaccgaagagcaacggccaatctgtggcaggttgagttgacttaagcgagtgatttctaatccagctttctgtagcatggagtatttctgcagcaacctagcagggtcggtccatttccaacaccatgttgaagctatgtcatggcacaatcatcgatcttaataaaacgttactccctcagtctatagcctcattgtttattagtaaaaaaataatttataagtacatattttctatgcgtgttcttagtgactaaaaacaaatattgtaaaataaacttctttaaaaaattaaaattaagttctaaattttaaattttgacttataagtataaacataaacaaaacaatgaggcttctaatgtggaatggtaggttgctatattttgaaatggagggaatataacctaaataaatattattatatcatgtttttgctataaactttgtgcttttaaatcatcaaaaaacattcaaattcattgcgtggttttcatggtttgccgggtgacaaggcaacttgggctgcatccctactccttagcttaaatagccattgaaaatgcatttcaaagcttcaaaaacaaaaagataacaaagataaaattgtgccctacggttggaaaaaattctggctccaccatggctggaggtggatccacccatgctatggcaaaatacgcttcccacattcaaaacggatgcaagtgagacagggttgcgatttgcatatacaccgtacaagtttttccttgttttagtacggagtagaaaataaactagcatgcagggtttttgatgtgggataatgtgctgctcgcttgcatccctagctactcaaaacaattgattaggccataaatcagtacacggactgatcaaatattatagattatgaagttagatagcttagaaagaagttatctgtagcgcccgttccgtcgtggcgcctagcgggaaaattatctcttaaaaaccctaattgcgaaatttatttctttgcttgttgtctagtgtccatgccatctcaagatctcaaatccccgatctatcgtcgagttcaattccgaatccaaaaccttccaaatcaaatccctccgcaaaagtctattttgcctcccccggggtcgatgggctgaattttctctcggcccatctccccctccctcccccggcgctctccctctctctctctccccctccgctccgcccgcgcgccgcgcgcgcgtgcgcgcgagcaccgcgccgagcgcccctcctcccctcctcgctctccttct

SEQ ID NO: 45789 - DNA, 608 bp, Oryza sativa
attcctgcagccttattatggctaaaaagcagtcggctagaatgcctctttaggcgccgcgtatgcttttgccatctgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttgacatgaaaagtttgaagcactcggactatttttgagatggctacgatggctgactgcaaaggtctcgggggctactgtggagattatggatatcccatatctacacggcgatggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactcctccccatatataaggggggtccgggtgcctctaggggcagatgttgattttccctaaatcatacaatcaataatacac

SEQ ID NO: 45790 - DNA, 1269 bp, Oryza sativa
aaaaatataaatctatttagaaattaaatttaatcagcaaaaattatggaattgagtaaaaacaatgaactcaaagcattacgaaattatgagaagtaatttaatcaaatctaaaagtagtttttatataagataaaagtaacttacctatataataaaagtaatttacaatataaatgttttttcatcataatattatcatgtaagatcttgttataaagatttaattgcaacggacacaatggtgtaatcggattatatatcggataagtaatttaagagaaaattttataagaagaaaaaaaatatgcacaacctaatagcaaaaactacttgcatgcatgtctgtaacgctactagtacttctcacgtaattgtccgcgtcgctcgttaagtctaaatcgagatgcctctcgaaatagattttgcgtaaattattccctcctccgttctaaaatattttaatacagaagtagtatttagcgtgttaggtaagctgcttaaaaaaattatgtagttataatttattttggtatgagttgttttatcacttaaggtatttaaaatttttgaataagacgaatgatcaaacataaacatgtgttcaaaagtcaatggtgtcatcgattaaaaaccagagagagtagatttcaggacagagggagtattaaattagacacgtgtttgttatcattttttttgaaacagttgacggtaagatttctaccggatatattagaagaaaagagtttttacctaaagggggagagagttcacaaggcaacacctccaaggaggaaacagcacccgcatacatcgatgtcaccgatcctgtaagaccagacaaggatttcacccaagactgtcgccgatcctgtaagaccaggcaagaatttcacctaagactaccttaaaacgtgtagaaccttcaagaaacaagagcaaaagtgttgagtgttatcgttgcccaactcatcggctgacccgatgcagcagctccgactccgccttaacacgaaagctcaagcaccgtagagaaaagcacaccgctccaaactcggcactaagacagatccacacagtcacagggctcttatgcctcgccagtgctttgttatcattttgtaccatgtcttttgggcctacggtgtacattactacatgtggagcgattagcagcagccatttcgtagttagaatagaagaacacactcttgaggctatcagcaaccagctccactgctagctccaggccggtcatggcggcgg

SEQ ID NO: 45791 - DNA, 410 bp, Oryza sativa
attcctgcagcccaatatatcttacttaaatatgaaaagtaaatatcatcaagaaataacaaaacacttactcgtattaaggcaaacgtctgtagaggtacaagctaggataagagtgccaacagacccaacacttccccaggagaagagtgctgatagccctagcaattctctagacttcctctatctccctactctaggcactagctaagtagagcttcacttttagaatgaatcatatgatcttctatcttggtgtgtcttgagaatgagagtgtcaaagtgacttgagagagagtggagatgctaagagaatattctccctctatctcctctcaagcctccacctctcctcaaaccatcattcgatggtggtttcctgccttaagccttgcgccactgacttaagg

SEQ ID NO: 45792 - DNA, 594 bp, Oryza sativa
attcctgcagcccaaattttatttgtaaacaaaacaatctcgcaattaggatcaacatgttcaaggaatagtgatgacttgccttgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaatcatgctaggggctaaggtttcttaatctttctattgtcaacgtggcctatttaggagttaaccaacatagcatttatgggatacatatatatttggctaatcggtggtttagtctatcaaatagcttatggaaggattatggctaagcatgcatctatctaaataggacggttatatactagaggttctgttgttagatggatttaggatcattcaaataattacagtgaatcatttgtattatttattttattgatggaagctttactttaattatgaacatattttacttgtcacaataaattataaaaggttaataattatcca

SEQ ID NO: 45793 - DNA, 1501 bp, Oryza sativa
ctggccttccgggactatgtaagattctgctgttacacggtgttttttgcttctatcgactactggaattggtgtttcccttttgctttgcttgtgccattttcttctaagtgttacatgggttatcattgctgtcatggctcttaggtgatgtatcgatgaatcgaaaggcgttgcttgtcgaatatatcaactttagtttagtttagtggatgaattttaatagaaggggcttaaggtttcattggattggagtgcctagtgagttcattcataatcgatgtcactccatggacacttgtggtggtagaggacatgttcttgaacaatatatgctattacgggcaattattttgaactaaatatgaagatgccatatttagagatggcatgttggtatttgtgaattatactagttcaaatagtttgccatacattctacctttgatacaaaacagtgcaaccctctagttggttccatcttaagaggaacagaaactaaataaagaaatagccataatggtgttcgcttacttaacccctgaaatcctgaattagaaaaaaaaactaaataaccccctaaggtgcttacgtggaacaccacggaactgaaacaattctctcttttttttttctttcatttgccttctcttatcctacttttctattcaccccttttctctctgatatagcagctttagaatttgattacaacttactagctaaatcctagctttttagggataaaacaaaatgttacataatattatttcctgaaataaacaacattaatttgttttttactatatgtagtgctcgccttgattatttatgtggcaacccaataacattgctgcaatatgaagaggtgtggtggcagattcattgccacaaccaccatcgcatctttcaaatggagtatagatttgttgaagcattgacacattagctgctatggtggcaaaaggcatgtgtaaaaccttatcgggtttatttagatggtattagatagttcatggggttatctagacactttcgcagtcagagggctaagtagatcaaccctgacagctaagtggtagcttggactggaaactttttttgcatgtaataagtcctgtaaacaatgttaaccaatcgaaaagatatcagtttatctcttggtgtacttaatatatttacatttcatatcgtgagatattagcaattcataaagtgtgagtgaaactaaacagagaatgtgaagaacaaagaaattcatctagtctaactgtagagcatgctactgttgtttaattcgggcctttcacccatcatgtacaatcacacctgtcagtttcttggctgctctttcttcaataattccttgcgggtatgttggtcgggatgtcaattagcaatctcaatgtgtactctgaaaattaatgtatattcagtacatattctttgatgaaccatttgtacatatttcactttacattagaatgttgcctagtatcta

SEQ ID NO: 45794 - DNA, 366 bp, Oryza sativa
agctacttgtcatcttgcccttgtagccttaaacaaaatcctgtttagttagtggctgatcataatggggactagtataatagacatgcttaaccctatcttcttcgccctatgtgctttccatcagattcttctactgacaaagttggtcacctttccatgcgtgcaaaatcaagattgtttcaatcgccttttctgggactgtgtagtagtggtcattgcagcaagcatatatacttgcatttggttaagtccaagaaggaacaggcaggacccaacttttgccacgtttgaccgggacatttgggatgccatggatcacaagctgttgttctgatgtgaccataattttgatgttgtttaagt

SEQ ID NO: 45795 - DNA, 384 bp, Oryza sativa
gcagctcctctccccaccgccattgcgtcgcccgtcgtcggccgccgacgccctcctcctcttccgcctcgcactgctggcctcgcagagaagggagagagagagagatgagaagggtgagaagaggggaaaagagagaggaagctgatgtggcaatgctgacacgtgggtcccacactgactcagccgccacataggataaaaccggcggtcaaaaccaccgaaggatctaaaatgaacggttttgtaagttgagggacgccggatatctggttttgtggttgggggacaattttgtaactcgatgacaagttaagggaccttcggtgtactttttcctatattatgtatgggtttggcccaagtttgttgcttgggtcacaa

SEQ ID NO: 45796 - DNA, 1501 bp, Oryza sativa
acatctagtggcccccgttttttacaagtctgatagcccattcggacttcaaaatcattcttattacctcatctgaattatctctcattttttctgcaatgatttaagctgtctatgatagagtaattttgcttctctctaaaagatagctttgtcgtatttacaaaaggagacatgggttgtcgtgattgtaatttattcgattttctttggaaaaaaaacttaattcagagaacgataaaaaatatatgagttaaatataacaacatactgatcctagcctcctacaaaacacacatgctcgtgtgagtgtacatctacctgtattgtgttgcacatagctagctagtataaaattgtgaatataaaaaacttttctatagattaccttttaaagaaagaaagtatggaggcaaaacaggagttcgatcataattaagtatcataacctcatggaggatgacgcagatcgacgtacggttgaaccggtgcactgtacagttgcgtgtaaatatgtacgctaaggaattttatgcacatattaaatttttgtaatccgttttcaaaaaagaaaatgtaacccgattattttagagagagggagagagagatagagagatcacggggcatatcatggtgaaatgatttggtcagttcgcgttgggccctacatggaacaaagctacaactagtttagtaattagagagagggtccattctatttaatatcctcattgttgcaactggaaaacgactctttgtatggatctaaacttacgcgtccaagcactggaaactattcagctgaagaattttatagaccaggtatgctgctctgcagcgcgtagacacacacacacacacactaacaattcgaccaaattgattgatagatggcacttgtgacatataagttgcttataatagaatagtaggcttacacttcgaatatttccatttgttcttaatttgccatagaataagagtgcatttgtttaaagttaatcaagcaaatcatcttcttagttaattacccaatgtcgttatgattttttaaggctatctacataaccatatcctcgatatgcctttagttaagtgcatgttaatttgcgtgccaatgtcggtctgtgtcattgctagttgttggaaaccatcgggataaaattccaatagttatacattactacatctgtctcatagctaaaaatagatacattttagaatgaaggtaataagatttcttcactacctgtgttaatatcggtggtgctgccactactttatagcaattagatccaaaacaagaattcagatataggatcataaagtggtagaactactgcagaaacttttattggttctgcttattaaccagttgtaggcgttggtttctcagtcggaaccaatttaagagtactaatgcctaatagcataggtgccggtttaaaatacgatacttataaaactataagtaccggttattatactacaaccatca

SEQ ID NO: 45797 - DNA, 993 bp, Oryza sativa
ctgtgtgtttttctgatcattccatggcactcattcagtcactactgatctgttactctgatctgttattcctgtctctgcttgcatggtagtttgaagctagtacttgtactggcttcattccaatcattgtttagggtatatgtcactaaattccatgtgtcctgtgcatgagctagcatagctgtcatgctcggagaaagaggggcttatactgctaatttgtttttcttatccttggagtcttgtagtatttttgtaacaccaaattgggatcagaaatactccattcaactaactaaggtactctgtatgcagcaggctaaacaaatactagtgccttgtactcgcccgttgggcactaatattggtgatactttgccgacaagtacgatacaagtacaatgcattttattccggattcaggtttcagacactagataatagatacataagccgtgatactgacatagtgccatatccaaatctccctgtttaaggtatatttagacttgaaacatacacgcatcggagtttggattaggccgtaatccattccgattatattcgagagcataataatttatttattcataacttcgtttcgctatgaggttagactgtaaatctgtagtaattcatagatttagttcggaccaagcaagatgcctgagccacaagtatttgggctgccacggcccagtttctcctgacatgataagggcctagcagtaaggctcacaccacttgggcatctcaattcggcctggtaactgtgtggccgtgtggaccacacagttaccacgggtggcgatatgggctgcagcgatcggagcaacggcgacttggcgggatcacaaatcacaatcgaaacgtgataaacagcccactggaaccgtggcccggcacgtcgcacgcgtgacgcgtgggggggtgctcgtctcgcctcctccgccgttcgccgcggccgcgccgcgggagggttgggtatca

SEQ ID NO: 45798 - DNA, 1501 bp, Oryza sativa
taaaggcaaattttgctacaggacatcgcaattgtgtggttttaacccagggacaccgcaaaaacaaaggtttgggcaaaaacaaagctttgccgatggacaccgtgccgtctaaatgaaacttgccgtgctgacatggcaagcggagcccttttttgacgtggtcggaccgaaatgcccctgcgccttatctccgccaccgctgctggcacgagcggcgtgaggtcctcccggtcaaccgagacgtcggcggtgaaggagagcttcttcttcttcttgccgttgctgctgctccactgcacgcgggtggataggcggaggcggaggatgctgccggctcggtgcgttcttggggaggtggaaggggatagtgatgggtgggtggcatggtggttgcagtggtcgcagctccactggtagtcgccaagcttgatgcggaacgcgacctgcgtgtcgttcttctcctcgaggaggatcaagtaccgcgtcgagaggaccggccgtttgccggcggcgcggcgccaaccgcagaggcacaacggcgagcgggtcggcttcttggcggacacgacaccgatgatcaccaccacggggaaccgcgtctgctcatgctcggacgcttggaacgccgtgccgcgcaggaggtcggtgtcgacggcgtcggcgtcgcagcgatacacggcgtggatcctatcgacgcactggtggtcggggacgaggcgggcgcggctgtcgctaagcgcgaacgagcaacggcactcatcagccttggtgtccacagacgacgccggggacggtctcccacatcatcgcgccaccgccactgcccccgccaccaccactacccccatggcgaggagccagtgacaccgtcccgccgagggacgggtcccagcggaggaggaagtgggggccgacgaggaagtcgtgggtgctgtgggcgagaggcgagaaggagagcggcggcgcggcatcccggtgccggagggaggacgacggcacggctatcgaggaatgggttgttgaggcggacgtggtcctccttggtagtctgagttaacgagagaaaagaggctaggggtaggggaggaaataggaataaatatgtgggctacgtgggctgggacatcctgttgtgggctggagtgtctccacccggttacttcggattttgaagagcccagctacgagtatcccccattggaaaatgggtgtctcatgaaggcggtgtttagttccacatcaaaattgaaagtttgactaaaattgaaagtttgaaaaaaaatgaaagtttatgtgtgtaggaaagttttgatatgatggaaaagtttaagggtgtgtttagttgactctaaaattaaaaatttggttgaaattggaacgatgtgatggaaaagttgaaaatttatgtgtgtagaaaatttttgatgtgatagaaaaattaaaagtttaaagaaaaattttgcaactaaacacggcctaaagtttaaagaaaaagttt

SEQ ID NO: 45799 - DNA, 1348 bp, Oryza sativa
ttgtggctaccagtacagccaaagagaattttgatatatagcttatcacatctctaattctttccagggcggtgagtttgccgcttccctagcacgggcggagccccagaaagccagcctccttcctcccctttctcttcctctcctctgtacgtccaatcgactacgagatgccctcatgccgcatgtctttcttgcaagtcatccacggtcatttctccaagtccagtgaaaccctcttttttccccttctccaacgcctcccctaactctcatatctaaactctaaatctagcatcacagtcgttgtcgttaccgtagccagagacagagaagactctattatcgtcacgaaacttagcatgaattatacaataaacaaatttaactgcaaactagggaaatttcccgatgcaatcttatgtgtcctagttaaattggacaattagctcatgtttttatatatgctatactttataaacgtagatgttaatagtagaattagaatttaatgtacaactatcttcttcagtttctattgcctttgtatacaactattgctattaacatacattgttataatttggtcctaacacgatctaacagcttagattttattttaaaattattgtggtaatttttctaaaccacgaagatagcatgggggcttcttttcaagctagtataaaagtctatatagatagatagataaatagatagatagacagatagacagacaaatagatagattaagggttggtttggtttgtagtctaaatatagattttaccaaattttatcaagttttggtatgactaattttggtaaggcaaagttgtgcttggattgaagccaaaattgtctaagttcactattcaaatggcctattttcttaggcatgccaaaatttggcgtcaaaccaaatatacactaaacactattgaaattgccaaatattggtaagcctaatttagacctcgaaccaaaccagccctaagattttaggtgattgaaatttagcaatttccaaataatatactccctccaggctgataatattagtcgttttgaacaagggtaaagtcaaactttaaaatctttgactacgaataatttctaaaatatttatcttaaaaatatgaaaaccaatgtgtagattagtcttagaaagtacttcaataaaatcatatatttgttgaaatttctatatattttataatagaaattagttgtcaaagttactttttgaagaccaggttttccaaaacgcctaatattatcaacccggagggagtaataagaagactacgtgggtttcctgtgaaatgagtattgaccgcagattgca

SEQ ID NO: 45800 - DNA, 1501 bp, Oryza sativa
ccagccgctcctcccacgtcaaggtcgacatgttaggtatgctctctctctctctctctctctctttttgctcgcggcttccggatgtttctcaggtgatagggtttaggattacccccaacgttttatttttgtaaagaaaataggggattgctcgatgttgtctgtctatgtagcagtatgatttctggtctggaatgcatgccatagttgttctagatttattttagataatgagtagttgactctagtagtttagttagccttgcaacgatctctgattgattcagagttctgtgcctgaaattccttgttggctatttatccttttctgggtgtttgttgtttcaaatagtttccaagtatttcttttgagagaagaacttgagattttgtgggaagcaaatgcttttgattagtgcctacaaattgacgctaatgtttcctttgttttgcaaaggaaagcgcatgtacaatcctcatgtatttttattaatttttcccttacagaggtcgagaaggtggtggacaaaatccaaggaaatgttccaaaagttgaatgggacttcgaaggaattcactattttgacgatggccccctcactgtccagtacctcttcgtcctggatgctctgaacttctgcttctggccaggtataagttctagcaatgctgcatcgtttcgaacatgtaaaagttagtcgtactcgtacctaaggatatacaaaataggaccaacaggtatcaagtatcaaccactgtaattatctgatttcaattcttttactcctgtatcaactatagcctttccagattgtgtactagtggttctgtaatctccatgaattataggtgtactaggctactactagcttccagtgacctgaaattgatgttcttactattaagctgcagtatagcctttttcatttctatgtttgtttcttgtagaaccatgatcagtaatatcataatgtttgtaactgaaacagataaggatctgagctatgaccatttggcttctggactaaagttagccttagagaaagataagacagcccttgatgcagatcgtctccagagttacactggtaacttttcttctatacggacatcttgcattatataacaagtatattttatggtttttattgacatcagtatactgaaatatgggattattgtaccagttgtggtgacatggaatcaatagttatacattatgatagcctgcatatggtgcaactttagatcttctcaggccccttattcacgctctacatccttctatcataaaaaagttatgccctctatctcaaaatatagcaacttctccacctacttcctcatctcaactaatcacaacaatatatcatttagtttcacctctccttaatctcactgaaagactctagaagtgcttatattttgggacagtgggaggtattctttttttattagctgagatgcattttgaatactctgtaagtatctcttaaac

SEQ ID NO: 45801 - DNA, 237 bp, Oryza sativa
aaaagcatgcattaaagttactttctttttgttataagttacttctataatatatataaattacttttaggctttattaaatttacttttatatgtctaagaagtgatacggcctggccaaggccattcacatgtaatgtgattgttgcacatcaatgcaaggttaacgctatgcttaactacaaatcttattgttttcatcgagcaaggctgctacttggcttgtatgattgtagg

SEQ ID NO: 45802 - DNA, 351 bp, Oryza sativa
tgttctgcaggtcaaaatctctgtttggaaaagccactcggatcacattaaggcatgagtcatcctaccatgtaggaaagaaaagaagtacatcatgaaaataagcccttttcaagggtctcttctctcagtcacacaatagtttgttttgccatccaaattcatgggatctccgatcacaatggacaggtttccactattgtgcaaccttaggtgggtatcaagcccatttccctcgatgcactgtctatcacattacgtggtagccccttgataaactgatctgccagatttctagccgtttggacatagtccaatgctatcactccggagtttttctgctttctgaca

SEQ ID NO: 45803 - DNA, 262 bp, Oryza sativa
attcctgcagcccgatctgtacagccgggtatggttgttcaggatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctca

SEQ ID NO: 45804 - DNA, 1501 bp, Oryza sativa
ctacagagggtaagagagcggaacgaaccaggccacatggggctaatctcggagaaccatccagggatgacggcagagatacccgcctgctcgccggcaccggccgccgccgcgtcaccgctctcccgcgccctcttcgccgccgcctcggcctccatccgagaacctatccacgcacaagaggcacatagagcatcgccatgtaagcactaccaccttaaagaaaaaaaaaagatgccgcggcgagccgcccctggaggctaaacacgacggctttagacggagaagaggagggatgaaggggagcaggcatccagacctagagcacggcgaggcaacggagacggtggcgagctcggtggctggcggcgggttgggggagagacgggaggagcgctcacagccgcggccttgagattagggttttctcccctgtctctcttctgtggctttttgggggttttgggctgcaagtcgcatcaataatacgagaggtcggccgagcgacatattcccaagcaggggaacacttggtagccaggcaagaggcgtccatgacatgtggggacattttggcgtgggtcccacttgtcaggctatgggtggagggcgtttggctctatctgcgcgctggcgactgggctgaaatttttttgagaattaatattatttttatggaaaatcgcaaaagtagtggccaaccggggaaaatcacgaaagtaggtccctgtcgaacgggtgcaattcgatagggcacctatcgaacgacgggcagtcgacaaagccctgtcgaacggctggcgttcgacacgctcacctatcgaacggagggagttcgacagggcccaccacccggcgccgcgaggcctgtcgaaccgggggcgttcgacagggccctccaccgaccctgtcgaacaatgggcgttcgacaggccggtttaaagccccgtccacctaggccgcgagttcgatttgttttgaggaccacatcgccagccgccgccgagagtcgccacatcgtcgccgtgagcgccggagggagcgaggagaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggtaatatagtataagttgtaatagggtaattatcgaatgattaaatgattaaacgtgagactatttgtcatgttttatcagga

SEQ ID NO: 45805 - DNA, 382 bp, Oryza sativa
taattcctgcagcccttcagttgtggtctgatgtagctcatttcctaggtggaagttcaacttaacagtctccaccaaaaccctggtatatcaaataggcacaaccttgagaacatttcttatgagccttgaaatttggtggggattgttagaataattgggctaggcccaatttatcctattaaatctcaaaggcccataataagtgttaaggataataataccacctcaggatttaagcgaggaatatcttaacctaaatagggagttattggaggccccctgttgactggttgaggtgggggtcggaaagccacacgcgcgcgcgcgccgggccgaggccgagggctaggcgtggcgtggcgctacacttttgcaacca

SEQ ID NO: 45806 - DNA, 675 bp, Oryza sativa
gttgctcggtagtcaagttgtctagccgtaggtgcatccctaaattcctaccggtctatcgtttgtcgtaccggggcttttctgtgaatcgtttctagtccaccggattagccgcagccgttgttgagtcgttcgctcgttcgttcgaatgaggtgttccccgtgcttcgttcgttcgtccgtgttgagtcgtcctttagttcagagccgccggttccgttcgccggtttcggttgatcatttaggtgatcccgtgtcacgtagaattgactcgttgagtcggtatctcgtgaggcccgcttgccagatcaatccaagccatccgatcttagtcgactcggtcaatataaatcctctcctcttttcagtggcatattatttctttttaatatatgtcatctaccaaatatgatccaatcttttccggaggttgctttaatcttctgtctcagctataaatcatttgtaaatgatttaattaatttggaatagtctccgtttaataggtttaattggaattaaatcttgtaaaattcataataaattcatatgaaatcagaatgaggccgttcaagtctcataattcatctaaaaatatgatctacatgtttgtttactttttatgtattgtttatttggtttttattagtctttttcctcgttttgcgtgatagc

SEQ ID NO: 45807 - DNA, 1501 bp, Oryza sativa
atattatacaaccaccctaacacgtcattcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactatattaccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctctcctcgctccctccggcgctcacggcgacgatgtggcgactctcggcggcggctggcgatgtggtcctcaaaacaaatcgaactcgcggcctaggtggacggggctttaaaccggcctgtcgaacgcccattgttcgacagggtcggtggagggccctgtcgaacgcccccggttcgacaggcctcgcggcgccgggtggtgggccctgtcgaactccctccgttcgataggtgagcgtgtcgaacgccagccgttcgacagggctttgtcgactgcccgtcgttcgataggtgccctatcgaattgcacccgttcgacagggacctactttcgtgattttccccggttggccactacttttgcgattttccataaaaataatattaattctcaaaaaaatttcagcccagtcgccagcgcgcagatagagccaaacgccctccacccatagcctgacaagtgggacccacgccaaaatgtccccacatgtcatggacgcctcttgcctggctaccaagtgttcccctgcttgggaatatgtcgctcggccgacctctcgtattattgatgcgacttgcagcccaaaacccccaaaaagccacagaagagagacaggggagaaaaccctaatctcaaggccgcggctgtgagcgctcctcccgtctctcccccaacccgccgccagccaccgagctcgccaccgtctccgttgcctcgccgtgctctaggtctggatgcctgctccccttcatccctcctcttctccgtctaaagccgtcgtgtttagcctccaggggcggctcgccgcggcatcttttttttttctttaaggtggtagtgcttacatggcgatgctctatgtgcctcttgtgcgtggataggttctcgga

SEQ ID NO: 45808 - DNA, 206 bp, Oryza sativa
tattaaaataattagtctcctaaactacacctaacattgatattgatcaaattacggttttgggcataagttttaaattattgtgaactatctataaattgtggtcacatagaccaaaacactagctttcaagtttacactaatggcctggaattggtgtaatggtgtgcacaagcatacaatatcttttgtgaatctctctgctc

SEQ ID NO: 45809 - DNA, 400 bp, Oryza sativa
tgggcagcatcaacaatatcaattttaggatgctgagaggtgcagcttttgaccgatgatggatagagtggaagaaacatttattccatcaaccggcttccatgtacttgacaaatcttttccctaaagctgtccctcaagtaagaatcatttcttttgtcaattttgttaactgcaaaccgatgtatcagttttaaccttatgtaaattcttcttttgcagacaacagaatcttctcctcctcatcacagcaacagcggtgtagacatccaatatgctccaggactcctgccaacggtggtggactaacacctctagttatcggctacaatgccccctaagacctccacattgctgcatggcctgcctcgtgtgccgattgctcctgctgctggaaaga

SEQ ID NO: 45810 - DNA, 386 bp, Oryza sativa
acttttgcaattattaagagcagaaaataaattatattatctctaggcttgtgatttcttccgagtaatacttagcaccttgcgttactcggtccatccaacgagcccccgggtgttaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtga

SEQ ID NO: 45811 - DNA, 417 bp, Oryza sativa
aatctaaagcaatgaaaacatttgaccaatgtgaaggcttcgaacttcaggagtagcctgaacagtaaaaaacatttgcatacttcaaaaagctctactaagattatataaggcatattatcacatccgcaattgtatataattttactatcaccatctgtaatttttgacacgaaaatatttacagagttatgtacaaaagcttaaaaggaatttttttctttaatttacagagttatttaccaattcatatccataattatgggatggaaggttccatttgtacaacctacaaaatgcacaaatggttcatgaagtatttcatgtaatataaatgagcatttagatatgtggaatctgatatggaacctttggtggctataacttaactgaccaagtgaacttcacctcaaaatc

SEQ ID NO: 45812 - DNA, 157 bp, Oryza sativa
ttaggaaaaaccgtactattaaaaggggttccaggtgatgctctgagatatatcaagtgctcttagtgtgaaccaagtgtcaagtttccctaggagtcatttttgcaaatactccatttgtccaaaaatgcaagtccggaacttactgtcttccagg

SEQ ID NO: 45813 - DNA, 439 bp, Oryza sativa
aaagaaggaaaacagatgctcaggaactaagctttattatataggaatttaaactgcaattgttcggatctgaattaaaacacttaaaaagcaagcaaaaatccttattaagacagccatatcataggcgcatgatatcgaccgtcgactgaccccaagcaagcaacctaaacacacaaactaacaagcagaaactagacagtcgataaactaatggaaagcgagcctaatgctcggaacggctcctgcggtcggtggagtcgaaggcgtcctcctgctcgtcaccaggtccctctgagcgactcctggagcctggcagataagtctcgccgccgcccggctctgagccactggagctactgctgctgagatcgcggctgccactgggagtagcagacaaccaacctccgttgccactggctggacccctggcggctga

SEQ ID NO: 45814 - DNA, 1002 bp, Oryza sativa
cgcgtgcgtccacgccgtcccaaattctctcgtgcgagcacttcgcccttgcttttaattaccccgattaccccgatatggtagttaaaatttgcttggttttgataaaaatttatatggggatcaatatggaatagacgaagtatattctaaacaatactatcatgtgggcaatttatatttatccgtaacaaagcataactatttagtaagttgtacaaaatctgatttctacccatacttatttttgcaaatataggctgtgttcggtggtgggtgttgggaacccatcacccacgcatgaaaaacggagcggtccattaacgcgtgattaattaagtattagtttttttttccaaaaatggatcaatatgattttttaagcaacttttgtatataaactttttacaaaaaatacaccgtttagtagtttgaaaagcgtgcgcgcggaaaacgagaggggagttgggaattcctgtatcaaacacaaccataagagcaagtttaatggtctatttgatgagcttctaactgctgcagcttctcatagaatcagaagctccccaaacagtccagcttttgatccaaattatgagaagatatagttatataatccagaaaatgaactagaagccagaagctcagaaacccagcttttccagtttctcagaagctggcttccaactagctgctttttataatcttaagctcctccaaataggctctaatactatagacaacaactattagcttcaagttatctataatcaatctaatagccaattcatacaatagttaactacaaatatatactacatcattaataattggtcccacatgtcatacacacgtaacgtttcagagttcgtgctgcagctggctacaaatttgtaacccgttttttttctttctcctctcttgtcttctccatataagtttatagctgacttatagtctattattgtacttgctttaaggtgtaatttaacttcaagaaaagta

SEQ ID NO: 45815 - DNA, 246 bp, Oryza sativa
ttatcgacattttgggtataatctcattctaccatgccattaacagagtagttaagcatttatttgttttatggttaactttctgttatcagtagactatttatcgaatatgtcaatgggacatgggatttcatatcctaaaactctctgttagcagtagactatttatcgaatatgtaaaagaacctacagctatcactgtctttgtgagttacatgtgtccttttcttgtgtgatatttctagt

SEQ ID NO: 45816 - DNA, 861 bp, Oryza sativa
tgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactccctcctttcacttgtctttaga

SEQ ID NO: 45817 - DNA, 289 bp, Oryza sativa
tcgtttatattattagcggtttaaaggcttgttttcatatcaaggataaaagtgtaatacgtagaacgatttgccttgtttcttcactgcaaaatccaacatattttaaattctagttgctgtattcctgacgcaaagtaaatactcatcgctttaccagaatagatttgaatccataatctacctctaccagagaatgaatctaaaatccatccatccaaacaagccagccatagatcaacgcacacagcaaagctatagccaaggaagaaatgaagtagagcgaaaa

SEQ ID NO: 45818 - DNA, 180 bp, Oryza sativa
tatgtccgctcacccctccaaggtacatctccccgctacgtaaaaaaaccggtgtacactctaaaagatccatcaaccatgaaatgacctgctatcaatttttgaaaggaacttaatgtcgcctagaggggggtaaaataggtgttcctaaaaattatcacaacttcatatcatattaga

SEQ ID NO: 45819 - DNA, 930 bp, Oryza sativa
ttggtctgtgtgccaagatgaaatatgactatcaaaagtagatggagggagtattaaatactccttccatttcatattataagtcgctttgactttttcctttgtcaaacttttttaaagtttgaccaagtttgtagaaaaatatagcaacatttccaacacaaaagcaaacatattatcaaaatatattcaatgttacatttaataaactaatttggtgttgtagatgctgctacattttcctataaacttggtcagatgtaaagaagtttgattaggaaaaaagtcaaagcgatttataatatggaacggagggagtatcaagtttcttgggtgccaagcatgagatgtacccccctccatccttatttagatgatgttttagggtattggttttgtttttgaatagctttttatgttttgtaggtattatgttcccaaattacccctaataaaagtagtaggtatattgctccaatgaactcatttatttctaaccactagcatatttcgtctagagcttggcttggctgtaacacgaccactagcacaatcctgttcagccacgcaccatgtctacttgtgatgaaattgaacaagctggactagcatagtaatgtggacagctcagtagaaataaagtatattaattaggggtaagacagtctcaagtaacacaattgaacatcaccctagcctgtgtgtttggcccaagatgacaagtaattcaatggagggagtagcaaacttgacttgaatccacatttcacgtcaaagttgcctgaattcgtatagcggtttcaactatatttacaacttaccgttatccactataaggtcagtactgagacaattatgccaaaaccagattgatcaatacataagagggaagataaacccctagttgtcgtttgctctatcatgcatgca

SEQ ID NO: 45820 - DNA, 275 bp, Oryza sativa
tatcggagggtcattcggacagtggccattgcaaatctccacccattaatgaaggaatgacagggtgatcccctgtgtcaggcgagtgacggcgctgggcctcactcaaggacaagctatgattttgcttttaggcgaagatgcgagccaagttttggtcaagatagggtgggtccccacccaaaagaagagtaggtagaagtggtgcatgtggtatccccttgagatataaaaggaggaccttgcccaccgaggatgggaggccagaaccagaa

SEQ ID NO: 45821 - DNA, 808 bp, Oryza sativa
aatcacacgatatccggatgaaatagtgaaccttctgggttgcaaattgcaattcgcaaagtgttcattgttcaaggcaaatgagaatttatgtggttatgttttttttagttttgttcatcgttcatatcttgtctcgactgtatcttccatatataaatagtgattggctatgtgtcttgtgtgtcattgttacacatatggagatgaagacaacattctttagaataacagttctttggcacgcacgctctctctccctctctctacttcactgctggtctatctagcattagtaaagggcttgtaagagttgtggacttgtggttacgtgggagcaaatctagttcgagatcgaggcatgaacttaccgatgtcttttcaacggttccacggactcatccttcaggtcggatgattactgtgatcttaaaaagccacggtgcaatgattcttcatattttgttcagatctctgcctattcttctcttccaccggcgacaagatcgatagggatgtggaaatatattggatgtggttttaatttggttttaatattctttttagacatagtatgttctgtactacctcttgttttacataatacaagtcagatataaaatgttctagggtgtttttgtccaaaaaaaaaagaaaataaagaaacaaaaacatatggccatatgttatgtgacacactgacactgttgaattcggcccagcccaaaaaggtgaggtgatgggaagtgaggaaccccgcgccgcgcgcacgccacccgcgtcctatccattccacggttcgtttcca

SEQ ID NO: 45822 - DNA, 469 bp, Oryza sativa
tgttacggaagggcctctggatcacacgataagtggtgtactaaacctcataacataagtacataacatcctaagtgaagatttgagttattgatttacaactgaagctgactgcccaaaccttttaacaaatccctttgtccggtactttgtaacgaggattaactgttaatggcagtaaaacaaggacgaatcctacaaattgacaagaaggggcttttttgctgccaattcagatatcgatttgcgccttagtcctgtcatccccgaatcgtaagatttaaactaaaacaaggccgctaagagccgagacacgcgggaagcaatgcaagcaatccacccaatatgagtacggaacagctgcgcagcaatccacaaaccagaaggcggcggcggcggcggcggcggcggagcgcctcgatcccacccgcaacgccatgaaccctcgcgcctcggctaactaactagg

SEQ ID NO: 45823 - DNA, 327 bp, Oryza sativa
caacctccgctcctcctctcgtctcatcgcaccaactcggtcaaatggcccagagggatccgggtcaatggggccctcccctcctctccctctccctcgtataaaaccaaccaaccaccaccctcctctctctccttgctcacgaaaaagctcccacaaagcatcacctgcaaccagcccccgctcatctccatcttcctcctccctccctcgctcctgtgcttcttctcttcatcaacaagagagctttccctcgatctgtgtgtgtatatatatagagagagagggactgatctgggtgtagcgagctaggtagcctagctagca

SEQ ID NO: 45824 - DNA, 172 bp, Oryza sativa
ctgatagccagcttgatggtttctaagtaagttccaaagttttttccacataaattctttggtagatctattatatataaaagttagttttttctacggtgttgatagaattatttttttaagagttgtttctttctttgttggtgcctacttatttgtcacgttttatagt

SEQ ID NO: 45825 - DNA, 738 bp, Oryza sativa
ctgttgctatattagcaattgcagtttttgtcattcacatctggaggagaccagcaaaagggccactaatgccatgtaactcctcttgcctctgcatttctttttccaggttgtgagtgattgtatttactttagaatggatcagtcaattaattaattaattgattcgatcaaagtaagatgtacgtcctccatcccaaatcatagggcgacatctttttaagaaaaatcaaactcggtaacttttgtctaataattagactaatcatactccctttcgtcccaaaatataagtatttttagctatgaatctggacattgttacattttgagatggaggtagtatatgctaagtattatatatatatatatatatatatatatatatatatatgttatatcactatatttatattttaaagtactttcatatgatactaatttcatatttgttgggaacataatatggaatacattaatgatcatagtatgtcattgaataccgataaaaatatataaaaaatatagttattataatttgtgatgaagagactattaacacacatggatcgcaacaagctaagtacgtaatattgcactccccaccacatttattattattttagggctgataaactggaggctgtaaaatcagccgatctgatcaggcatatatatcctgggctgctgactgctgtcatgtacttatttttattcaacagggtcatttaatcaaga

SEQ ID NO: 45826 - DNA, 158 bp, Oryza sativa
taatcaaatgaatttgtttttaattctcttttgacctgtcaaaaagaaacgcctttgcttcttttcaattcctccagaaatcttccattccaatttgctaccagctgacgctttgacacagcaattaggcgaaattcttgatctctctctctcatcca

SEQ ID NO: 45827 - DNA, 412 bp, Oryza sativa
agatgcaagctgggctggtttgtgatttgtgccacatctagtgtacacaataattattgatgtaggtttatgagttgatcgtatgctagtgcggtggcgggaagctacctaagtggctgttaaacctaggcatcacattcttatcgtttcatgattctcatctggactgtagcatatagtggtctgtgatttgtattatatgttcaatgattctatctagcactatcattctgtgaaataggttcataaattggctgaaagtgataacgatactgatggtggttttgtgatgtgtatgtactctgttgtcaggactcaggacaactttgatttcttggtcttaaaattgtactttgtggacataaaacaatattacaatattgcagcactaaaggaccatgttgtgttaatt

SEQ ID NO: 45828 - DNA, 1205 bp, Oryza sativa
gcccagataggactcggtacctaaaagataaaaaataatactctcttcgtcccataatataagagattttgagttttttgtttgcactgtttgaacactcgtcttattaaaaaaaattagaattattatttttttttgacttactttattattcaaagtactttaaacataacttttcgttttttatatttgcataaattttttatataagatgagtggtcaaacactataagcaaaaactcaaaatcccttatattatgggacggatgagtatctatgaaatagaatctaaataagaagagtcaatttaaaggtgtgacaaatcattgaaacaatgttgaacacagactagagctaccacctctgttcaaaaagacataaaaatttcactaattttatgcttatcacctgaagtgggaagtggtagctagtgacggatctaggcatattttgtagggtaggccgactccacggctttttttaaagcatcctacaaaccttgattttcatgtataaattaacaaaatatagtgaaataatcacacttaaatacaaactaactaataattgatcttacaggattggattaaatttctgtttccgtcactggtggtagtaaaagccaagagccaacaaaccaaaccggtagtcctgaatcctgatccagcttagctcaacagcctggacccgtaccagtacaccacttgtatccatgagtgattgtgctcgagcatgtactgagattccagcaatgaaaagcattcgctgtcagggtctacttttcgttgcttcgtttggttccagcctactacctccctcaaaaaaaacaaaaaaaaaaactctaaacagattacgtgtagattcataatactataatgttgtcacatagcattccagatttgcttttatgggacaaaagaagcagacatgaaggcttgacagtggctatcagtacttgactagtcctgatcaaaggaaagctaacactacacattcagttcgtatgcatcatatatgcaccttggcatactaatttgtgaatgcctcgaaacataggagcacaaaatatagttgcgataattttgcagacatcagctaaaattcaaccaggatcaccgatcatcaaaacatggtcacatgggtagcctcaggatgcgggggatggctgcaaccattcaattcagcacgcaacagggaagtaaaga

SEQ ID NO: 45829 - DNA, 645 bp, Oryza sativa
tacaattcacaaaggtcaaatggctggttcttggagtaatactagttcataatcctgaaaactgtgttgttctgcatttgggcaatttctttatttttagcgttgaaagtttgaaagactccatgttcccttatttgccactgatatctcacgtgagccctggaccaacatgttagtgagatgatgagttgcaagtaatttaacagggaatacttcagttacatatgaggaatatattctagtattttgatctgtctaattacaaatgtttgtacaacttcagttattatatattactcttagagtctttagtcccagttaaaactgctctcccttttccctgtagaatgaagtcagcgtccagtcttcacacactttctcatcaatttcattttgacctatggaatgttacacatcaatacatcattaactgtttcagttcctgtaatattggaagagatatgtcatgagctcatgcttcagtttgctataactgtgccataacaagttggcaactattaccttttgccatctttcatattaagaatgttgctaatctgtatttatttgggagtgagaataactcacatgtttgagtattattgctagtcctgcttgaactgacaggcaagtgcacattgcagg

SEQ ID NO: 45830 - DNA, 714 bp, Oryza sativa
attcctgcagccccctcgtgtgacatattgtcagatgtttaattaagttttaattattttaaaattgaaacataaatttatatttaaagtaacttttatatatagaaaattatcattaaaaaattatatcgtttaactgtttgagaaacataattaactgatgaaacctacttcctccgttccacattaagttcaccagtagctctttccatttgtctcaaaataagttcatttttaaagcaatcattgcatcagaatttgtaaaattagagaataattatattacgagtagataaaatgagaaataattatattgggatttgataaaggaagattgttatagacttatagatctttttcctttgtattggtatctataaaatagatgctaaatagatttattttgaggaggtagtggcatcactgtctcgccggagtcatcgtggctttgaaaacgtcactagccttgacgtcgtcgcggactcgctgaaactctgtgaaagcgaatcgaccagacgaaccaactccaaaaccaaaacccgcaccctccccttgcgtaagcgccgcgccacgtcatcaccccacccaccccgctctcctctttgcttccgctcccccgcaacgcatcccgcttcacgcagattcgattcgattccatttcgataccattccatggccgccgccgccgccgccgcgggtggcccgcggccgcga

SEQ ID NO: 45831 - DNA, 1501 bp, Oryza sativa
tccgctaccgccccgtcaatgccgaacgcgaatgaacgtgaacgaacgcgaacgaacgtgaacaaacgtgaacttaacgtgaacgaacgtgaatgaaacgtgaacgaacgcgaacgaaacgtgaaggcacgtgaacgaaacgtgtgaacgaacgcgaacgaaacgagtacgaacgagataattaaacgattattagacttagcatatatatatgattatatatttgaaaacatgaacataaaatatatgttcctttgcgtttagactaatacatttttttgcatgttgcaaaaaagaagtcgtcgtcgtccctcaagcagaagtggtagctagccctcgaaggaatttgggcaggcaagtgatgtaaagatatgattatcgagaatgctaatatacgaaacttagacttagcatatatttgattgttagagttttaatataagattattagagttttaatatacgaaacctagacttagcatatatgattatctagagttctaatatacgacacttagacttagcatatatgattgttagagttttaatataagattattagatttttaatataagattattagattattagacttagcatatgtgagtgttagacttagcatttatgactattagagttttaatataagattattagattattagacttagcatatgtgagtgttagacttagcatatatgattattacagttttaatataagattattagagttttaatataagattattagagttttaatatacgaaacttaattagacttagcatatatgattatttgagttctaatatacgacacttagacttagcatatatgattatttgagttctaatatacgacagttagacttagcatatatgattgttaaagttttaatatacaattattatagttttaatatacgaaacctagacttagcatatatgattatctagagttctaatatacgacacttagacttagcatatatgattgttagagttttaagataagattattagatttttaatataagattattagattattagacttagcatatgtgagtgttagacttagcatttaagattattagagttttaacatacgattattagagttttaatatacgaaacttaattagacttagcatatatgattatttgagttctaatatacgacacttagacttagcatatatgattatttgagttccaatatacgacacttagacttagcatatatgattgttagagttttaatatacgaccattagagttttaacataagattattagattattagacttagcatatgtgattattagacttagcatttatgattattagacttagcatttaatattattagagttgtaatataagaaacttaattagacttagcatatatgattatttgagttctaatataatatttttagagtattaacatatgaatattacacttagcaaaaatgacctatagacttagcaaatatt

SEQ ID NO: 45832 - DNA, 954 bp, Oryza sativa
aagggtataatggacatttctaagcaaattaatatttagactgcgtcaaagatcttaccatttccgaaggaactggggctgacagagacttgacgagaggggcatgcaagggttccaaacaaactttcaaggacacacaagggattcagtatttttcaggtgcatagaagggactgagagagttttgaggtgtacacaaggaattttctctagattatataggatatccaccactctgtgacacatccaacggcttgattgtctatatattgtccttcttttcatacttatagctgcatcagttgagtttgaacttatgagtcgtgattagaatctcaatctctagcctgtctttggttgctgattagagtagtatgccctttatcttatacactttattgacatgttaagtatgccctttatgttaagatcttgttgcattcaaatatattaggctttctgtttggtatattcttctagctttaatatcttaatatagagtagtatcggagtattagccgatacatactagatctatctgatcggctatgctatgaacacatataatctcattattcatatatatttcgatctaagtgatttatactgtctcggcatagcgaccgatctatcccaatcacttgatttaagcatatactgacataaatattatataccattgatatctacagctgattgagtagatttagttctttgttacttattaatgactgccgatcgacgcatatatgacacaggctcaaagataaatgatatgtcattggcaattagccggccggctatcgtttatggatttaaccgcggtttctttgtctttgtttcttgttgattgcaggatcaaatcaactggcatgcttacacacccaaaggcaagttttggacctgtactggagttaagcagatctcccaggcctcatgttgtacatcaacaga

SEQ ID NO: 45833 - DNA, 1501 bp, Oryza sativa
gaacaagatttttctaggaataacaccgggcagtaatgactttgaggaacaatataaaggcagatttttaggagacattttaaccagagtgcactaagctaataaaaatgttggatgaataagaacttctccacacatattatacaatgcaatactgcacctttgatatccattatctatgtggatcagatctgcatttgcatcgactttttatttgcctaaacctggccctgaactagactactgaggaagccatgtaaggatgcaaacaaagaacgttgagattttactgttttttatcacatccctctgcagttagaagcaaatgactatgagttttagaaataattggaactgaaacaagtcactattggagaagtgatctttgctgggtgagacaatttccacaatagttccggtttcaaaaagaaccgggactaaagaggttttttagtcccggtttattactccaacgggactaagggatctttaccgggacaaaagttgcacaactttaccaaccggaagagatgaggagttctcctagtgagttttagtactacaatattacaatactagatcttggttcagtaaactaaacaacattgatgtcgctccaacataatgccctaagacaacattcaccctagcttactgaactacagcttgtattagtattaccatgctagaaatcagttccgtaaaataaacggcatggtagttgctccattatatggaggcaacattcatcaattcaccctagtttgctggatcaatctaaaatactaatttataagcttatattagtatagtaactctagatattgctgattaacatactctgggtttctcctacggtcaacgaagatcagcaacatcacagttgacaatcaagataatcattattcagtaatagaagtaaacatcgtcgtaactatgacataaataggtagataaatactatattagcatcgacagtcagaaacttcatgtttttttggttctatttaacctcagatggataagaaaattaaataaatttgacaagttcccgtaattcacaaattctgtggccatatattagtaacttagatgtatggaagtgtgtgttgtgaaatctcctaaacagttgaagacaacattggtgtttaatgctttgattgctaaaattaaagccaagtattgttcggaacataaggaatctgacaaaatgatgacgatgaaagcttgcattacctgcttaattaggaagtaacgacaagtcatcgtggcccctgcttccactccacccaaaatataaggggaaaatgcttacgtatgtgataaataaattaaagttgtgaggaattcagcattaataaataaaccaagtaacttacggtttaacagaaagtaaaagaaggcatcataattatcatgccgctaaattaatcactaaaaaaattaccactggactgcccccaaaatctttttttattttttttatctttatcattctagc

SEQ ID NO: 45834 - DNA, 1501 bp, Oryza sativa
gcacaaggataccaaaggatggcataatataggctcaattgcaaaagcagcatttagcaaaacatttaagagaagtaaaacagtggagtaattaatcagaaattttaatcaacactgaacagcacacccatgctgcacaggcccaaccatcctgaacaaccatacccggctgcacagatctatctccaaaccaggagctaaacaaattattaccaattatatcatcatttattatggtgagaagtgtgagactaaccacgaaagacattgttagacccacccatgactgcgggcacggctatttttatagttttactctggccagaggtgtaccactgtacccacaagacacagccccacaacatgtcaccatgtgcctcaataccaccacggtacctcggaaaggagctgtgacattacccctcgcacaacacaatccaccacagtgcaccgttcccggatcatagtcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatatttcacaaccgaaaatcgtgaaccggtccttaattgtcatgagcacgactctcaaaaccatgtgctcacaacccaccattatcaagttttagttggcaagtaattaattaaccaatcacgattggccatcgtgagctatcattaagccatcattaaataatagtgaaacattaattatcccaatagtgtgctaatgtttctaagcatggctaagcaatcatatctaatatctagctgaaccaatatataaagcctaactagtcaagttatcataacccaaggtatcaaagaataaagtaatcaaaaacaaaagggctataaacaaacagtaggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcgaaaatggactctccggaaacgtcggaatctaaacagaaaggagcaaaacaccaaaacagcacataaacaagcatgaacagttcatgtggatatttttaacatgtagatctcaattttagaaaaatttagagacttgaaccaactaaatccgagctaagatgaattagttatgaatttttaaagattaaatcggattaaaacacttatatgggttttaatggaattatgacgcaataatgaattattcttgaaaaggaaaagaggattattgcgtcagcggctagggttcacggtggaccgggtgcacagcggcggctcacggaaacgaatggccgagatcgatcctatccaaaacggacggccaagatcgatcggatccaccgtggctcacggatggacgacgacga

SEQ ID NO: 45835 - DNA, 1501 bp, Oryza sativa
accttgtattggcagtacccgctccatgaactttacatcctcatgcactccaggtgtacacggtttctagcagtgagaggagttctggcgcacccgggagggaaagactcacatgcattaagttataattatgtttaaattctcacatggcagtcctaccaatggcgacaccactatagacacccgtctcgcggttctacctatggctgccccaccgtagagcccctgcctcacacatcaagaaaccactatgcatggatactgcctccgctcagccatctactccgctaggtctatacccatacgagaagcggggttgtacgggggtcgtttcatgcttaacttcatggctcggtccctaattgaccagggacggcattagccttttccggataccacccaaatcctccgtccgccccagtcgaaaatagttgtttagttttatttctcttttcacaaatcatgtcatcaatatcatggcaatgtggcgctcatgtctccacatgcggcatctcaattaccttcccaaaggtaattgcccaagcataaagcattttgataaatatgagtatgcatgattctagaatagcatttctaagcaattgtcatagttgactagggactcatacgtaaacatggttacgaaggaataaggggtaaacaataatcaaggcatggcataatcacaagtaggatgttcatcattgcatgcaattttattcgtaaacaaaacaatttcacaattgggatcaacatgttcaaggaatagtgatgacttgccttgctcgaggtcttgcgggtcttggccttcacccggatccgcggctccctcggtctctatagttacgtgcgtaagaacaatttgaattcgattagaattcaaacaaaatccaaataatgaccgaattgaaaaacgagcgtgggaggtgaattctatataggctactttattcgcgaagtggaattattcttcttcctaagatattttgtgatttatagtcatgtcctaagactcatcgaattattgagttcttaattacatataaattagtaccgcgaaattgatttcttatggagattactaaaaataatctataatctataggaattcatctaattatattctcattaatcctataattaaatgctagtattttaggtatttaattagtaagaattcatctaacaatatgttcattaagcctatgattaaattctaatatttttaaatattttaaaatttctcttaaatttttcctttcctttctctccctctttcttttcttttctcttttccctttttcctttcctctctttctttttctctctctctctccccctttttcctctcctctctttctttttctctctctctctgccggcctctcttttcctctccctctctctcggctctctcccacccgagcggcggcggcggtggacgcgacgggaacggagggcggctcaccggcggcggcagcggcgacgacggaggtggcga

SEQ ID NO: 45836 - DNA, 1501 bp, Oryza sativa
tacctctgaacaaatgtgcccttgcgagtctgcatgaatgaatttaaaaattgatctcgtgcttgttgcatcattgcatcgaagtctttcttctgttcaggagtgagcttttctggatcaataggcgcaatgtttccttcatggacgtcagtcaaaccgagcttctggatcttttctttaacattactagggctggccgacgacggtgacaacggtggtttctcagccatgagggaagctgctttctgacttctaatcggtcccaccgggcgtgccaaaagcgtgttgacagaaaacacgaggactgggagatctgcttaactccagtgcaggtccaaaactcgccttcggatgtatgagcgtgccagttgatttgatcctgcaatcaacaagaaacaaaggcaaagaaaccgtggttaaatccataaatgatagccgatcggctaggtgctgatgacatatcatttatctttgagccgatgtcatatgtaaatcgatcggcaatcacgaataagtaaagaagaactaaatctactcgatcggctgtagatattaacaatatataatctttatgtcgatatatacttagatcaagtgattggggtagatcggtcaccatgccgagacagtataaatcacttagaccggaatatatattaacagtaagactatatatgctcatagcatagccgatcagatagatctagcgtgtattggctaatactccgatactactctatattaagatattaaagcaaataaagtacatcaaacagaagcttaatatacctaaacgcaacgagatcttaacataaagggcagatttaacatatcaatcaagcatataggataaaaatagttaaatcagataagatcggctgaaaccccgatactaccctaatcgacaactagtaggtaggctagagattgaaattctaagcacgacttaatagatcaaactcaactgatacaacattaagtatgaaaagaagaacaatatctagacaatcaaccgctggatgtttcatagagtggtggatatcttatataatctaagccgatgtcattatttatcctaatcgcctgccttttggtagcagatgttagccgattgcaggttagatgacgatattgtcaaagattatgcaagatatataataactcgacgaattacataaacaagactagagtatcatgaagatggaagcactaatcttgagaacgtaaatcgccataacaagtattacctcttgttgaagattgaaaccgatgcagctcaacccgaaagcaagaactcgtcgaaataaaactaaagcaaaaaagggtggcgatgcgccgaaattgtattgaacgtgtgtgttaatcattacatagggctcggggtctatttatacccgagaattacaagatatgtccatattggacacgactcttatctctaacaaattctaagatatcataagtctttgcggcagacttttaccacatttatctctaatga

SEQ ID NO: 45837 - DNA, 1501 bp, Oryza sativa
cctcgtcgtcgctgaggaaatgctggtagaggaacaccctgccatggatcacgcatcagtcagtccatccaatgtcgagatcgagacgaaaccaagaaccaaccgatggcggcgcccgcgcgagcgagagaaagtgaacctgggcttccaggagatctggcgggagtggtgcgggtacaccacgggcgccgggtacaccgagctccccttcccgcctccacctccgcctccacccccggcagcaacgccaccgcctccgccgccgccgcagatgaggaggaggacaagaagcagcagggcgccggaagtgggagccccgagccgcaccggagccatggcagcggagaattctccgtctccctctcgcccaacggaggcgaggaggaggtggaggtggagatggaggaggaggcggctgcggcggcgagctggaggtggaagtggtcgccgcgacggtggccgccacgcttcgcggcggagagggaccgagtcagtgatgaggagggaggagatctgagccgtcgaaatcccgcgccgaggagatcggacggccagggcgcaccgggaaatcgtgcaagcagcgaactactagtaacgaacgggtaggtgaggtgagcaacgccaacgcacataccttggaaatcacgatgttttgcttcaaaattactgtgttttttcatataacggacgttttttttactgagaagtgagaaacacagtattaaacatatgcgtcctcagcgcgcgtacacttacaccctacacatacgaacacctttaaaagactaggcgtatatcggctaccactgaaataataattagccataaatacaagcacccgtgtcaaatctaggatttgaatttgggtggactggttccaccacgagaaatctaaccagtcgtataaaagtcatataaaaatggagcctcaattactcctcaattttaagccatatttgttttaaagttatttacaaaatattaagattaaaaaagttctcttttatcatactaatagtcaaattttagattatttataattgtaccataaaatatgattagccagaaatgtatggatttttatttattggaatcagtgttccataagttatttagactatggtatataagtgctataaatatttatattttgaaatggatgaagcactaccttttacattctgtcttgcaaatgaaaaagaaaaaaacaaaacaaatggggagtctgttccaagctagtggcttcctgaccagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttga

SEQ ID NO: 45838 - DNA, 1159 bp, Oryza sativa
atgacttgcgaggacaagctccaccgcagcccgtgccaaggaagccgacgacgacttcacggcctcgccgacctcctccttcagcctctccagatccgccgtcatcccgtccagccgaagcgctgaagcatctaggctcccatagttaattttggtaattaatgacaagcgctaattgtggactaaccgttgctattgagataatattttaagttaggtccacgtcatgtgtgcacatggatgactatcgatggattaaaatttgatggcgcgaagcgaagaaaagaaaacggtaaaactagtgttttagttttaaaattgatcgaggtgaagggcgatcaaatttgctagtttatttgttagtttcgccgtactatcaaggggggtaatgacctagcaaagagatgattaaattgccacattaggtcattatgcatttagacttgtgctcacatttcacacacacacacacacacttcactgggttcggcctgaccaggggcggtcagaccggccacatagtggcggtctcaccggagtgccctggccggtctgactggccacaatacggcggtctgaccggaccataaggccgatctgaccggcggcatatgcgccgtcagaccggccccctggaggctgggatggtgctgctcggggtggccgatacagagccgacggagccgaagtcggtcagaccgagccgatggcggtctgaccgagccgaggccggtctgaccacccactcaacaccggtctgactggcaaggccgatggggccctctgacagcacttcaacggctagttttctagccgttgcagagtagcacggtctgaccggccacatatctccggccagaccggcaaagcacaatgattgggggatttcgcccccaacggctagttttggtgggtgggagtataaatactccctcaccagcagcaaggggtctctcttggcacccaattcaattgcatacatcccttgcacctctctcacacccacttgagctttgtgttcatccatctagtgtgttagagggttgattagccaagagtcaagtgcattgcttccatttgtagagttagtgtggtacttgattgatcatctccacgctgggtcattgcttgttactcttggaggttgctgcctcctaga

SEQ ID NO: 45839 - DNA, 1501 bp, Oryza sativa
agtagctactgtggtccaagagacaagcaacaaccgctgaaaaaccattgtctaccgagtctgatgactaaactactttcttgtggagtcaggaacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccacgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctggtcaggaagccactagcttggaacagactccccatttgttttgtttttttctttttcatttgcaagacagaatgtaaaaggtagtgcttcatccatttcaaaatataaatatttatagcacttatataccatagtctaaataacttatggaacactgattccaataaataaaaatccatacatttctggctaatcatattttatggtacaattataaataatctaaaatttgactattagtatgataaaagagaacttttttaatcttaatattttgtaaataactttaaaacaaatatggcttaaaattgaggagtaattgaggctccatttttatatgacttttatacgactggttagatttctcgtggtggaaccagtccacccaaattcaaatcctagatttgacacgggtgcttgtatttatggctaattattatttcagtggtagccgatatacgcctagtcttttaaaggtgttcgtatgtgtagggtgtaagtgtacgcgcgctgaggacgcatatgtttaatactgtgtttctcacttctcagtaaaaaaaacgtccgttatatgaaaaaacacagtaattttgaagcaaaacatcgtgatttccaaggtatgtgcgttggcgttgctcacctcacctacccgttcgttactagtagttcgctgcttgcacgatttcccggtgcgccctggccgtccgatctcctcggcgcgggatttcgacggctcagatctcctccctcctcatcactgactcggtccctctccgccgcgaagcgtggcggccaccgtcgcggcgaccacttccacctccagctcgccgccgcagccgcctcctcctccatctccacctccacctcctcctcgcctccgttgggcgagagggagacggagaattctccgctgcca

SEQ ID NO: 45840 - DNA, 1501 bp, Oryza sativa
aagatgagggttgttgcggaaacagagtaagagtcggctggagtctggatcggctacgactgggatcggctaagtctgagttagactggttaagtgatacagccgattccgacaatatgacccgtttacgacatcgggttcgagttgatgtgcttcaagatgattgccacgcatggatagagtcctagggaggcaattgtatctattaattaggatattttatgtaaattcattagagataaatgtggtaaaagtctgccgcaaagacttatgatatcttagaatttgttagagataagagtcgtgtccaatatggacatatcttgtaattctcgggtataaatagaccccgagccctatgtaatgattaacacacacgttcaatacaatttcggcgcatcgccacccttttttgctttagttttatttcgacgagttcttgctttcgggttgagctgcatcggtttcaatcttcaacaagaggtaatacttgttatggcgatttacgttctcaagattagtgcttccatcttcatgatactctagtcttgtttatgtaattcgtcgagttattatatatcttgcataatctttgacaatatcgtcatctaacctgcaatcggctaacatctgctaccaaaaggcaggcgattaggataaataatgacatcggcttagattatataagatatccaccactctatgaaacatccagcggttgattgtctagatattgttcttcttttcatacttaatgttgtatcagttgagtttgatctattaagtcgtgcttagaatttcaatctctagcctacctactagttgtcgattagggtagtatcggggtttcagccgatcttatctgatttaactatttttatcctatatgcttgattgatatgttaaatctgccctttatgttaagatctcgttgcgtttaggtatattaagcttctgtttgatgtactttatttgctttaatatcttaatatagagtagtatcggagtattagccaatacacgctagatctatctgatcggctatgctatgagcatatatagtcttactgttaatatatattccggtctaagtgatttatactgtctcggcatggtgaccgatctaccccaatcacttgatctaagtatatatcgacataaagattatatattgttaatatctacagccgatcgagtagatttagttcttctttacttattcgtgattgccgatcgatttacatatgacatcggctcaaagataaatgatatgtcatcagcacctagccgatcggctatcatttatggatttaaccacggtttctttgcctttgtttcttgttgattgcaggatcaaatcaactggcacgctcatacatccgaaggcgagttttggacctgcactggagttaagcagatctcccagtcctcgtgttttctgtcaacacgcttttggcacgcccggtgggaccgattagaagtcagaaagcagcttccctca

SEQ ID NO: 45841 - DNA, 595 bp, Oryza sativa
tggtaaatcgtagaagttaagcaaaaatcgatggtatattatagaacgtgacaaagtcagtggcaaattatagacccatgacaaactcagtggcatacaatggattatctctatattaaatttgtttattttggaatcgaagaaaatacgaataaccaagcaaagcttgtcaagtgccttcctcacatatatggttgtgtttagttcacgccaaaattggaagtttggttgaaattggaacgatgtgacggaaaagttgaaagtttatgtgtgtaggaaagttttaatgtgacgaaaaaattagaagtttgaagaaatattttgaagagtaaagtgcaccagcggtcctcaaacttgtaagggtgtgtcatctaggtccccaaactctcaaatcgtatttacaggtccctaaacttgcttagccgtacattgcctgtccaaaccccatttgactcggtctgctcgctgacgtggcttgccaacgtggaggggaggagacagccggggtggtgcattatgcattaagccccttattttttcgccagccctcagacgataaatcccccactctttcgcttttttttccccatcgagc

SEQ ID NO: 45842 - DNA, 267 bp, Oryza sativa
ctcttgcacttaaggaccgttccttggaatttcatccaaacataagacaagtacgaccacatgggtggaatgggacacccctggctgagtacctagcttatcagggaagccttgatgccgagagacatgtggattcgcgggggtggtgtcggggaggacccctgggcttcctggcacagtatggtctggaacctaacctgttgttggtctgggacccctctcgtcggcatatggtaaacctgtgtcggctttcgaaatgccttgtca

SEQ ID NO: 45843 - DNA, 1501 bp, Oryza sativa; identical to SEQ ID NO: 38875

SEQ ID NO: 45844 - DNA, 205 bp, Oryza sativa
gccctgtgcttccaggtaaaaatttccaaatgcactcgactcaaactgaagtggcagcccttccaatttatgtacaggaatatcagaaacattgcatgatatcatatcatacataacttcaaattcaattaaaattcataacaagagaggtatttcagcatctgatcatgagcacacaaaaaaaaactgcatttttcttttcaga

SEQ ID NO: 45845 - DNA, 1501 bp, Oryza sativa
atcgctagaccgttattccgctgctgttttcttttcttttgtaagtgtgtaacgttatttttatgatggatttgaatattaaattgtcagtttgtgtacctcggctgattcctggacgaggattttatgcacaaataagttcggaaattactagtgaatttccgggcgtgacatgacgggcgagcggcgacggcaacggccgaaggcgacggcggtagcggtggtgcgcggcgcgaggcgtggggcgcgggcgcggcgtcggcgcggcagcggggcagggttaggctaggggacctcgtcgaacacctggcggccgatgaatagtgccgttttctatttacccgatttaagcctatttatttatttaaaattgattctataaacctaaattttgtacaaatgaagttcactcaatatttgtgttattccaaccaatgggtccatccttgattaattttacccatattttatttttatataattttcttgaatttaattagagttaattcttattccgatactttcaaatttaattgatacaaatatagtcgtaataatattttactcatttctatcctcaccaaatattattttaatttgcactttaattatttacttagtcaatttactttttagggtttattcctaactaattatccattattcgcgattcataaactccgaaatcagaatccaataaaataatcgaacaaaatcggcatgatgcaattttatttaaaaagtttttgaaggctcatatttttgggactttgatttttgttggtcgaattttcagggtgttacatatactctacttctaatattccttatttttaattacaaatttatattattttctaattgtatttctatatggactatatactatatttctaatatttcttatatttaattctgaatttcaggtattttctaattgtatttctatatgaactctagtctcatcttttaatattccttattttttaattccgaatttcagttatttcctaattatatttctagatggactctagtctcctcttctaatattccttattttttaattccgaatttcaactatttcctaattgtatttctatattgactctagtctcctcttctaatatttcttattttttaattctgaatttcagttatttcctaattgtatttctatatggattctgctttttctttttcttcgattaatgtgagaatttctaggccatgagagcgaacgtgaaggctcttttttctattcctttaataatataatagatattctagcaattaaagaatatatatcatgatgatttatgagcatgcttgtggacattcatggataaattagtaattaatactactccctccattccaaaatataaggcacaaccacccttaacccaaagactaagaaataattattatcaccttgtagtttggatcatcctaataaatgtaatgcatgcatccaatagagttagagaatgtgagagtg

SEQ ID NO: 45846 - DNA, 1501 bp, Oryza sativa
tcatatggaatttggaagaaaaatatacatgagagaacattcctcggagatattagaatctattccaaatatgatcatatatatactaaaaatttaaatgttcatgacagtaattcgaattggattgcattaagtgcttactttatgggcaacaacatctctttacaccactacggaaaggctcatcactcccggtttgcaacccattttactcccggtttgcaaaccgggacacctaatccgggactaaagttatctatctttagtctcggctaaaataacagggagtaaagatggatttttaagtcccggttggtaagatggcggcaccattagtccggttggttagtttttttttctttttgttgttatttttctgctcgcatttattgtcacccttaaatgccccacaaatcattcacaacaaatcatacacaattgcctatccataaaatcatccacactccacaagtcattcataaaatcatccccaaatctaaaataatccataacaaagtttataaatcattcaaaaaaatctaaaataaactcaaaaaacacaaccctgccgccgccgcccggtggcctcccctcccgccggatatggaggaggggaggccgcccggccgtgcgccgcatcgctcccatcccgccgccgctgccgctacgaccgcccggccaccgccggaggggaggccgccacccgcagctcatgcgtggccgcggccgtgcgccgcctcctcgcagccgccacccggcctacgcccgccgtcgccggagtgggaggagtggggagggggaggagaggggaagcggccggaggaaggggaggagagagggggagggggaggaggtagaggagaaaatgagaagggagaagtagaggacgagttcgatgggaggagcagaggaggaggggatcggataaggactgctggaagcgcgcgcgagtctctggggagtttttcgattttttttattttgggtttcggttggtacaaacaaccgggactaaagatgataggggttggtaacaccaactgggaataaaaatcacaaaagtacatgtaggttttcaaaccgggattaaagttatttttagttccggtttttactcaaaccgggactaatgtgatttttgtgtgacctagtaaagatcatttctccagtagcgttattaggcaggttcatgaattcccttattttattttttttacgatatattacccccaaatgaggtaagacgaatgtcattcatatatacaatactagtaatattagtatcatggtatatattatggacggtgtgaaacaagttgggatgagcatcataaaagattctcaaaggcaatatataaggagaccatcagccagcttctgagcaatactaattaactctcaaatccctcgcgcacacacacacgcagacagagagagagagagagagagatggcgttatttggggtaagagagatgagacgatttgagagaatgacgccgg

SEQ ID NO: 45847 - DNA, 1501 bp, Oryza sativa
cggaccaggccggcggttgaaccggaaaaaaccagaactagggaccttggcggcttggttcaacaaaaaaccgccctgcaatcgaaccggtaaaaaacgggtgaaccgggtggtttttatgggaaccggtggaccggtagcggtttttcaagaatcgaatagatttttaatttgtcctagcagtatggcattaatccaggcaatgcttggcaatgatgacatgttgcagtctcttccaaggagttctggtgctagccgtgtgaaggaagtggctcctcggtggcttggctgatgcccattgttggatgccgaagctgcttttcgctttggcgacctttgtgccttcagtgtcgctgcggttgtgaagtcggcgctgctaggtcgcttgggcgcctagctcggcaatgataacacctcttctgcgatgtaggagctattgtgtcgcttttgtgtttagcctggcggcccgacgtcctgcgtttgtgctccgccgttgttgttagttgtgtaacggcgggtttcagccggtttttctgtaattaaccgtgcagttgtatggtttttgggccaggttttccttataaactgggtcaattctcttctaaatataaaagtggaacaaagttccgccttaggcttaaaaaaaaggagttgacgtgtgtcagtgtgtaggtgattgattgatagcttgatttagagccaacaactttgataaaacatgatactagcatggaagaagaaaaaaaggcagagaattgctattaactataataagttaaggatgatttgtataggtttgtaggattcatttctccttatctaccatcggcacaggcaaccggttagggggctgcgtggtggaggcagtcgccctgtggattttgcggaggcggcacgcggtggagggggagagatgagtgaggtggcggcgggcgtgcgctggatttggcagaggaggaggcggtgtgcgcggtggatggggagagaggcgcatgcagtggaaggagggagaggtggcaatgcatggtgaaccatggaaggggccgcgaggtggcggcgcccagggttttttcttgcgtcgattttctttttggcgtggaaaaaattttggcggttttttttattttcccgcacacctaaatgaatttgccgcctgagctttcacctcactctatcttaactgtgagatcatgatctgacagacgaaacattgctgacagatggataataatcattaagttctctggatatataatttgtttctactcataatattgctgttattttgatccaaaaaatatttagatttcctaacatataacatgtcttattacgcagtattgtcaacacataatttgccaaaatctatcaataattctttatctttactgatagatgtctgctggtaatctagtgtcatggtgtactgtatgcctcatggctactcccacgttgataagactttcttgggtgctgttttgactgtgtaatttgcactttt

SEQ ID NO: 45848 - DNA, 481 bp, Oryza sativa
aatttaatgaaactaatttggtgtacagatatttctattttttttaaattcctataagcttgatcaaatccaaccacgtttgacttaacataaacctaaaatatcctattaaacgcaccactacttaaaaggagagttgtccgtctgctccccttcccaactccatgacgcagagagcgacccatagacctccttacttgagagtaatcactctcccttaaaaacagaaaagaaaacctaaaaaccattccatcatatgggccgataaaaccatgaaatggcatctattgcaacacatgggcatttcgacctaatcaatgcgtctggtaactaaggatgcccaatagtttggtgtaccataagaaacactattccatttcagcgataaataaaaggaacaaatcagggaaaaagaagtgtacagtgaacaaacatgcagcacctggatcgaaggtggtcgttttataggcagcggccgaca

SEQ ID NO: 45849 - DNA, 295 bp, Oryza sativa
tttggcggcataggttctaagataggttccaaacttcactctatctgaacacttaagattcgactatcatcttattattcctcgatccacttgacttgcagaagttgacaacatcgacgtcttcgagtttctccatcaagattaacgactactcaagttgaaagaggaagggggaagaacgacaaaacgatttgcaaagaattctagataaggaagaaaggaaaattttcacaaattatgttttcggaaaattagtccttaaggtttgaccatttggcttatcctacagtcaaga

SEQ ID NO: 45850 - DNA, 261 bp, Oryza sativa
cagagtcgccgcccttagctttatcgccttcttagtctgtttgcttgctagttttcgtgtttaggtttgttgcttgtgggttagtcgtcggtcgatatcatgtgtcagtggtatgactgcctcaattaggagcttgcgtgcctgctttttcactgttttaatcccagattaagataattgcacttaaattcataagcaagattagtttctgagccccctgtttttctttcttttctcatatttctacctatccccttcaga

SEQ ID NO: 45851 - DNA, 1346 bp, Oryza sativa
agccttagaatagggatgaattctggcatactttgccttggagaggatccaaaaagaaaatatacatctttgagagacaagagagaaaagtcaatatgaggaaaagagctagtttgcgaaaattcataaaaaccccacgagtctaacagagaagcaagaaggactggaatcaagatcattccatttatcaattactcaagatggtaagatagccactgataaaattcacaggtataggtatgggtgtgaatgatttatatgcttgattcatctcttgaagaaattcattctacactgacctttactcagggacgagcaaagtgctaagtgtggggggttttgttggcggctgttaaatgtcgattctataccgccaacgtctgcataaagttcggataataaaacatccaacatagtgataggtgcttaatctcacgtattccacaagtgttggtgtatatttgtatgcagatgataaaccctgaagttgggaggaaaatcagactaaagtgaggagaattatgtatccatacaaggagggtttgtgaacttcatcaaaacattagtgaatcaacccaaaactccgagaaatggatagacgaaggatcggggaatccaccgaccgaaggccaggccaggagggcccagcccaggttcaccgttgatcctggggtttggcgtggacgctccagatcactccctgatggcggttgcggggtacttcggacatttccccttcgccaacagtcatacctacctctatataaaggcttcactccctcacttcacacacacacttctaagcttaagctgaattataagaggctctattgtactataatattgtatactataataggaagagagtagagtagaaggagtcggaagaattccggagttgtcggtaatcttctcctatttcttttattctgtttattatcctgaattcaatataatattcttcttgagtaatttagatttatcttgtgagaattacctcttggttagttcctaattagcatacgggattattgttcgctataatcaacttaaatatagtgattgctttggtgagttataaatactaaagtagatattaattgcatagacgtgatgtttaggtaattattattcagtaattgctgcgtatcccacaatacgttgaggtgggtgtagaggtggtgacagtcctcgagagcacttaagtcctccctgtccgggtacgtagtagagcgacatctaggaacaacgggttgccagttcctgaagtattacgttaggattaaaattaagctttccctagacactgtttctcactagtaaatcctctctatcctggcctatca

SEQ ID NO: 45852 - DNA, 235 bp, Oryza sativa
tgttggtatttgatacggttacagataaaatccgcaagcgcacggatataccgatgtagcacttcccctacggagtattccaagggtatcgaatccaagggaacgtgtgtgatcagagcttcttccagttcacccaaggataccaagtaaatgataggccaggatagagaggatttactagtgagaaacagtgtctagggaaagcttaattttaatcctaacgtaatacttcagg

SEQ ID NO: 45853 - DNA, 1230 bp, Oryza sativa
aaagaaggcaagaaggtcaaaaagaagaagtctaagtctgaggaaggccctgcttcatcagaaccagagaaggagctgccgaatgaacagggggatgcagatggcaaggcaaaatcaaccagaagtgaacgaaggaagcgtaggaggagggagttgaagatgaccaccgaaaggcaagcagcctatggaaagataaaccctaagcgtcacaagagccattgagctttggagattcggcatagttcatctagaaaattattatttttttgtttatgtgatgcatttttgtctgggcgttgtccttgtggaagcatctgtttagggcattcatgatatatctggagctgtgaacccgttattgtcacagtggtaacatatggttctatggaagttttgcttacatattgtaatttcatgagccatataatctttttgtttttacatttgcctctgcaattttggtttccttatcgatttctatgatgaatggttaagttggaaagaggaaactcatgccagagtgaagatttgtcaatttgtatggcacaaatgtctatcaaaatgattcatttgttcctctccagccgtttgaccagaccatacctggccaatttacatcttgtgttaatttgcatgaggagagcttaccttccatgtttatgatgttgtcagctacagtggaattgtgcttacaactgtctaagacaaagcagtaaactacagttaggcctcaccgagtgaagaccaattcagagcagctccaagcagtggcaaccaggtcaacaaaaactattttggcctgtcatcttcttccaatcatctcatttctctcttcttgtcaccttgttctctgcacaaaaagaaatccttgatagggtttattcccttgtgttggttgttgcacatgtccctttcttccatcgtcacaaccttcagtactcacattactctatataatgctctctcatattgttttgtttactgatcaggtcttcaggagaaggagcttgctttgtactcctaactgctccttccagtttgtgctctgctgttccccaaattctctttctcctacttcctgcagatacccatatgattcatttgttcttcctgcgctactgattacttctttcaggacacagctttgctactggattactgccaattgagtcttgttattcggttcctcaatttatcaagttcttcagagcaggcagtcgaagtccataa

SEQ ID NO: 45854 - DNA, 1501 bp, Oryza sativa
acggacgagccaacttacacatcactccacttacactttcttctacgctttgtgtaaaaaggttaacccagtagcgatatggttgggagaacaaacccttataagttagttccacccttgctaaactagtaaggtggtacgaaacatgcacacacagctctcatgggccacacaagctatatcctaattaggctgggatgtcacacaaatggtatcagatagaccctagacagggatcaagtagaaatttcgggtgtatagaaaggatcgtgtaaattttagaggtacgagagagattgcatgaatttttaagagtacagggaatttactctattatgccagattttgcaacattgttgtagctattgtatatatcgcacccaattcttttttttttttaaaaaaagcaaatactagctgcacccggttcttatactatatatacttgatgcagaaacatcaatatcttcaacaaacagttgagtgcgttcatgaaacacagggacatgttgatatcgtcctcaacctacaagacatatgctgtaattattccctcaggtatcaatcaattcagttaacttttatatttctcaagtagaaatcatacgatatcactttaaaataacatcatgttctttcactgtgttttttttttgcaaatacatctaaaaatacccgctgcaatgcgcggggtattgtgtagtatgtgttgtcagtgttgatatctcctccctaatccaaccatccatccaatcgccacctgaggtggaatgtttgtttctcaatttttcaccttttgcattcctcccatttgctttaagattcattttcagcttaccaagtgaacctaagaaagcacacaagaatcattttataacttaggtaatgttttcagtataaataatgaaaatatgtaaaattgcctcatgatcgacttaaaggaagaatacgattagtttaaaatgtttgacgtgtaacatatccaatattaaagtttgagtattgctatccatacttaaaaaaaattaaaaacatatagtgtaaactctatatatatgcagtgcaaatgtacgaggaaactatcgttaaaggatgactaagatttatctacgtcaccgtagttttactcatgatgacgtagataaatatcaggcttccattttgtatccaacaataattttcaggtttacacactatatatgaagttgcactacatattttacaaaaataccttacaaagtttttacaagcaaagctaataacaattctcactaaaaaaaaatgctcttgaccatttgattttaaccatatgaaagttacagtactcacagcatgcaacatctgcgtttgaaaagtttttaagaaaaagtttgcatgcaaatgaaagtttaggtgtgcaaataggatgaacgcaaccgttaagaagcaaaccagactttctcactatgttctgctgctgccgtattgttaaagacagcagtgcacgtctgaccggaaaaac

SEQ ID NO: 45855 - DNA, 1501 bp, Oryza sativa
cctcttctgcactcgatcggtgccgttcacgattaggaaacacgagctccatccaatctgagatatccgggctccatttctttctccgatctacgcgtcctcacgttcgcgtcgaagcctcgctggagccgccagcgacggccacctgccctgacagcggcggcgatccatccagtgattcatcgatcctccctcatttcttcagatccagaatgtcctggatacaatttcttcagattattcagtgacaagagtagtacagtaaatttcttcagaattattcaaagacagagtggtgctcgtttgtttaattgtttatatgagaaatgcacggtttcttgcgagatcttgttgaacaaatcatggattcaggagtgacgagacagcgaaagttgatgtctttttagggtcccaccatcttgaggccttggcattggcatagcataatccggaggagggagagccgcatattctgattctctctcctcctcctcttcttctccctccaaacacagcgccgggaaagcgaccgctgggctcccactccgcattaatactcggcctcctccgattttgtttgttttgtaactttgttcatccaatccagcctctctttcttgctttcttggagttggaggtagtagctcggatgaggtcaaattctttgccccctaagcttcctttctcttctcttctccccactgataatcttgttcctcctcttctttgttcttgttcatactatgcaagggtataacttggtgtagtttccggttcgattctgggattgtttgctctgcatttcgaggctcatcaagttgggttcttttttgcttgcttatctgattcatttgatgatgggaggttggtttggatgtgtctgtaggttcatggagaggtggagatgcgtcagtgtgttggctctggtgctcttgctgtcaaatgcttcccatgggagaggtagtttcatgtgaccctttgccctaagtttccaattttgatgcttgttgggtaattgttctaagtttgcctcaatgtattccaaaatgggttaacgtttaacagaacaaatagcaaatcaaggtattagtaactgactgctttggtgggagaaagcagaccaatgcttatgcaggcatctgtaataaggtttaattttctagagaaatggggagtgctgatgatggatgagattgtcttgttcttttgattttaccaagttctgggttttggctgtcggtttggtatgaaatgaccagtaatttactggagttactggactagttgaccaagttatagctgttctgctgttgtaattggggatgcatgagcaagagtaggtgggtgacagttggaatttcttgctgccctgtccttactaatataattgatgccctaattgctgaaaaggaagacaaggttggtgggtgagtagaaaataacaacattggaaataaagaagttgatggcaagaaagataatggatataattgtgctcaga

SEQ ID NO: 45856 - DNA, 441 bp, Oryza sativa
ctgccgctgcagtggcgacggcgacgacggcggcggcgaagctgggggtaattagggttttcgcgaatcgagaggagcaaaccaatattaaaggaggcaaatgacatatgggtcccacctttactgaaggcccatctgtgaattttacggcccaagaggacggaggcccaggggcaaacgcgtaatttcggcagcgaggcggcacctatatacaccgcgtcgagctaaaccctaaccagccgcccattcgcgccgccgccgcagaagccaccgcgccccgcagctctcgtcgtcgtcgccgcggccgctcgatcacgatggctcccaccaagaaggcggtaaggttcctgatcgattgcgcctccctccccctcctcgtcgcgctctcccgctgcgcatctcaccatttcgttgcgatgtttttgctggtttctgattggt

SEQ ID NO: 45857 - DNA, 180 bp, Oryza sativa
tgtttggtgcatagtttttgggacctagtaaagcatgcagatgctgtatttagataatgaacagtctagatatgatattctagatatctgaagcctctatgtagaagtgcaaaattattatccaatcatttccattgacttcattccctttctctagtatgtgtcaactgcgatctggaa

SEQ ID NO: 45858 - DNA, 1501 bp, Oryza sativa
gggaggatcgatgaatcactggatggatcgccgccgctgtcagggcaggtggccgtcgctggcggctccagcgaggcttcgacgcgaacgtgaggacgcgtagatcggagaaagaaatggagcccggatatctcagattggatggagctcgtgtttcctaatcgtgaacggcaccgatcgagtgcagaagaggaggcgaaccaacacatttgcgacgaattacgaagacctaatcgatcatgagatgatgagagagacctgcaagaaacagattgctcccctactcatttctccacgtaatctctcaccatgagagcacccacaatggtaaagtaaggagctatctatataaaacatatacatctcagcagtagactagattaatagtaaaccactttaatggtatgtctacatgggtatctatagctctctaatccattgtttcgtttttctatagactatctccaggttaaggttagtagatagctttgctctctctctcttcatttaatctcttctaagtaggaaaatatgctaacatggatctcttgtagagagcttatagataagcattgtgggtgccctgagtgttgcttaaacacgaagtgatatctctcaaagaaaaaaaaaagaagaggaagagcggactagtgggcctgaaatgggtcgcccccgttctgggccgtcgaggaggagagtggtgtgggctataagcccagcagaaactggaggtcttacacgaagaggcccagttgatgggccgatccatgggaaatgtctagtgggcaggcctggaagatggagtcgcgagcccacgtcgttgtaggctaacaggccgaaacagcaactgcatttgttcgtgagttaagtttgcgatgatgacgataaattgatgagatgtgtaatttgtaaatgggataatttcgtttttacccccactttaatgtctaatattgattttatccctattttttagggttttcgtttttacccccacttttttaaccgaaagaggcgtttacccctggtttagacggaagttagtgagcccgggtttatggcagttaagaaataaagaaataaatgaaataaagattttttgaatttgtgatttacctttttacccctgggaaatatctaaccctatactagtcgcttctctcctctcgcacgcgggtcactctcgaaaccgatctgggcagcacaggcgacgacgaattgggcggcgtgcgggcagcggccaggcgacgacgtgcgggcggcggccaggcgcagctcctcctgccggcgagcaggcgtgcactctgcgcgggctaggcggcgggaggaggcgatggctacggcggctcgtcgcaggaggcgacgggggcaacccagccaggcaatggtggcggcggcagcgagtgggcggcggcgacgagcgggcgtcggccatgcgcacctcctctcgctggtgagcaggcgcgcgctctgcgcgggctaggcggcgggaggaggcgat

SEQ ID NO: 45859 - DNA, 1501 bp, Oryza sativa
tcgcgcacacacacttacgggtctcggagacgaacagcagcagcatgacgacggaggcgacgaccgtgacgacgccgccggagagcgtccgcttgtagaagtcctcgttcaccttggggtacgcgtccagccccttcagcttctgcaggaacccctccatctcccctccacctccacctccccacctccgccacagccgccaagtccaccgcctcagctgcacgccgaaagcgagcgagcgagccaaacccctagcctcctcccgagcccgatccgcgctcccctcgccggcgaggagtggtttgaccggcgccgccgcgtcgccgccggggaagagagaagagaagatgattacgaggaggaggagatgtgaaagcggccgcggtaatggtgggatttaggacaaatttctcgcgcactcggggacacgtggcggcgcgggattgggtggagggggcggaaatgcgttggacttggtccgacgtggcaggtcgggttcgggtgggaagcggttgggctggtcgaaccaactcccgcatcacgcaccggcaattatgagaggagattagggagccgctatatttgggtattgcgtattattatggcaattaaactcgtataatggttgctctacttcatatattccataaaatttgtcaattttttgtgctatatttatgttttggttttgggaatgtgaattttgtaggtaaccaaaccatgttaatgaaatggcataatactgtgccaggtgtggattctgctggcccctagaaccttccgtgatggtcaacatttgtttcctttctttggtccacgattatggcttgttcagtttgctaccattttcaatcttatcaagttttggcaaagttaaaaaaaaagttgctacatttagtttgttcctaaattttactaagcacatataaaatcttgtcaaaatttgacaaccttgccaaaattttggcaaccttgctaaaatttgacaatactataatttggtaaggttgaaaatggtagcaaagtgaatagacccttagttaatagggaagaccactatgagcccatgatactaccaactacggcacactagtagtacaaaattactaatcccgtgatagctaatctgtgtgcccaattagatggtgttgacctgctcacatcaacttatcagtaaacacgtgccttgttcaaacaaaaaatgtttcacaaaattagttttgttagatgcacttctaacactacaacaatatatagaaactcacttaaattaacctaataaatacacacgtactcctagcattaagtacgctcgtatcacaaacggatgaaccttacaatctgggagataggcattattacgtcacggaatatagaaaagcataaacaaaacagcagctgctaaacggcgataatcaaatcgacaagcaaacgtggaagccacactacgtttccagattctccaggagcagaaaccaaaacggcaatcagcgaatcacac

SEQ ID NO: 45860 - DNA, 1501 bp, Oryza sativa
ttatatattgagcaagtttattctcctgctgttctgtgagcatcagcaaagagagcatcatccaagatgtttgcttccttgcttatgtggttcaaaagctagactatggttgttaactatctcgaagcttcgaatcacttgctttgttttttatccatggtgtgattcgctgattgccgttttggtttctgctcctggagaatctggaaacgtagtgtggcttccacgtttgcttgtcgatttgattatcgccgtttagcagctgctgttttgtttatgcttttctatattccgtgacgtaataatgcctatctcccagattgtaaggttcatccgtttgtgatacgagcgtacttaatgctaggagtacgtgtgtatttattaggttaatttaagtgagtttctatatattgttgtagtgttagaagtgcatctaacaaaactaattttgtgaaacattttttgtttgaacaaggcacgtgtttactgataagttgatgtgagcaggtcaacaccatctaattgggcacacagattagctatcacgggattagtaattttgtactactagtgtgccgtagttggtagtatcatgggctcatagtggtcttccctattaactaagggtctattcactttgctaccattttcaaccttaccaaattatagtattgtcaaattttagcaaggttgccaaaattttggcaaggttgtcaaattttgacaagattttatatgtgcttagtaaaatttaggaacaaactaaatgtagcaactttttttttaactttgccaaaacttgataagattgaaaatggtagcaaactgaacaagccataatcgtggaccaaagaaaggaaacaaatgttgaccatcacggaaggttctaggggccagcagaatccacacctggcacagtattatgccatttcattaacatggtttggttacctacaaaattcacattcccaaaaccaaaacataaatatagcacaaaaaattgacaaattttatggaatatatgaagtagagcaaccattatacgagtttaattgccataataatacgcaatacccaaatatagcggctccctaatctcctctcataattgccggtgcgtgatgcgggagttggttcgaccagcccaaccgcttcccacccgaacccgacctgccacgtcggaccaagtccaacgcatttccgccccctccacccaatcccgcgccgccacgtgtccccgagtgcgcgagaaatttgtcctaaatcccaccattaccgcggccgctttcacatctcctcctcctcgtaatcatcttctcttctctcttccccggcggcgacgcggcggcgccggtcaaaccactcctcgccggcgaggggagcgcggatcgggctcgggaggaggctaggggtttggctcgctcgctcgctttcggcgtgcagctgaggcggtggacttggcggctgtggcggaggtggggaggtggaggtggaggggaga

SEQ ID NO: 45861 - DNA, 349 bp, Oryza sativa
cctaagttgacgtcttctgaagccttcttgtaagaactgccagttcctttttttttttttgtgtgtgtgtgtgtgtttctagtttacaagaacctatcatggcccaaatctcatggagataggactggatctatatcttgcccttaacatcaaggattaatcctgaactgtaatttttaacaaggcggtaagatagataaaaatattagagaatatctgcccatgtagccaaaagagataagattggcactaagtatagtgctaatccactggcaaagtcaacttcagaaaagaaacctcacaaatgtaacaggaatcagcatatattaaagtattaaacacaccaaaa

SEQ ID NO: 45862 - DNA, 1501 bp, Oryza sativa
acatccagcatgatgcaaaagttttaaaaagtttgaaattttagtgtttcaggatgttacagttgatgatcctgaacgttactctcacactcgcatatatatattccgcagcgaccagaaggaagaacatcagttcttcccgactcttgcacttcgagttcctccccctctgttcttgggctgtagaatccttcctcggttctgttcacctgcgtgcacaggtgtacgggatgagcatgtgcttccggaactccgtccgcttgagaaactgcatgggtaggcgggcgatcaaatttttgggtagcgcttcaagcgcgactgctcctattcttcgttcttcgacgataacgttgcatcttcctctgtttctgcttcacgatcacttctaatggagagaacggatgagacaacatcaacggaggcaatatgaatacctcaacatcttctgcaccattccctgggtataagattctaagcttatttgattttcttcttgttatttacatgttcacaatgttatccataggattgaaattctatgtgaacgtcaacgatgtctatgcttattttgccataagcatgctcatgtttatgtttagcctcatcaccagatcgcttctcattgtgtatgtcttgattattgtcctaaaattttggattaaaatatgctaaattatgaccaaatttctaacaattaattgtagtctaacttgaggatggatacattattattgcattctaaaaaatggaacaaactaatgtacgtaggacaaccaacggtcggataaagctttttatttgtgcagatatatttaatttgatttccagaaggatgtaattaaatagtaacgatgactaaatttgcacatgatagcaatcaccgtttgctgctgtcttgttcatcagctgtgtgtgtgtgcatgtgtgcgaaacatcatccacgttggtgttggtgccaactgtcaaggctgcacgtacttgccaggaatggcgatttcttttggttctcaaaccgatagcgataatggtttgtgttggccttcggtagttcgggatcctaattaacacagttgaccttccacggaaacaattaagaaattagcacaaacacacgtttgacctagctagccaacaccgtgtacttggcatcattagtttagtccgttttgcatcgatctccagcataatataatatactccctccgtttcccagtgtaagtcattttagtatttcccacattcatattaatgttaatgaatctaaacatatatatttatctagattcattaacatgaatatgaatgtgggaaaaattagaatgacttacattgtgaaacggaggaagtagcatctaccttcgttatcttgtatatatatactactccttccgtcccatattacaaatcgtttgaatttttaaattatttttaaaataagtaatatttacaacaccaaattatttttattacatttaacattgaatatattctgatactccct

SEQ ID NO: 45863 - DNA, 1501 bp, Oryza sativa
gatgttaatgaatctagatatgaatctaaatagatatatgtctagattaattaacataaatatgaatgtagaaaatgttagaatgacttacatttttttaaacggagggagtatcagaatatattcaatgttaaatgtaataaaaataatttggtgttgtaaatattacttattttaaaaataatttaaaaattcaaacgatttgtaatatgggacggaaggagtagtatatatatacaagataacgaaggtagatgctacttcctccgtttcacaatgtaagtcattctaatttttcccacattcatattcatgttaatgaatctagataaatatatatgtttagattcattaacattaatatgaatgtgggaaatactaaaatgacttacactgggaaacggagggagtatattatattatgctggagatcgatgcaaaacggactaaactaatgatgccaagtacacggtgttggctagctaggtcaaacgtgtgtttgtgctaatttcttaattgtttccgtggaaggtcaactgtgttaattaggatcccgaactaccgaaggccaacacaaaccattatcgctatcggtttgagaaccaaaagaaatcgccattcctggcaagtacgtgcagccttgacagttggcaccaacaccaacgtggatgatgtttcgcacacatgcacacacacacagctgatgaacaagacagcagcaaacggtgattgctatcatgtgcaaatttagtcatcgttactatttaattacatccttctggaaatcaaattaaatatatctgcacaaataaaaagctttatccgaccgttggttgtcctacgtacattagtttgttccattttttagaatgcaataataatgtatccatcctcaagttagactacaattaattgttagaaatttggtcataatttagcatattttaatccaaaattttaggacaataatcaagacatacacaatgagaagcgatctggtgatgaggctaaacataaacatgagcatgcttatggcaaaataagcatagacatcgttgacgttcacatagaatttcaatcctatggataacattgtgaacatgtaaataacaagaagaaaatcaaataagcttagaatcttatacccagggaatggtgcagaagatgttgaggtattcatattgcctccgttgatgttgtctcatccgttctctccattagaagtgatcgtgaagcagaaacagaggaagatgcaacgttatcgtcgaagaacgaagaataggagcagtcgcgcttgaagcgctacccaaaaatttgatcgcccgcctacccatgcagtttctcaagcggacggagttccggaagcacatgctcatcccgtacacctgtgcacgcaggtgaacagaaccgaggaaggattctacagcccaagaacagagggggaggaactcgaagtgcaagagtcgggaagaactgatgttcttccttctggtcgctgcgg

SEQ ID NO: 45864 - DNA, 267 bp, Oryza sativa
ttcatttgggcgaaaatagaccccgtaccatagcaatcaactacagctttctacaggaacagagccatgacctaactgaccttgaggaccctttcatagaagatgaaataaaataagcaatctttcacgcaagatcagataacgccccaggtcctgatggcttcacaggtgcttttttcaaaaaatgttgggagattatacaggaagacgttgttctggcgataaatcaggtggctaaccacgacactcgaagcctttggttactaa

SEQ ID NO: 45865 - DNA, 318 bp, Oryza sativa
cggaataagaataaaaaacactttcattttacatgcataatgcaggcacaatagtgagcttggcatctgcttcagcaaacacaacacaatcctcagtgacattgtcaccgccatcaccatcaacatcttgactggcctccagtgggaactggatcggtgttactactgagaggtgccgcaactccagtcagatcagcgcttgtagttgattgaaccttgatgtcacagcatgtcttgagcatactgttgagcgtggcaatcgtccttgtgcacagtttgtttggaatatcaccgctggttcctcctcgacttgagcta

SEQ ID NO: 45866 - DNA, 1501 bp, Oryza sativa
atatatatgaaatccaccgaacagctatactggagacaaaagcatctcagtttatacatatcgcagcatcgcatatgtgaaatgaactaaacatgtatcccacataagcgataaaaaaaccaacctacgaaagaatatataacataacaggacaatacaaaaatgaaataatgtaaatatatgccaaagcacagctaattagcaatccaagggaaaaaacagaggagcaccatatatgcgaaatcaagcaaacaggtattcgctgacataatcatctcagtttatccatataccacagctccacacatatgtaatgaactcaatagccatcccagtgataaaacaatgtgatcttgtattaaataccttagcgagaagtagctgacgaaggcaaagatgcccccctccctccccccaaaagaagatgcgatgtgtgggagagacgccaattggagcccgcaacctggaaggcagagaaaaaaaatacactgagcacacgcatggatggaacaacatcggcatcgcaatggggaaatcgacagcgagacacggcaggaaagatgaaaaacgaaataacataaatatatgccaaatcgtagctaatcaggaatccaatgaaaaaaacagaggggaaccatatatgcgaaatgaagtgaacaaacatccagtgacataatcatctcagtttacccatataccaagcaccacacatacgtactgaactgaacaggcatccccatgataaaaccaggtgatcttatactaaataccttagcgagaagtagctgagggaggcaaagatgcccccctccctccccccaaagcaagacgcgatgtgggagagacaccaatccgagagcgcagcctggaaggtataaaacaggaaaaaaacagtgagcacaagtatggctggcacaacatcggcactgcaatggggaaatcgagagcgagcacagcaggaacggtcggaccacacgagacgatgcggtgagggaaaccaccgagctggaaatcctcaagaactaagcaggaggagcagcaaatagaaccagctccatatatggaagaaaaaagggagtggaagaaagaaggagcgatgcagattacctcccctggtcctcatagggctctccgcgtagtggagcagcagccgtagccaaccccgtcgccgccgtacgcccatggcagagcactatcgtcgctccgtcgctgatggtcagataggggatggagaaggggcacgcgtcgagaggatagcggcgaccgacggatgatccagcgcacaggaaacccaggacggagcaaggtcacggcaccgatgccgcgatgggccgctgagcactaaaaggctgccgtgcattgggccaaaaaatcagctggcccatagaagcgctaacctggcttggcagttgatcaactgtaacaaaacaacgtgtcacgattgtattggataacggctggctcaatcacccggaaggcagctaatccagcacctttaaga

SEQ ID NO: 45867 - DNA, 395 bp, Oryza sativa
tgggtttttctcgacgtacaagctgagatccgtgcctgcaaagagcgtggaattcaacgtacttctccaacccgtgatgtccattgtcctattcataagacaaagaatcacgacctctcaagctgcaaggttcttctcagcaccatgaggacgtcacctcctaaggttcaacagtcacaaatctctcttagagatgcggacaaggaacgaggagtgacggttatctcagatcgattcgttggggtaatcgacatcgatcctcacgagctgtctgttctacacttgttcgaagaccagacctcatcatcaacgagtacaccacgtgatgtattcgccatcgatgggaccaacacatctgcgcacgctaacgcagaacggaggatcaagtggttaca

SEQ ID NO: 45868 - DNA, 1501 bp, Oryza sativa
gccccctgtgccgtcggcccgccgcggcgccgcctcccttccctgcaccacctccggcctccgtccaccgtccccagtgccgctcgagccgagctcgacgccccctgcgtcgccggcgtccctgactcgacgccgtccatcatgacatcacaagctggctcgagctggctcgagctttgaaacgagccgagccgagctgcatcttttgctcgttcaattaatcaagccgagccaagccgagcctgtagttgagcaagctttcacgagccgagccgagcttggctcggcttggctcgtttccacccctactgcggggagaggaaaaggggaggaagcgtactccgtctccgactaggattatatatactagagcggttacgcgtagcgcgctgcgcggctgctaagagatgggttttatctgatacgtaccggtgcagtatatggaaagcgtatttttggtagtggaggtatgtcaagctgttattatgggttgatcgtgctatgccataaaggagttatggccttttccttttatgtttgaccttgggcttttaaagatgtacagtcccataattagtgggctggttttgggatttatgatgcacggcctttttgagttaagctcggttgtcccagggcaacgtgtcatggtgggattgcatctgctttgctgaggctggtatatatgtggtataactggctgcttctttatactgagtggttgcggcggcgctgctactgctttgttagatcttgttgctataagagggactatccagttggtacggaggaacctgcacaaggtatgtgtattaatgtatttgtatatgctccgattaatcttggggacctagatatactcttataaatttgtggtgttagttttgttcggtctcttgcatcttgtttggtctgaaggagctgtgtacgaggggcttgtttttttagatgtgtgattatttttcagttgacccgtgttgatctggatctttatagcagcatatggtgatttggatgatttatatataaatggatgattataggaagttttaggaataggggaagaaaggggatggttttatgatgtcggtatggttagtgatgttgtttttgttatggtttaacagagcagcgtcggctcgtgcagatcaggtccaaaacgttgctatctgaggttttgagaggcataggcgcaaatgaggcacgatacagttgccgtgctgtagcagatggctatgttgggtttgctgaggcaactgtttatggtgcaagaggagttggagagccttttgttgttcgtgcacagggtatttcagctataagaccatgtgatgcggaagaaagcgctgcacatgctttaatttctgttatcaagaaagaatgtagtgtggagttcgatgatacaaactggtttgacatgaatcgctatcatgttgagacagagcgactgaagagagctcttgggagagctaggaagaaatgcaatactcttgcaaagaag

SEQ ID NO: 45869 - DNA, 1501 bp, Oryza sativa
cacatcgtagaatactccaacctcacgatgactaagatcatcagcatcaggacctcctagaacaaaagaacatatgtcatcacatatttggttgacagaaccccaatgaatctaaagctctatcccagccgatttccagcaaccgtgccttctttgcaagagtattgcatttcttcctagctctcccaagagctctcttcagtcgctctgtctcaacatgatagcgattcatgtcaaaccagtttgtatcatcgaactccacactacattctttcttgataacagaaattaaagcatgtgcagcgctttcttccgcatcacatggtcttatagctgaaataccctgtgcacgaacaacaaaaggctctccaactcctcttgcaccataaacagttgcctcagcaaacccaacatagccatctgctacagcacggcaactgtatcgtgcctcatttgcgcctatgcctctcaaaacctcagatagcaacgttttggacctgatctgcacgagccgacgctgctctgttaaaccataacaaaaacaacatcactaaccataccgacatcataaaaccatcccctttcttcccctattcctaaaacttcctataatcatccatttatatataaatcatccaaatcaccatatgctgctataaagatccagatcaacacgggtcaactgaaaaataatcacacatctaaaaaaacaagcccctcgtacacagctccttcagaccaaacaagatgcaagagaccgaacaaaactaacaccacaaatttataagagtatatctaggtccccaagattaatcggagcatatacaaatacattaatacacataccttgtgcaggttcctccgtaccaactggatagtccctcttatagcaacaagatctaacaaagcagtagcagcgccgccgcaaccactcagtataaagaagcagccagttataccacatatataccagcctcagcaaagcagatgcaatcccaccatgacacgttgccctgggacaaccgagcttaactcaaaaaggccgtgcatcataaatcccaaaaccagcccactaattatgggactgtacatctttaaaagcccaaggtcaaacataaaaggaaaaggccataactcctttatggcatagcacgatcaacccataataacagcttgacatacctccactaccaaaaatacgctttccatatactgcaccggtacgtatcagataaaacccatctcttagcagccgcgcagcgcgctacgcgtaaccgctctagtatatataatcctagtcggagacggagtacgcttcctccccttttcctctccccgcagtaggggtggaaacgagccaagccgagccaagctcggctcggctcgtgaaagcttgctcaactacaggctcggcttggctcggcttgattaattgaacgagcaaaagatgcagctcggctcggctcgtttcaaagctcgagccagctcgagccagcttgtg

SEQ ID NO: 45870 - DNA, 622 bp, Oryza sativa
ttcctgcagccctattatgtgagaaaaaaataaaacgatgctagccgcacaattgcgcagccataagatctggtaatacaaaagtaatattattaataaatttgctatgaaaaatagactttatatagccatattttctgttttgtcatcaatatatgattagaaaagagtaacaaaaaaatgtgtggtttggagctaaacacttgagcagttaaaacagaagagaggaagtactatccacttgcttcacaacagtacaacacaacacaacaactgccaccaacaaaatttcagttgctgagctattaaaaacaacactaaatttttgcctcccaatgaacaactacaccagcatcttggttgcccttttgtttatgccatcttgagccttgtgccctcgaggccttgacttccttcccctacccccacccccaacatctccctgaatttagctgctttcgcggcacagatcagtgcgcaagccataaagatcgagccttagcttcgagctggaatttatcggcggatcggctggcattttttcagtttgtgcgcgcgcctcaagctcaagaaccgggagagagatgagctgcttcccgtgctcggggtcgtcggggaaggg

SEQ ID NO: 45871 - DNA, 382 bp, Oryza sativa
tgagagctggagctgtgccaaacggggcatgaagtgtgcgactgaattggagttttccatcttgaattatatatcagcacattcatctcttttatttatcagacgacactttaaattgtttataaagaaccgtaaaaaagacttaatactttgtttctgttggaaagagataaatatcaaccaacactactagcttgtaaatctgacatatgtctttttaagctttagggcatatttgatttctccggccttcccctgatccaagcttgaaatgtacacattcagaatgaaaaataaagcacacaaaatatgtataggatttggaggcatcgagaacattgatctggccaataaagaagcttaggtaagaacaacctcagca

SEQ ID NO: 45872 - DNA, 209 bp, Oryza sativa
attttttttctagtatagatatatattgaacatttgattttacaatcatatacatatatatcaatcacacagtgcacattacacacttatatacattacattaccagtgatcgtacatgcatgcattacgccatctgcatgattatgtatgtatgcagagattaaaccaaaccaaaccaaaccacaccacaccaaattaagcaaagcaa

SEQ ID NO: 45873 - DNA, 359 bp, Oryza sativa
gccattggaaaccacccgaaatggagaaatggatcaaacgccctccccccctcccccccgcgcgaggttgcagagaaatggagcactaatctttgcaacagaaatgccacgaacagaagctgctgctcctcctcgaccttgtcctctccgaatggctcacgcaaccatctgaaacagaacaagaataagcacaccggattaggcgaaaaagatgggagagaattgaatgccgcgcagcatgcataaaaaaaaagaaaagaaaaactcgaaagaaactcaaatcaagaaaccgagaagacgacgaatccaaagagagaacctacctcagacaccgcgccaccaccaaatcaaccgcgagg

SEQ ID NO: 45874 - DNA, 1501 bp, Oryza sativa
  unsure (1)..(1501): unsure at all n locations
gagtcaggacctctgacaggctggcgacaagaggttggccaaacggttccatttgccccttatgtcgtcggacccaggaaacaactctgcacctcctcgcagcatgtagatacacaaggagagtctgggcggcactagcggagtgggcgacgtgcgagcaactaaatcctagccaatggaggcaaacttcaacggtgctagattggtgggaggctaccgcaaacatacaagagacacctaagaaggcactccgcactttgatgttgttggtcgccttgagatatggaacgaaaggaatcgcagaaccttccaacagaaggagctttcagctacctcccttttagccaagatcaaggaagaggccaaaacttgggccttagcaggagcgagaagtcttaatagctgctttcttttagttagctcggaccaaaggtcctagctcctttcttttttcctttcgctttgtaaagttctccttctctattcaatgaaattggcgctcgtcgattcgttcaaaaaaaatagactaagctgattctaagaattcaaactttgtttcaaaacaagttgattcttacagtttacaaaaattatccaaaaataagttgatttatatatatcctcttatctattcttggtctgtaaatcgacaagttttattctcctatattagccgttatacatatatatagcagcatgatgtttttcatatctcatttctcttcttaaatattttaattcaggtgctgtaaaaaaattgccatgcatccttagttgatgtagaggccgaatcttcactttgtttaaaaagaaaagatgaatacatgttgccacaaaaatcctagggaacctatatatattaccacgaggtacacgctgttgaaatgtccccgtagaaattgttgtcatgcatgtgaagaaagcacaattatcatggttggcatgaaagtgaaaccggtcgatatagaaggatgagaagaatagattcattttttttttgaagaaaaagcggcaagagaattgccgattatattaggaggtagaataaagtcttacagcatagttcttagaaagattaatacatcttgggaagaaaagataggtagaaaagtagagctagtaataaattagcgcggtttgaaaacaaaatcccgatctctaatgtcttccattatagcagttatagtctgcgggatgtctggtgattggttcctgaagatttttgcatttctcattaaccaaatacgccaccatggtgttaattagaaggagaagaatagattcattcacgggtaaaaccccatcagtcgacgtcgtcgcgcgctgtactacgtggtaatcgattccatcgtcgcatctgatctcaacaccactctacatacagtatcttttagccaagccaggtgtactaccacacactggcagtatgtacagtactgcatccagctatagcccccccnnnnatatacggtgatatgcagacgcaggtagcagcatcata

SEQ ID NO: 45875 - DNA, 1501 bp, Oryza sativa
taacaacaaacgagcaactaagatttctattattttccttaaaaagtattattatttcaccctcttcagtaactactttttattatttaaccctgatttttccagtgtgtggctgtgagctttcaccgtttgagagcagcttcagtgctggtgtgtttggatcccagccattgaatgccatagctacagtattttcgccacgctatagtgttttacgaaacgtccgccacactcctgtggcgagccacgccgtggcgtggcattccaagccaccaaccaagcatctctcaacatgattactgcgtaatctgatttttgccaactaaccgccacgtcattgagattgagaacgaaatgtgtacagatgagttaatttggatgaagtggcaaaaggaaggtgacatggcaggcagcatcggcttgattaatcactataaaagggacatgatgttcttagttgttaaggcaattaatttattcacgttggataagatagaaccaccggtccatcaatattggtcacaaatagatacggtatccttgatcagtttatatctcaaatagtttttttttaacaactcacacgaaacggtgcgaagttctattcatagagtagaaaaaaatacaagattacaaccctagaaagtcgtaaccaaaaaaataaaaaaattataccaccacccacatactaactgcgccaaacacagacccaggagaagtctagcaccggaccggccaccactcagcgtgaccgaccgtcgctaggccaacaatggaacacatccgagatcgcccaaaaacatgacccttacaaccaacgcaaagcccgactctacccacatcttcaggatttagggagagggggtgagagagaagatggaacacctctccccctagacccttcgacatggccaacttgtagaaactaggccacctccacaagagaatgagaatctagagcgtgcttgcaccaaaagctcgggtggtttcggcaaggggatgcctagacgacgtctccaaggagaggagcgacggaacaccgccgccgccgtccgtcaaggactcaagagagccgatactaggctttcgctcagcaaccgcccttgaggggtaagatggcactacaacaccctcaagaggggaaatgacactcgagcgtcatcgttatcggtctggccaaggccgggctgggttttcactggccatccaccacctaccaatataccacagatgcaccattgctccactgccaactaaacctccgccgccgcgtgggcacaccgcaccagtgccccccgccggccagtctccacatgcagctacctcactgggctccacctccattggcttcgcctcccgttgcgcatccatcgtgcgccagccgtccttgacgccgccggccacactgcaaggctaccggccgcaacactctaccggcattggccagccacagcccccggccctcgtcgttgccctctgccgcaggcgcggcctcctgccc

SEQ ID NO: 45876 - DNA, 1191 bp, Oryza sativa
tagtcatccagtacgcttggtccctcgtgcagagtgtggacaggcctagcggcgcccgactgtgggtaagcaaggcactgtagggctcccacactacgtccgtcggcagaaggcggtcgaactccatcacaaactccgcgtacgaccgcctaacctgcacgtgagcccatcggcgctgcaatacaataaggtcagtgtgacgtaggatgaagttaacaatagtaggacaacattaccaaatactagcgacgtacctgacgccggcaccacagagtacccatcgttgggtagtcgaccgccggtctgttctcgtacagcgacgcgtcgtaagggtggtgctccacaagggggcggccgatcgcaatcctctcagccgcccaaagagaaatgaagagagggcacccaccgaagatcgcgccagggtccgtcctggtacaagcctcgcagaggccacggtactgagccgccagcaacgcggagccccaactccactgaggcacctcaccgaccgcggcgtcggcgatgctcctggcgtagtgcacgagaccccggtcgaccgagtgtccgtgactaccacagaacatcacccacccaaaaagccacaacaagtacgcctccaaacaacggctgaaggagtactcgtcggcctcctccggtagctggtcaacctgcaagcgttggatgaaatgttaggcactttacaagttacgtacataatacacgtcagtttaggtagaaagaacttacagtgaactgaagcagccacctcttcgtaggcccggtgttgcggtgctgctgcaacggctcgagcggtagacctggtaggcgctgcacgggtgcgaaacgtgccgtcagctcgtccttccagtcgacacccatgtcaactggcccgacagcgtctcccgcgagcggtagccccaacaagtaagagacatcctgcagggtaggggctacctcaccgcacggcaggtgaaaagtgtgcgtctccggcctccaccggtcgaccaacgctgctaggagggacctgtccgggtcccaacgtctcgtcacgtcatcgtcgccggtcgcggcctcaactagccgagccaacggtaagagaccggcctcacgcaacctgcgaaagcgaaataataccagacgttaaaatgaacacattgctaagccccctccaccgtagtaaggtaagcccgg

SEQ ID NO: 45877 - DNA, 304 bp, Oryza sativa
actatagggcgaattcgagctcggtaccctcttactttcacgtttaaaatatctttaataataaaatatgtcacaacaaaataaaggcataaatatttatgactataattgaacgagcatactgatggagagatcaagaatccaggtagaagagcatcatgtgcgctttcttttcataaaaagacattgtgcgacaattaataatggcatcactcatctgtcgtcactcgtcacgcatgtgctcaatccgaattaacaaagacataaaacaaagttattaggtgaaaccacctgcgctgcgcta

SEQ ID NO: 45878 - DNA, 717 bp, Oryza sativa
ttgatgagatgcggacgtgccagtcagtttgatcctgcaactgacaagatatgcaaatagtagatcaaaacatccgatcggctgacatgccgatggagtagttccagccgatagctactaatagccgatgccgatactagccgatagcgatatggtttaagcaatcggctatatgtccaatgtagataatgatataaaggcaatcggctgatgatgatgtaataaaataataatataatccagtataaaccaatcggctagcattgatatgataaaaaagcactaatccgatagttaaagcatacatcggctggaggtctgatgtcatgaaatccacaagattagattaaacagtgaaacatttgttgtcatcggctaaatccaacttatatgtatatgcaatccttatgagccgatgcaacgtccagataactcaccagctgaaacccttattggcagtcaaagagcaggctagagattatggttctaagcacgacttggtatatcaaacttaactgatgcagcactaagtatgaaaagaaacataatatctagacaatcaagccattgactgagttttcagggtggtagatgtctaagctaatctaatctagcaacgtgatttagccgataccggcagaaaccctaaaacgagaagcagccgatagagctaaattgatatgctaagactagattaacagagacatatgataaata

SEQ ID NO: 45879 - DNA, 161 bp, Oryza sativa
aataatagtggacattttgtctcctcgacgaaaatgtggagggagcagtgagagaatggaggataagcacggcacaaacgaggaccatgaataggagcaggtggtggtctgtgcctgtctgtcacgcttgactccgtctctgtctcttgtcgccgcgcagg

SEQ ID NO: 45880 - DNA, 1501 bp, Oryza sativa
taattaagggcttgttcggtagttggggtggtttttccccagggaaaataccactaggcggcagggattgggtggatcccctcccaccacccaattcccacgtcaatccactccaccatgggatataatcccctcaacccatgggatctaagtatattggtgtggtaaataatagtgagtggtgagatatcatatcaatttaatagtctcactccagaaatttcaaaatattatgcacataattcgaaatactgcacaaacaaaatctaatttttcaggaaaatacagaaaaaagatatataaatgcctagaaaattacgaaaattgtagaaaattaaagaaatactgaagacctgctgcaaaatccatgtcgtaattgttacaatattgcaaaaaaaaaaaaggcaaccaacatgaagaaccaatacacgttgagatttaggacacaaatatctctcagtgttacaagtattaaatcgaacaagacataactttttttttgaggggaaaacaagacataacttgagcttcattgccttaatagttctatctagtaacaacactttccgacatacatcataatacatttccttgcatcattggtgcagcaaacaaaaggcccgtggacatcacatatcagaaaactgcacaccaaaacaatatgtcaaagtcagtataattatttgtgtcaaaagcctgacaggcacctgtaaatacacttctaaaaattcagctaactgttcattaataattagctaactgcatacatgttcataatcacagaaggaacatttcatcaaatcttcagcccatgaccagccccatctaatctaacttttgattgtaagtaattcctctacaattttatttaataacttagagactatccacatgaatcagacataattaattcttattagtaccatagtagcatattcaccttaatcaaattaactaactacatgccacaagacaattcaacagatccttcagagaaacatgcacctgatctatttctggatttaggatactaggagtaccaagtactaactgggagccaacaatatcatgaaaaaacatgacaatcttaccccactttattttctttttcaaaccaacaatatcatgaagaaacaggacaatttcatatgctaaagatgcaattatctttatttcacatagttgagatacattggcgcaaccattaacttcttcactgaaaaaagtctgggcaacacaaagtagcaggtacagggactgtaaaggaaactgaatcaaacgtcaaaaatattattagggggactcatcatgcaacattatctgtccatttatacacttctaaaaggtactttttgcatgcttaaaatgattgctccttgacaattagctcattgcaaagttcataacctgagcagtacttgtgtttagtagaaaagatgcagagcagggaaaaggaaaagaatcatatcgtcatcctcttcctcccgcttcctcattcgaa

SEQ ID NO: 45881 - DNA, 1501 bp, Oryza sativa
atgtgcatctcatgtggccagcatgactcacatacccaacttgtagcttatccagatgtctgttcgcaatcatatcgggtgatcaagccaacaacattcacgaggaattatccgttaacaacctatgcccaaatagtccaggcgtagccggcgctatacatgagataagtcatcggtcttcattggtaggtttggtgtgacaactcagcctttaccgagaacgttctcgataatggggtgtactcgaccacaatctacttgagtgctcgattgttcctgaaaaatattgtctagaaggcaagatatatagcagagaatatcgagtatgtactcaaagaactgcatgaatcttctagcattattaggatataacgagcatatttaaatatcaggcattacgtaaaccataagcaagcatgatttatacaaaagaaaataaagcgagcccccagtattaaactgtagttgggctaacttcagaaacactcgcacaatagatattgtataaaaaacatgttctaggtaaacataacaaattactgatatgacaatattgtatagatagtacgataaattgcatataaaatatggcgtacctttgtagatacataccagatgtatctacggaattagtctgacaataccgttgattttctatatatgaggtatgattccatataagacttggtatatggtgggccctgccgagcttagtggattactattgggtatgtggtatcaataaacccgactaggggtggataccgagctagcttggctcggctcggctcagctcggtcaagcttatactaacatgctaataaaagtctagctcggctcggctagttggccagctcgagctagctcgtttagctcgcgagccaacgcagaagcaagaaagccaaaaattaatcagcgcttcaatagtccaacatagcagccaaaaaaatcaaccgtgcatataaacaacagttaagagatgtgttttctggacatgagcagatgagctcaatggatcatctggatatgtttcaagaacaacaaatgaaaagggaaaaacaatatcacagattctaatattcactcattcacagcgtgtacaccatcgctttattctgtaatctttgtcaaactccaccaaccgttcttgaataatcgagtagtcatccaaccattctcgactacgataaagccctgaaatatgactttcctgaaatcaatactcagaacagattgttagatacaaatagcccccgagcgaacgtgtcgcgcccggaaaaataccttttccagaacgctagtgtattaatccccgtcccaggaaaagtcggggtacaccacacaaacatgatatgaaaggcacatctttattatatcgataatatttacattattacaaaggcacttaaggcttgacaaacagaaataaacagcagcggactagcgggcctatggctccatcttcacaggcgctcaactagggtataagccaggacttcac

SEQ ID NO: 45882 - DNA, 1501 bp, Oryza sativa
tttgtggtgcctctttgtgagagggatttgagaaggggaaagagttggattgagagattgggaagttgagagctagtgagcttcactccatactttgagcactctagttcatagcaagcaaatcttcgattgtgtttgttactcttggggactaaggtctcctagatggtcaggcgtcgccggtgagcacccaaggttgtggtgtgccacggaaagtttgtgaaggctttgatttcgcctccacaagggaagaaatcaagagtgaaaccgaggagtgcatttgtgcaacctcgtgaggaaagggttgaaatagacccggccttgtggcccctcaacggagacgtaggatccgtggatccgaacttcgggaaacaaatcaacgtgtctcctctcttggtttgctcattcttgccttctctcatattgtgcttgagcttgtttttacccgatctacttgcatgcttaattgatttagttggtgaccttatatcttgcttagataccttatttgtcaccttttgattcatatacattttgtttattcaagctacaagttcatagctagtgttttatcccgttatctgccgaacctttcggttgagatcggaacttccaatcctataccggaagttccgatttgaatcaaaagttctcatcactctaatatgctatgaagttgtgataattttaggaacgcctattcacccgccctctaggcgacatcaaggtcctttcagccataacaagctttacctcttcgtcgaagatcgtacccgatgcagctcaactcgaaagcaaaaaaactcatcgaaacaatgaaaatagaaaagggtggcaatgcaccgaagtattattgaactatcgtcctttgattacatggtgtcgggtcatatttatacccgaagtacataacatgtacttgctggacacgactcttatctctaagacaatttaaaatgagtccttcagggggactcttaccaaacatatctctaaggaaactggaaaatgtcctagttaatagatacaattgtcctttttaggactccagtccttgtgtggcaatggctatgaagtgctgcgaccaatcccgacgacgaacgtgtgaccatctttcccgagacaggttgcatcggcttgactctgtcggatccggcgcttagccgatatgtggcaggcgatgctgcttgtaaccgatgcgtattctttctcgaacggaatttctccaactcagtcttgactctagctttgaatccatgatgtggtattaccaaatttgttcgttaacaacttcagcttggtttgttataagatttaagctgtctttgtggaaaaacgatttttccataaagatagctgggggctaggaagagtaccagactccaattgctaagggcagctttagcgagagtactcttttcttgtcatgtgcatattcaatttattttcatattatatcgtgttaccctagggcgttctgtcacgtcctgataaattcacc

SEQ ID NO: 45883 - DNA, 1501 bp, Oryza sativa
  unsure (1)..(1501): unsure at all n locations
aaaacccgccattcaaaattcccctagttttcaattccttaaattctatttaaattccttgtccaaagttcaaaaggttcacaaatatcttcctttagaatttttcccctttgaattctagtcaaattcaaaaagttcacaaacattcttcctatagatttcatctcctttgaattccattcaaaatcctctaaacaaaaattcccaaaggttcctattcaaatcgggccgaaattccttctcccatcggcccatttcccacctcagcccaagccgagccagccccagctgagccgcctccttcctcttccctgtgggcgcgcgtggcgcacacgccaccatcactatggctttgcgccaccgtcgccgtcgtgtggatattatgaataacccatacccacagggcatgtatatctgactgggtataggggtaccatatgtagatataatatctttaaaggactcggattaatttcctaacttgtgtatcaaggaaatacccgaggatcttagtcggttacgattgtaatttatctttacctacctattccgttaggaatatgggctgtaccctgtaatacggactcctccccttatataaggaggggttcgggtgcctcttgcggcataacttttctcccagatcatacgatcaataacatactcggcggatcaatccccggacaggagtagggtattacttctcattgagagggcatgaaactgtataaatctcttgtctctaaacccatccacttttcctgcttgatagccacccctttttgtattgccgaaatcttgtttcgacagttggcgcgccaggtaggggtagcgtcaagcttttcgccgatcagtgcgatggtgatacgacccgaccaaggccattcacacataatgtgattgttgcacatcaatgcaaggataacgctatgcttaactccaagtcttattgttttcatcaggaaaggctgctacttggcttgtatgattgtaggttaaagcatatcgttgtgcttaaagagagagacttaactcagattaccaccactacaccaaggcaacgtaatcgtgcactacccttgctatcatatgaacgtaaaccaacaattggattagtgccaccattgcaaggaccaactacgctaagccatgttgtgactccatcaccaagagattgtgctgagcaaagatggagtgcacaacatcattcaataaaaacacgacaaaaggttaattcatttcttgctaaattgaactttagtattgatgataattttatactatctaaatggtgtatatttgctttgctaaggttcataccaaaggagatggtcactactacaaatatcaatgactacatcaatgggggtnnggnttccacagaagatgaagtgacatttgctcaagtggagatggtttacgacaacgagcagactggttacacgcagatgctccaacttccaagggatgtgcgatccagccagtcaaatttctccatgca

SEQ ID NO: 45884 - DNA, 1501 bp, Oryza sativa
atcctggaagacacggagacgatcctgtgccgccgcgccgccagcgcccgccggcgacggcggcgcaggcggaaggtgatgaggacgagggggcgccggggtgggtggggccctcacgcgccccgcggcgccgcgcagggtctggcccatgtggctccggcccgccgccgacgacgacgaggaggagaggcgaggaggtgggggatgacacgaggcgccgcggaggtggccacgcgtgttggggggaggcgagaacttcgtcggttgctgcgatggtgggagacgggctggattttcggcccaaacgggtggtgttccggcccaaaactaaacagacattgaaattaaaagaatttatttatttatttttgaaaagatttacaaaattaaatttccattttaaattttacaaaactatactccacccgtagggcggggcatataaattttcctaggggacggtggctaagagtgacatggcggccgcggagaggggcgcgccgtgatatttttgcaagcggccccttctcgccctacgctagggcgatttatcaccgcgaggagaccactgcaaaatttctcgacgccccctcccggccaggggaccggccattccccgcccaaggggagggtgatttttcaaccccccctccccgcacctataaaactagggttgtcaacgagccgagctcgagcgagctcgtctgcctaggctcgagctcaatacaagctcgagtcgagcttgagccgagcctataaaatgttcgagctttccgacaggctcggctcgagctcgaccaagctcgagctcgaccaagctcgagctcgactaccgagcttgattttcaaggaaaacaatatatatttcaaagataatctttaaaaaataattaatttctagttcatcatattaatagaagaggaaaaaagaataaaataaatatatgatgtcaatataaggcatacaaataacatatttgatctcctaatttattaaataacaacaaaaatcatatattactaggctcgttagaaactcgagctcagctcgaaaaaaagctcgcgagcttagggacgagccgagctcgagcagctcgcgagcctcgagcttttttgacagccctatataaaaccctcccttcctcttgaaaattctcatttattcataaaaatcaagaaaaaaaagaaagaggggtaaggggaaggttaagaaggaagcagcagagccctgccggatcgcacactcgattggaggtaattttttttccattaccatttcaatgcattgcaagtttgagtagggacaatattttagcaacttattaatttgtatagaaatcctatgttagtaataacatccaatgctaggggtgtagatctagtacgtatgtatgctgtagtaaccttatgacatatttaggtacttatacatttagcaacacagatagcaattgcgtttattttaatatattataacgagactttaatctgtgagcagata

SEQ ID NO: 45885 - DNA, 178 bp, Oryza sativa
tctgtgagtaaacatttttcgatatttgatctacttgtgaatactgggctctccaggggaaaaaagaaatgggcaaaaattgaaagaatgtgcaactctgcaggaaatatcctccatacatccaatgctagtatgctactacctgtatcgatgaatttttatccattccacctccaga

SEQ ID NO: 45886 - DNA, 285 bp, Oryza sativa
gcgtgcatggttttagatgccgcgaaaattttttagttagactttgctttacgctggtgcattcatttgtgggctggcagatctctttagcagctgccagccggtttatgctagctgacatttaaaaggtttgcctaaaaaatatagtattttttatgcggacctcttaatgtgacactgacggactcgtgacccccgaattttctacgccggcgtttttttctcgtagccgccaaaaaaaatattttctagacgccattaaaaatcgtttttctagcagtgata

SEQ ID NO: 45887 - DNA, 235 bp, Oryza sativa
tttcatgattatggcttctagatggatactatgcgtatgtaatacagttgtttgctactaatgagtcaagttggagatagcttggtctcggaatatggtttctttatttgtttcatgtgtaggtgacttgatgcctcgggatagtattgccggcgatggatcgggagtcgacttcgtggaaaggcaatgtccgcgatggtcagatatcatgcgggatacttaggctagagttcaa

SEQ ID NO: 45888 - DNA, 236 bp, Oryza sativa
gcacaaaggtggggttgaggggaataagaagggcaagagaaaagcaggtaccaaatgtcagcaaaagtgtcctatctgcaaaaattatggccatagatggacaagttgcaaagaagcagatccagaagccaaagaggcctatgctttagtggcaaaacaaaggtgatttctatatccatatcttcatgttgatttcctttgccaacaaacttcacttattttcattttcctgtaga

SEQ ID NO: 45889 - DNA, 226 bp, Oryza sativa
ggtgaaaaacacacaataagggaaacgagccggaccccaaagaaaaaaaagaccgggtcacgagttaaggtagagaaacatgaaccgcaccaaccacaagccagcgtgggcaacggctaaacctggcgtatagcagggctcatggtggagcaccagacagagaagtggcggagaaagcaaatgggggtcacgggggagtccatgccgtgaacataagggggtgaaa

SEQ ID NO: 45890 - DNA, 381 bp, Oryza sativa
tggtcttctgttgtgaagatataacaatgccatagcctggacaagtgttttcatgtatcagaacatggtagtaattattttattggtggcctggatggttagaaatatgataattgataaggattgcagtaaaaatgtcccagctatattctgcttctcatcccatataagtggtgccacctagccatcctcccagtagtatttaactatgatctagtgaatagtgataattacaaaaaggaatagctacataaagccaacattatgtttgaatgttggaatctttagtaccatgatgtgaaccaggctactggaattttggagtgtatcttcatatcttgaggtctagtcctatttttcattttatgtttgttatacaga

SEQ ID NO: 45891 - DNA, 552 bp, Oryza sativa
aatgtgtaaaggaatactttgaatgctaaatgatgacaacatgaagagaatagtggaaagtaaactgaacataaagaaagtgaatcggagttgcttgttcatgagagctattcccagttatgaaccaagtgatatgttcgaagatagtctatagaggtcagattaaaatcacatctacaaacgaagcttcagatttgacaggataacgatcagacaataagaagtccagcagtaaagccatttgggaagacgtcaaagcatgtcaagtgggataagttggttctttttagaaacataattcaaaggcaaagttaccgacccttgcatcgaatagcagaagtagctagcacccggagagcaggaaagctaatatgaggcagttggtggcaagttagaagtaaatgacaagcatgatattcttatgatgacaaacatggtatcctagtaatgacaagctagtgttgacgcataacatgaagtggtaacctgtatgaggttgactccaaagatatgagttataagaagttctggaactgaagccccatcttccaa

SEQ ID NO: 45892 - DNA, 372 bp, Oryza sativa
cttttgggttcctgatatcatccagattcaatcttgcattttgaagttgcgaagatggacaagtgatgagagagcagaaatttcacctgatttttgtagagaaaaaaattctgattcaccatctaaacaaatcattatcaattcaattttacccccaccgtcgctcaacaagtaaaaactctcagaataattgaaatcgaagggttggtccatcatggcaatggggtcaccactcaccacccataagctcctctcctcatcatcttcttcgctcatctttttctctttctttcttctcaccttccccggctatgtctcctcaagacgcgcctccacatcgggcgacggggctgcgccgccgccccgcgtagc

SEQ ID NO: 45893 - DNA, 156 bp, Oryza sativa
ggaccgccgccagccgttgttgccgcctccaccgggccaccgccgaggtcggccgcctcccctccggctggattcggcggaggggagggcgcggccgccacaagccgctgccgcctccaccgggccaccaccgaggtccgccgcctcccctccagc

SEQ ID NO: 45894 - DNA, 1501 bp, Oryza sativa
cgctccaggttcacggcgtcgccggcggaccggccgccgagggacgtccggcggagtgtctccggcgcgacgccgaaggtgagcgtcgacgccgccgcgtcgatggccgcgacggtgaggcaggccccgtcgacggccacgctgtccccgagctgcgtcccggcgaggagggtgctcgtctccacctcgaggtcaacgccgggggcctcgccgccgccgccggagggcggcgcgggcggcgggccgatgcggcggacggtgccgacgtcctcgacgatgccggtgaagagggagcggacggggacgtgcgacggcgaggagagggtcttggggatcggggagagggagaagcgcggcggcgggaggcggtggcggaggggcgcagcggaggagacccgggaagcgaaggggagcggggaggccggcgaggggaggatgccgcggcggaggaagtgcgggcgcggtcgggggagaacgccggcggccatggcggtggcggtggcggcggcggcggtcgtcatcgtcggcggcgacatgggcgagatttggaggatttttaggatggggtttggtctggagctgatggcgactacgaaaaagtaagaaaaatttaaattgaatttgaatcatcacaattcatagtttcgtgttgaatgttcaaatctttaattcaaactggaaaaaaaagctcttgcgttacaatgggtgaagtttatttaatgttatttgttagggttatagataccacatacctaatagtagttgactaaatctcgacaggacccaccacataccatgtcttatatcgaaactgactttagatatggagggagttccggataagtaaagataactagagttctacatggaaacgacaagtactacttggattgtatccatattagttttcctatttctacttggacaagggaacacctataggtataaatacaagaccccctaggagaagatgagataatcaacatacacggaataatagatcaagacacaagatcaatatacaagccaacatacgccaagacaagacgtcggatatcgacttcagagataagcacggttagtcccctacggtttctccggatactgtcaggagagacgaaagcgctatctctgatctcgccgggcacagattcgaggaggaagactaccctgtcatcgactatgagtcagaacttcagaccgccatatcgacaacagttagataggctaccccaaatattgtactggtgtgattatgatgaataagatcaacgaccggcttcggctaacaggatgtagggttattacctgacagttcaggggcccgaacctgtataaaaatcctcgtccccatctcatttacctcagtctcgcatatatcctagtaccaacgatcctcatactatgcaaatactggaatcgcgacatcaaacgtcgatagtggcgcgccaggtagggggattttggtgctttaggatttcgatgagatgggttcaaaaga

SEQ ID NO: 45895 - DNA, 1501 bp, Oryza sativa
gttttttttgttgccctctattataatgtggcctggctgctctctagtcttatcctctctgctacatggacacatgcatgacttagcctggttttttagcacatgattgtttcatgggcttttgagtgacaatgtgacatggtatttatctcctaggatacttaattcttttgtgtacttgttctctggctggctggctggtttggagttaggagaagattaattatgagatgttcaatgtgggagatgacaaatgagcactaaactagatagattggtgtggtccatgggatgaaagtcttaatagttctaactcgtaaactctttaatggtaccactaatgtattacttacataaacttttaaaaaaatattgataattttcttaaggtttgtggacttattagcctaatttttgtggttgtgttcataagttcatttattaaaaaattgtcaccctcatttactatatccaggcaaaatgcgaaataaattgttatagtcgaaatgcaccctaaaggcctaaactacatatttatgttttttttaccaattaatgtgctatatttatttctatcaccaatgagacaaatgtactttttttcaccatgttttagtaatttttatagcatactgtcatcaatattaaaaatccagacaaacttttgatgaaaaaaccatgtgctcatcagtaaagtagttaggccaactgaattatctcttatctgcatggatacatcacaacaacgaaccaaacaaaagattagcaccgttaaaacaagtcccctgcatgcagttcctaatcatcatggaacaaaagaaaaaaaatccacaaagtggctaaggttgttgagccattgctctcaccaaaaggggttgttgggacacgcttaagaaagttcttaggcacaaacatatgaacatgcagctgtttgttagttaaacaaagaacaggagctgtgaaaaaccactagccgctgtcaccagtttttgagctccatcaaccctgagaatgtctaccaaaccagcattgttttcctctgctcattgttttcaacaaatcataggtgatcaactgatcatcataggttgtccatgttcatctcccctgcacaacaaaatattctcctgtgtgtgcaagagaccgtccacatggttcacagggtgttcatatctgtcactgaaatgtgggaccgtgtcagccggttcaggttgtgggcccacttgtcattgggacattgttggaatttttgttgaaatggttgtgactttatctttttttttgtttttgtgtggtatgaagaagtacggaacaaaaggttgtggtacctaacatggctttgtttggatcatctttatgacaatttcattggcattttgtgaaagatatttagccaaattgaaaactgtgttggtcggcactcaaaagtaatgggggctagagttatctattacctcgaaatgcaaaaacaatgtttctgtagcttttatatagttgtgtt

SEQ ID NO: 45896 - DNA, 1501 bp, Oryza sativa
catggtatgtggtcagtcctgccgaaatttagtcgactactattaggtatgtggtatccataaccttgacagtagcccccgacttcaatgcaaatgaacaaattcatattctcaaccgccgaccctggagtaactgttatcgagctcacgtaaccgttctcggtgagttcagagataacgttagacttcccttatcagcctcgtgcgggcacctatagggtttgtctgagtcaatctccgatgtcagccaagaaagtacatagcatacgactaagtctcccgtcttgctgtaatcgagaatttggattgaagtcaagaaattttatctcgacgggtacaccatctcttcattccgtattccttgtcgatatccaccaaccgttctcgagtgatcgagaaggcgcagaatctgcgacggagccttgtcaacatttgtcgtactcgccttggttgatcttggcgtagaaccatagagacatggagtcttcgacagagtcgaatagaattttcctgaaatcaatactaagaaaagaatattagatagaaatagcccccgaacaaacgctcaaagggtgacatgttataatatgtatggaaaattgaaaatgaattaaatttacagaccaatgttttgtatattagcgtcttctcttttaccgacttcgattagtcagtttgttgagtcatacactctccctagcccccagccttgtcgtcggagaatcgttctcggaggataaggctcttggacccttgacctgccttggttgaaaaagcactgatcctagcccccagtcgtgaagttggaaaactcaatttccgattacacggcttggttaatacgcacggcgagaactcttacatgaccagatcttagatggccgtttgtctctacaggatccgacaaggccttatctgctctggacgtcctcagccgaagttcccttaggttcctcagaggccttgtcaggacggcgtaaagggacatgaggataggtttcaactctaggtgtcgtcgtggtaagagatctctgggtaaaacacttagcgatattgtgtacctgatatcaactttgttggagtagaggtagtgggagaatcgctacaccgctggtcgaggaccaggtagtagtcgtaactcgaccacttaaagtggcggtgcgagagattgctacggtatactggttcgagaaccagcgagtagaattatctctcgagcaccaatagaagttacggtgcgagagattgctacggtatactggttagagaaccagcgagtagaattatctctcgagcaccaatggaagttgcggtgcgagagagtgctacggtgtactggttcgagaaccagcgagtagaattatctctcgagcatcaatggaagttgcgatgcgagagattgctacgatttaccggttcgagaaccagcgagtagaattatctctcgagcaccaatggaagttgcggtgcgagagattgctacgatttactggttcgagaa

SEQ ID NO: 45897 - DNA, 1501 bp, Oryza sativa
agatgccatgctcggtttgaattcgtaaggatgcccatcgatgcttgctccgtatcctccttctcgatgccggatcaatttgtgacgtcgcctccacggtcagagcaggtactccgattgatgaagtagattggattgttaatgatgatggttctgatcttgtcgggagacatacttcgatcgggttagatctccccttcagccaaagtcgccgagtagattattgttgaagaatccatcttttgaacccatctcatcgaaatcctaaagcaccaaaatccccctacctggcgcgccactatcgacgtttgatgtcgcgattccagtatttgcatagtatgaggatcgttggtactaggatatatgcgagactgaggtaaatgagatggggacgaggatttttatacaggttcgggcccctgaactgtcaggtaataaccctacatcctgttagccgaagccggtcgttgatcttattcatcataatcacaccagtacaatatttggggtagcctatctaactgttgtcgatatggcggtctgaagttctgactcatagtcgatgacagggtagtcttcctcctcgaatctgtgcccggcgagatcagagatagcgctttcgtctctcctgacagtatccggagaaaccgtaggggactaaccgtgcttatctctgaagtcgatatccgacgtcttgtcttggcgtatgttggcttgtatattgatcttgtgtcttgatctattattccgtgtatgttgattatctcatcttctcctagggggtcttgtatttatacctataggtgttcccttgtccaagtagaaataggaaaactaatatggatacaatccaagtagtacttgtcgtttccatgtagaactctagttatctttacttatccggaactccctccatatctaaagtcagtttcgatataagacatggtatgtggtgggtcctgtcgagatttagtcaactactattaggtatgtggtatctataaccctaacaaataacattaaataaacttcacccattgtaacgcaagagcttttttttccagtttgaattaaagatttgaacattcaacacgaaactatgaattgtgatgattcaaattcaatttaaatttttcttactttttcgtagtcgccatcagctccagaccaaaccccatcctaaaaatcctccaaatctcgcccatgtcgccgccgacgatgacgaccgccgccgccgccaccgccaccgccatggccgccggcgttctcccccgaccgcgcccgcacttcctccgccgcggcatcctcccctcgccggcctccccgctccccttcgcttcccgggtctcctccgctgcgcccctccgccaccgcctcccgccgccgcgcttctccctctccccgatccccaagaccctctcctcgccgtcgcacgtccccgtccgctccctcttcaccggcatcgtcgaggacgtcggcaccgtccgccgcatcggcccgc

SEQ ID NO: 45898 - DNA, 1501 bp, Oryza sativa
cacaagaatgtagacaccgttgatgttggaacatggaaatcactgcattcatacgcatcaacacaactatataaaagctacagaaacattgtttttgcatttcgaggtaatagataactctagcccccattacttttgagtgccgaccaacacagttttcaatttggctaaatatctttcacaaaatgccaatgaaattgtcataaagatgatccaaacaaagccatgttaggtaccacaaccttttgttccgtacttcttcataccacacaaaaacaaaaaaaaagataaagtcacaaccatttcaacaaaaattccaacaatgtcccaatgacaagtgggcccacaacctgaaccggctgacacggtcccacatttcagtgacagatatgaacaccctgtgaaccatgtggacggtctcttgcacacacaggagaatattttgttgtgcaggggagatgaacatggacaacctatgatgatcagttgatcacctatgatttgttgaaaacaatgagcagaggaaaacaatgctggtttggtagacattctcagggttgatggagctcaaaaactggtgacagcggctagtggtttttcacagctcctgttctttgtttaactaacaaacagctgcatgttcatatgtttgtgcctaagaactttcttaagcgtgtcccaacaaccccttttggtgagagcaatggctcaacaaccttagccactttgtggattttttttcttttgttccatgatgattaggaactgcatgcaggggacttgttttaacggtgctaatcttttgtttggttcgttgttgtgatgtatccatgcagataagagataattcagttggcctaactactttactgatgagcacatggttttttcatcaaaagtttgtctggatttttaatattgatgacagtatgctataaaaattactaaaacatggtgaaaaaaagtacatttgtctcattggtgatagaaataaatatagcacattaattggtaaaaaaaacataaatatgtagtttaggcctttagggtgcatttcgactataacaatttatttcgcattttgcctggatatagtaaatgagggtgacaattttttaataaatgaacttatgaacacaaccacaaaaattaggctaataagtccacaaaccttaagaaaattatcaatatttttttaaaagtttatgtaagtaatacattagtggtaccattaaagagtttacgagttagaactattaagactttcatcccatggaccacaccaatctatctagtttagtgctcatttgtcatctcccacattgaacatctcataattaatcttctcctaactccaaaccagccagccagccagagaacaagtacacaaaagaattaagtatcctaggagataaataccatgtcacattgtcactcaaaagcccatgaaacaatcatgtgctaaaaaaccaggctaagtcatgcatgtgtccatgtagca

SEQ ID NO: 45899 - DNA, 598 bp, Oryza sativa
attaaggacctaggagtatgacttatacgctccacccgaggggtagtctacagacggtctagtaccagataagactctgagtaaaacttgcttgcacaagacttgcaattcaaggcgtggtccattgttcaagttgtgagtaagtgtagcttggagttctaggtggatattcaaccttaatcggtcttcatcgaaccgctagtatataaatagtacattggaaaaggcaaatctcagtgggattttgagatttggtgagggattgttggaattaatagatgggctaaggcccattcgaagattagttctttggaaaattacaaaagcccacctcatgggatggcatgcatgtggagtttagtaccaccttgcttattctaggagagggggacctctttaaaagggaggatgccctcctagccacttgaagcatgtgtggtgggagaagaggggaaacacgcgcgcgcgcgcgctcactcgcctggcctggcagtgcaggcggcgcgcgtgcacggcgtacgcgtcgaatggtccacaaaattggctcctcacccttgcgcagatgcagcctccttttgcagttttgttttgctgcagg

SEQ ID NO: 45900 - DNA, 176 bp, Oryza sativa
cgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctct

SEQ ID NO: 45901 - DNA, 1145 bp, Oryza sativa
ttcaggggtatagaagggatcgggcaaatttcaagggtatgaaagggatggagtgagttttcaaaggtatacagggaattgactctttaaatttaagcactcatatcagccttcttactctaaagtagagtaaagcaggcaaggggcatcctctctattttggtttaagctcacttccaaggatatacagggaatttactctttaaacttaggcactcatatcagccttcttactctaaagtagagtaaaacaagcgagtggcatccctcttcattttatttagctcatctactgattatctaaccgaaaaagcaccccaacaccagtttgatactgttcgaaatcactgcaacgagtgggtgacacaatacaaggacaccatagtgcaccgcaaagcaaattttggttcgaaattttcgaaattcttttcccccccccccccaacggtatgctcaaatctcgcctaaaattttgggttttttgtaacttttttttgtgaatttgggcaatttttattggaattcattcagattttcaaataatttcggccagaaatttccgtaatttcggtgaccccggcatataaaatccaatttcgaaatttcaaaccctgaggagacacgcccgttggtaatgttgttacagcatcgacatgttcatcgaaatctgaggtgctacattgcatacctctgagtccaggtcattgccttgtttcgtacttgtacgtgtgggcgatttcagggaccagaggatcatcagggttcggatcagtcagtacagagcaaattgacagcaacacctgaaagcaaacagagagcacatgtttgtcggatttgttcagcccaactggaggaaccaagcaatcgtcttgcaaaaggaaaatagcattacacgagagaggcaaccttggaaatggttagtgctgtgaagaaaccatagcaagtaaccatcgaggcatcgacactgctgaggtctcgctgatatgagtagtggtgcacggctgcgaagtcacgggtagaagggaatggggaagaggagaacgaaagggcaaacaaacgaatgggcctggttctatgggcttaaagtgtgcattgccgacaagcatgcacgacttagtttttccggttttgttttgccacgccaa

SEQ ID NO: 45902 - DNA, 761 bp, Oryza sativa
tggtgacctttctagtcttatggtgggaatgaaaaaaatttattttggtcttcaatttatccttccatgggttaaggtggtccttcccctaattaaaaccggaatttttggctcttgaaatttggagaagttaacctttaactattttgacaagaaattttaagtcctaaaatttcgggtatgttacagtctatcccccttaaaataaatctcgtccccgagatttgggtagggttggcttaagttatgactatctccagaggattgacattgacagcagataataatttcttttaagttgtatgacagacttgctaccataaaacatttggaaacttttatttcgcgggtgagtggcaagttctactcagttgtgggtttatggaagcttagatagttagttaaattgacactagagaagttagttccaacaagataaatgttggttcatattaacaggagcttataaccagatttctaacttagatgaacttatgtttacagattttccaaagttctggacagcaagcacagaggtttctaaattaaggacaaacgagttcttagttactattacatccatccaacaagttcttacataaatggagtacatggcagccatattacatatattacataccacgattttcttccaaaatgggccaccacatacctagactattccttaagcttgtccttaagtcatactaccgtggcagtagaggttagataggactattgattaatctctcatcctcagc

SEQ ID NO: 45903 - DNA, 386 bp, Oryza sativa
agctcggctaccgagctcggtcataagtagtatagatatatttgagtgatatccccttgataagtgtattattttctagttatcacactaaataaaaaagtaaagaatgattaaattaattatattgtgctaacacatgatatttaattgtgttaatagatactaatatatatatttatctattagtttattaaatcaataaggtaaccaaccaatataaattgtacacagttaagctcggtagaaactcgagctcggctcggtaaagcttgcgagcttttgcccaagctcggggtcggctcaattggagctcgagccgagcttgaattgagcatagaacgagccaagctcaagctacttgtgaccttcgagctttttttgacagc

SEQ ID NO: 45904 - DNA, 324 bp, Oryza sativa
taataccagggggtaccgccccgggtggaccactcggtcaggatgatccgagtggtcaaacttaattgttgtctccgaccaccgaagatattggggcgtatcgggctgaacagtgttaatctcccgttcggtcagcttttgctttctcttagattcataagctaggggtctgccaaagatgtgattgagttccttgcgatggtcttgaaaaccagtcgggacatcatcgtcatcatctttcttctttgacatgctttgatctccgtctgagggcaatgtccgcgacggtcagatatcatgcgggatacttaggctagagttcaa

SEQ ID NO: 45905 - DNA, 461 bp, Oryza sativa
ctagttagaccgccgaatccgataaaacacaaatcgacgaactctcaaagtatatgacaactttattgcttctctctgtgtttacaaagtgcaacagccgcactccttacaaaaatcttgactaaacttgaaaccctaactaaactatcaactcaattgctctaaaaagcactaccgggaagcctcacgctccctctctatttatacatgaggtaggcagcctaaagccacaaaccaaactcatactagaagtcctaatccgcataggaaacctcatcgtacaagaaacaaactttacataaccaatcataccaaatttggactccttccaaattcgactccgcatcccatacacacacaatacctccatcgtattgcatatggaatcttcaccaaccacgtgcattgaactctagcctaagtatcccgcatgatatctgaccgtcgcggacattgccctc

SEQ ID NO: 45906 - DNA, 385 bp, Oryza sativa
ggtgtccagtgcttgcctttttttttcccaagatccttcattcgatggagtgtcctcattcaaatcatcaagatcaataccgacccggccttcctttcggtgtctaccgacggccgatcacttcttggtggtacaagcatctcccggacttttgtggagctttctgcctactctatatggtcaccagggctggtgttattctactactactctatatggacaacaaggctggtgtcatacacctggccctacttgctacttttttgtcccatgctgcctctatgtgcgctctgcaatattaaggttttggtcaaattggctgcctttcagtgagcgaggtgctcatttgctcttggccgaaatgtgaaggtcatctcggggtata

SEQ ID NO: 45907 - DNA, 1501 bp, Oryza sativa
agagcaatccctccacatccttccgcctctgaaacataaaaaagaaaaagaaaaaacacagcgcatgagtgagctcacaggatcaccaaccaagcaaacaaccgaatcggatccgcgaggagggagggaggagggattgctcactcattggttgaggtcgatgttaggatgtccttgacggcggggtcgaggcgctgcagcacggtgaggttgagcagccgcgtgccctcggcgtccatcgtcaggtttggggtcacctccccccaaacctcaattggatgaactccatcatcatcgtcgtcgtcgttggctgcggctgcggaggcggcgacatgccggcatcccgcgtaggcttgggcggtggcaggcgctggatctgagggagcgcagcaatcaagttgggaatcgcggcaaagagagagatgacgtggacagtatgacatgagggcccacgtgggtcccacgtaggcttaaaaccattgaaggatttcgggtgaccagttttgtatagttaagggaccccgcatatctagttttgtgatttaaggacgtttttttatctcgacaacaagtggagggaccttcggtgtactttttcctatagaaaaccgtatgagaaacccagttgtccgatctacatctgacggctcaaaaaagcccaatctgatggcccaaaatgcctcctcgttaacacttggcccatatcatttgaatcccagtatgaagatttctgtcttctcagactcagtttaggccacacactgacaaatctgaagtctttcaggacaatcatttttttttccttttgagaatcaagagcttaatatgaattaatcaagttacatttgaaattcagtccctaattcttctgggataaactacttcctctaagtttctgttaaattcaatcatatgttcgaaatggagcctcagataagataagagaagtaaatttgtatgttacaaaaattagcattttgatgtgtttgctgaaagcatgcccaaaataaacctaaaaaaatatttctaaaattctgccccagctaccgcacatcgtaggacaatcgctctcccatgcacgaactttttgggatcaacgaaatgggagcccatggtcctcctaacttgtggagagggagaaacatgggattggggtttcttttctaaagaaattttaaaaaatctggattgatggcctactggatccatttttccctaaaaagtctaatatcgtaggatttatattattcttcttctaccttatagttcaccaactatagttctatacaaacctcattcatcatctatctatcctatacatcaccaactgcagtactacaaacctcattcatcatctatcttatatacctatagttcaccaactgtagtcgtacaaacatcaaatctaacagcctatctacgttgcctatttggcacagctccagctccaacaccacggccacctctcttagagctagagtctagctaaacagtttcagct

SEQ ID NO: 45908 - DNA, 1501 bp, Oryza sativa
agtatcttatacctcgagaggcacaagaactgcaagaagtaggaaacggtgcacagagcgaaaccggtcgggacgaagcaagaggccaccttggtgagctgaaacacatcacggggacgcttgaggcagagatggccgatgatcgcaatgtgaaagaagatgacggtggcgaactgaaggcaggtggatgcgtagtcgggggtcatctcccgtctcccagcggtcgggaccgcggaagttggttggtgtgccggcgacgtggtcagccctcggcctgatcagcgacatcttcgctgcacgcccgctgaggctgtaggcgatggcgacggagtagccgagggtggatgcggcgaaggtagaggcgaacacaaatttggtctgccaagaacaacaaaaaaaacaagtagcttgaatcagaagaacgcgagactggctggatgggttatagtgtaacttaccctggccataatgtgattttccatggcgtgatcttgctctgcaggaagagaacaccataagattaacagtggtgatgcaggaaagcgaaacgacatcgagatgaaaaaaagaaaactttttacccatcgcgcgcgcgtccggaccccggagggaggtggagcacgacgccggcgacgaggagcagcagcagcgacgagcccaacccttggacgacccgcgcgtcgcggcggaaaggacgagagggagtgggggtggaggaggaggcggagagggtggaggcggatgaatataaagagcagcgggtgttttgcttttttttgaatgaaacctgagaaagtgttttggctttcgcggtttctttcgccctctgcacgacgaccacctggtctctccctacgactaccctacgactacgagacaggttaggctgacgagcgggacccacagcgaagcgcaggttgcgtgggagggacgcacctcccactgacgagcgggacccacacggagctctgtacccaccctgtctctgttcgggtggaatacaccatacccatgttactctatacttttttgcttttttgaacccttccttgcgcattatgacggttccatttgttcacttgatggtccgatttaaccacgtcgacgcgaacggtcagttgttctgatcgaggcaaagaggaacaacttaagaggtggcaacgggttgggtcgggtagagcgaatccatacctgacttgagaccacatgcccgcaaggtctatgggaaaaaaaatctcatgctcgtgcccatacccgtcgagcgtaggtaccccatcgggcttgcctgctatttgataaaaacaaaacaacgaacacacagaaaatagggaaaccctgtattttattaatcacgattcattaacatgaatgtttacaaatatatgagggctcccgcaggagttcgtcttttgccttcgcgaggaatacttaatagaaaggtatgctgactagagattgcgtgtagtctgctgattcccggcgcctagcaatgaggcggccg

SEQ ID NO: 45909 - DNA, 1501 bp, Oryza sativa
gtaacggtcgagaaatgtcgtgtcatttccgtttcgtgtagtttaattcgtgtttttaaattcgttgctgcattgtaatccctcggtattagaaaaaataatataggccgtgtttagttccaaactttttcttcaaacttctaacttttttataacatcaactttcctacacacataaactttcaacttttccgtcacatcgtttcaatttcaatcaaactttcaattttggcgtgaactaaacacacccatagatgtgtacttcctccgtttcaaaaaaaaactcaacctaagatagtcaagattcattctcctattaaggatcacatcccccaactagattagtttttttttaggctggaaggagtatgactctacataaaataacgaatctggataaaaagttttgggtagaatcacatcccatctaaattggtttcttttttaaacagagagagcagtagattctgatggtaaatttgaaggacattatttgtggagggaaacagagggtatgtagcgttgccatagaatccagatagagaaacaattaacctatcatagatggtgctccacgtaaaatagttagatcatgttttttcctccgcgcaaatatgaaatatccacttgatgagaaattgtggtcaattcgttcattgttttctctctaatcaaatgatgggtatgtttgaccatggacattccaaatccctaatcatctcctctaataaactgtagcttgagtaagcatgaagtcctccaaacttttcttcgccccaaggtgaaaagatacagaacttttaaaccattgagtatcacgcaataaaaaagattcagcattagtcataaaaatttgatgtttagagtaatatttagtcaaactttaagatttctaacaatcaattttatactaaaaggattgtacgaatattaataagtttatgacattacgagagtgcttttcaaaacagttctccgcataatattttttaaaaaactaaaatataaggaattaatgatggttggattgtaaaagtgtccgaattttatcctaaacgtcaaatactatgtttatcaaagagactaatgttcaggaccaagttccaaataacggagcctgcagttaacaactcataacttttttattttttataaacaatggtattttttacctatcctctacatcgaattgaatatatacagccatttaaagtggtaacttactctctcaaataactcaatttgaaattctccatatccatcaagatataagatttaaactcgaaatcttgaagtgctatgcaggtgtatatatgccctctcgcaacaacttaaataattaagatcagatttataatttctaattttataccaccacaagtccatgtagcatcgctttctcgaagcagaaaacaaatgaagaaacgacggttgccgccgcagtataggccgacatggatcagagaggtcgttttcttctcacccatgcacaaaaaatagc

SEQ ID NO: 45910 - DNA, 1046 bp, Oryza sativa
aatcgtagattatttttggaaattgctcgagcgtaatagtatttcggtcgaaattccgagttaattataaaaatatgtttcttgatcagattagattaaaattggtagtaatttagatataattaataactaaacaattagatgaactcgtatagattattatagatcatttttggtaatctctaagagtcatcggttcgcggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgacagcaaaatatttatacccgcaaaatagtttaagtcaaaattgggtttgccgtagttcgcagatagtaaagttaataaaaaggaatcgactttcacattcgactttcatttggatttatttggatttttatttgaattctaaccgaattcaaatcaatttttgacgtaactatagagcccgagaaagttgcggatccaagcgaaggccaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgctggggcaattacctttgggaaggtaattgagatgcggcatgtggagacatgagcgccacattgccatgatgttgatgacatgatttgtgaaaggagaaataaaattaaataactgtttttgactggggcggacggaggatttgggtggtatctggaaaaggctagtaccgtccccggtcaattaaggaccgaacca

SEQ ID NO: 45911 - DNA, 341 bp, Oryza sativa
acggtaatttttcggacttcccgaaaagcacagagtaaaacgactataacttttcacccgggagtccctttttgatgaacttggactctatgaaaagctcactcagaggattacccaactcaaccaaaaagaaggtctaaaaccactcaaatgataggttaatgcttgggtttctctcgaggtagtactatgatagctcactttgagcatcgaggcatacacaaacacctcgacgttacatccctcttaatagtacggcattcctaaactcaaatgtaaataagaagataattataccattaggaatgcctttttttcatctttctttcattgtcttgagg

SEQ ID NO: 45912 - DNA, 1501 bp, Oryza sativa; identical to SEQ ID NO: 21904

SEQ ID NO: 45913 - DNA, 1501 bp, Oryza sativa; identical to SEQ ID NO: 21903

SEQ ID NO: 45914 - DNA, 1501 bp, Oryza sativa
gcttttgtgggatcaaacgggagaacgtcaggttttcgggatggatatcctgagggaagcagaagaaaaggtgaaaatcattcaagaaagattgcgtatggcccagtctcgtcataagagttatgccgacaatcgtcgtagagatctaaattttgacgaaggagattatgtgtaccttcgtgtcacgcctcttcgaggagttcatcgttttcacaccaaaggaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccagaaatcgagttatccgtttttgtaaagttcaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctaaaaatcctaaatatataaattgttgtttaattgtaattaatagaatttattttaaagtctagaaaagaagatctaattttaaataataaattccaatataaaatggggccagataaaatttcattaaatactttgcttaattctataatttctagatttttctgggatttatttgagctaaggaagtatttttaataaatggaattgcatttcatgaataatttaaattgaaaaaggtttttaagtcaccgctgacgtcatcgtcgtcgtctcccgtggtccggccgtggaccggtcgatctcggccgttcgttttggatggaaagatctcggccgttcgttttcgtgagccgccgccgtgcacccggttcaccgcgaaccctagccgctgacgcaataattcccttttccttttcaaaaataattcattattgcgtcataattcaattaaaatctaaataaatgatttaatccgatttaatctttgaaaattcataactaattcatcttagctcggatttagttggttcaagtctctaaatttttctaaaattgagatctacatgttaaaaatatccacatgtattgttcatgcttgtttatgtgctgttttggtgattttgctcctttctgtttagattccgacgtttccggagagtccgtttttacaggagaagaatttgaagagttccaaggccagcaaggcaagtcacacagattctaaacaaccctttgagcatgttgatcccgtttaaagctattgtttctattcaactattggatttattttcgaatgtcattggatggaattaacctattgtttgttatagcccttttgttcttgattactttattccttgatacattg

SEQ ID NO: 45915 - DNA, 839 bp, Oryza sativa
cagtccatcataacctgcagctgtgaccgaatggtgttagctttaaggttaagtgatttacataaaccactttcaaacaaataccagcaaaacttgatcagatcattctttttcacataaggaaacataattcattgaacactcgcagcaaaaataattcattgagcaatgaactcatttgatcagtaatatctctaggaatctaagaggccatttgtgatatacagcagctacaccatgcttcacttaatcatttatatagcaagaatatatatagtaggtggacagcagtaccatgctttactcttattattgacttcagtactagactctaaggcctgttggattgcctacaagttgtagtagaactacatgtcaacagacttgtctatccttatggctgtattattaaaataacaatgtgtgcagtgtcaaaaataaatttacacagctaagccttggaaaagcattctctgattgcacatatatttaaagtgtgtaggtatagtgtgcatggcagatttaaaagtatactaaccaacaagtatttggatagacaacgtgatgcaccatgtggcgcacatcgtgcatgggagtgcacatgtaaatgaggaacaagaagaaactgaactaggtaaaattcatgttttttttagaagtttgaataaatgtacgcattcttattaacccatattaacttaccatgtcaaacattttgtagatgaccatgaagcattgcaatttgagctggaagccttggagaatgatcttcaagactacggagtgtacgccgaagctgtcaatgttgtctttgatgtagaggagttgcccgactcaga

SEQ ID NO: 45916 - DNA, 741 bp, Oryza sativa
taatgtttcacaaccgaaactcgtgaaccggtccttaattatcatgagcacgactctcaaaaccatgtgctcacaacccaccattatcaagttttagttggcaagtaattaattaaccaatcacgattgaccatcgtgaactatcattaagccaacattaaataatagtgagtcataagttatcccaatagtgtgctaatgtttctaagcatggctaagcaatcatatataatatctagatgaaccaatatatatagcccaactagtcaagttataataacccaatgtatcaaggaataaagtaatcaagaacaaaagggctataacaaacaataggttaattccatccaatgacattcgaaaataaatccaatagttgaatagaaacaatagctttaaacgggatcaacatgctcaaagggttgtttagaatctgtgtgacttgccttgctggccttggaactcttcaaattcttctcctgtaaaaacggactctccggaaacgtcggaatctaaacagaaaggagcaaaatcaccaaaacagcacataaacaagcatgaacaatacatgtggatatttttaacatgtagatctcaattttagaaaaatttagagacttgaaccaactaaatccgagctaagatgaattagttatgaattttcaaagattaaatcggattaaatcatttatttagattttaattgaattatgacgcaataatgaattatttttgaaaagg

SEQ ID NO: 45917 - DNA, 1501 bp, Oryza sativa
gttttcttttatttgatagtaaaactacacatacttcctctattccaaaaaaaataaagaatatgatacattacagtacaacaaatttataaaaaaaacttgtacaaattcattgcattaaaataggtcgcatcatatcatattctagtcttagttttttttccttatacaaggagtatatagctgggtcgatctgactaagggggtgtttggaagagaggggcccctaactgtgccctgccatatggttctccataaatgcctgctgtagcatccatgattgaaccatgtgtaacaaaagatggagcaggctagccaatcaaacaaaggaatccaggaggatatatgctactgacatgctagctcatcacacactgctctgctatgggtacccccccaccccccaacacacacacaaaatcgacgagggttatctatagtactgcacagttgtatcattaatatgtgggactatagatctacctgctcgccgcttccacaacaggggcggtactgtagaggatccgtgtcagagaaaaaaaaactttcatattttcctctctaaattaatttgagaataaaaatgttatacagggcctgtcgtttataggttttctttttatgcatccagaaaaaccccatgtcggtcatagtatatctgtatatgttactaagtaattgactggtatttttagcggaatgtgacatgaattggattagcttgacaaggagatcgtgccggaggaaaaggacaaatgatatttcatgatagaagatgctctacatatctatcgaaattatgcatttggtggctagctagctaggtccccttacgttctaaaaggtcatttttactcgttttccttttcctttaagttgcgtttctttcttgacctgaaaattatcagcagagatagcccaatgcaggaattttgcctgattattgtgaggaatgaattatttcctatgaaatttcttcaaaaattctgaatacgtgatatatatattataaatttatataccaaatgagtcaaaataaaagaaatgaaactgttttcgttatatgtagtaccggatcaaacaggactatactacgtaccctgcatcacttatataaagttgctactccgtactaggcttcgaaccaatcatgtgtggccgaaaaccgtcaaaattaatactacctccattcaaaaaaaatattttttacctatctcacacataccaatataaaaaaaatagaatacccctactttatcaaatcctaatgcaattattcctcattttatctactcccgatacaattattcattacttttataaactatgatatgtaatggttattttaaaaatacttattttctgacaaatgaaataagccaaaaataaacttattgcggacggagggagtagctccgaaatctggtagtgagtagagcttactaggacatgtatgtgcgattcaaattgggccaagctatcttaggctaggcttgtcatg

SEQ ID NO: 45918 - DNA, 1501 bp, Oryza sativa
ttgcaaggtgagtatacgacatactcagcaagccacgcagcaaatatgcaagtgcacaaggataccaaagaatggcataatatagggctcatttgcaaaagcagcatttagcaaacatttgagaattataaaacagtagagtaattaatcatcaattttaatcaacactaaaaagcacacccattctgctcaggcccaaccatctcgaacaaccatacccggctgtacagatctatctccaaaccaggaatataccattccaaaccaggagctaatcaaattattaccagttatagcatcttttattatgatgagaagtgtgaaactaattacgaaagacattgttagactcgcccataaccgcgggcacagctattcgaatagttttactctagccagaggtgtaccactgtacccacaagacacagccccacaacatgtcaccatgtgcctcaataccaccacggtaccacggaaaggagctgtgatagtacccctcgcacaacacaatccaccacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccaacattaaataatagtgagtcataagttatcccaatagtgtgctaatgtttctaagcatggctaagcaatcatatctaatatctagctgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaatgggatcaacatgctcaaagggttgtttgggatctgtgtgacttgccttgctggccttggaactcttcaaattcttctcctgtaaaaacggactctccggaaacgtcggaatctaaacagaacggagcaaaatcaccaaaacagcacataaacaagcatgaaccaactaaatccgagctaagatgaattttcaaagattaaatcggattaaatcatttatttagattttaattgaattatgacgcaataatgaattatttttgaaaaggaaaagggaattattgcgtcagcggctagtgttcacggtgaaccgggtgcacggcggcggctcacgaaaacgaacagccgagatctttccatccaaaacgaacggccgagatcgaccggtccacggccagaccacgggagacgacgacga

SEQ ID NO: 45919 - DNA, 208 bp, Oryza sativa
cgtcacccacatgactaggctacccagctggccctcgtgggaggcgcgggtggacgcgtagagccgctccggtagagacacgtgtgccggaagcaacgggtgacagcgtgactcaagaaattaaactatccgccacgttgcccggctcacccacccactctacaccggcgcttccgcaagggacccaacgaacgccattattcatagg

SEQ ID NO: 45920 - DNA, 1501 bp, Oryza sativa
ttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcgaggggtactatcacagctcctttccgtggtaccgtggtggtattgaggcacatggtgacatgttgtggggctgtgtcttgtgggtacagtggtacacctctggctagagtaaaactattcgaatagctgtgcccgcggttatgggcgagtctaacaatgtctttcgtaattagtttcacacttctcatcataataaaagatgctataactggtaataatttgattagctcctggtttggaatggtatattcctggtttggagatagatctgtacagccgggtatggttgttcgagatggttgggcctgagcagaatgggtgtgctttttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcgtatactcaccttgcaatcattcatcagaggaagggttcttcagtgatgctgatggtgtggaggattaggtgtagccctggtcaagctgcctgtggagtggagtcgtctgcgccgtttatcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagtgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatagcacatgcacttcataatctcttttagtggttctcattcaaaatttattccagtgttgttagtactgtacatctaatactgtactaatggctcatttaccagcaaatgttttacaacattgttttattttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttctaactttattcaaattaatccaaaaacttgtgctattaattggataaatgtcttaactccctcctttcacttgtctttaga

SEQ ID NO: 45921 - DNA, 1501 bp, Oryza sativa
ctttacgactcatgtagatttgtcttgagaacaagattccaatacataatggcatattgtgcttaagtgcgaagaatataagtatcatggggggagttgtccaatcattgtatgaagagtggcagatgaaccagaaattctcagggttatctcgttcatccttgaggttgtctcaaaatgatgatggagttggacctccaccatttgagaagttagatgttgaagcacgtcctagtaggacatcccgttctcaaacctattctggtaattgttctgtcctctctctctctctctctctctctctctcacacacacacacacacacacacaccccttacccttagttatgtccactgtaaagttggcatttatgcgtggcagttgttatatatataaaggtaccaagggtttgaattcgattctcctggtgaaatctatatgcatgaattaagatgttcagaactatttcctctaaacgagggtgttccttttgggtgcaatatgggtgattatcagttgtgttactcactagtaagattttccctgtgttggaatctgactggagattattgtcaagtcctgcaaaattaaacaaataacattatttggataaaaaatactctttattctgaaaaacatggagctgaactgcacttttgcatgactttagttggaaaacctgatctgcatctggttattatgctgacaatatatttggattagcaagtgaatgtgtttttgacatacaaattacttcctttttttgtgtatatatggagttcatattgcttgtttccgtgacttgtggtccacttggactcctttcttatgtcatagcagataataaggctaggaaaccggaagtcggtcgtcagaatgtgtcagttagttccagtggcaaaccagtcaatgagagttcaagtgatgagaacaaagagtctgcagttgaacccaaacaatctatttcagatggcagaccaaaagagggttggcttccattcaaaatatttatatatatagtatattggtggcagttggttacaaaccttttgctttggcgttgcagtcagtgaagctattcctgttcaaaaccaagccactgcacagaagcttctgcagaaaatgacccaggctgcgcccgaagacagatatggtcggggccatagattcaagggtaaaggcaggcaagaagatactccagtatttaccctcgatgaatgggagaagcgaaaatccgctggtttgaagtccacagcacaaagctacatcgacgataccagccgagacgaggagctggcaaggcagctccaggagcaactagatcttgaagactcctatgtcggttcaacttccctgatcagaacccctttgtgtttcaaaacttccattaccgccattccaagaatgttgattcccatggcattgtgctattttgcagggagtgccagagagttcagacgcagatcgtttgcggatgagcatgttcagcttcagcggtcct

SEQ ID NO: 45922 - DNA, 230 bp, Oryza sativa
ttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcaga

SEQ ID NO: 45923 - DNA, 437 bp, Oryza sativa
ctatagggcgaattcgagctcggtacccgtagtttacactactttaataaggctaaaagtatatatctgtattttactatttgttgttagaacacgtaaaaaaatgacacgtcaatatattagaagaaaagaataattgttacacaatacattaagccacaccgacttatggtaacgagaggagggccatataagcccaaagaacaaaaagactcggataatacgacactgaacatcgggaagggggtgtattttactagttcatagccctctatatcatctgcatacaagatacatcttcaaggaacattggatcattttactcatgtcgcatcaatcagtttatttaaaaagagtaccaattttatacttttcataatatgcacgatataattttattttcatttatttttcataaaccagtgcgagtgtcaaca

SEQ ID NO: 45924 - DNA, 1501 bp, Oryza sativa
catatgtaaaatttgatcgattcgttgcttctttctttattacaaactgtcatcaatatataaaaaaattgatcgatcatcgtgaaacgctattggtggtttgggcttaagaaaacagtatgctgcacacggcacggatgaatgatgctgggaataccttcctatacgtccggacacgaatgtctagctatagctagtagctgcatatatattcctctcgagaagtagaagatataaggatgtgtttggataatggaaaatagggggtgggattgggattggaaaatgaataaagggttaggattaaatggaagagggagaatgaatggttagtatttaaagatgggtgggaaatcatttccctttcccatttgccaaacactcactaagagcaagtataatagtgagctataagcctactataagcttagatggaggagagaggtagcgaaaaattaagaatgttggctctcatgcaagagctagcttatcactagctctaagacaaatgcattaaatatataagtgagagatagagagatgagaagaaaattatagtcaatcttatagctaatctattatatatgttggctttaagatgagctaataatagaaagtgtgctctattattatcttgctctaaagggaaaaaaaaaggaaggaaagatggtagtaataaaaagctgggacgagtggatcgatccatgcatgtgttgttgcgtacctgcgatgcaggtagaagatgctcctactgccccccttttgaaggtgttagatcttcaatccatcaatcaatcccgtttcttctccatctctcatcgccacgcaccatcgatcgatcaccaaatggttagtactcagtacagtactcctcatacctttccttttccttttcttttttttttctttctttcttgttagtagtagttgctgctctagctaggttgttgttttgcagtcctcggaggcagcagcagcagaggccaggggacgcagaatctgctatagctagctgctgctgctgctgctacttccaaaagagtacccccatggagggacgccggttgcagcagtcaaaaggcttgcaggtgtcgacctcccattggctcaccgtggctgctgcaaaatgctcgccgaatattgcactgctgccgcaccagccactacgtacgcagtataacgatcaagccaatcaaggagcacttgcctgtttgatagagctcccgctccaactctatccaaccaaacagtttcagctcaaacaggctaaaataatctgaaaaaaattagaatgaggcgaggtttcggctgttccacagcttcactttagctccgagttagatctagttgttggagatctgccaaacaggcttgcaacaggtagcttagctatacacttgtctccttttttctgctggtctctgatctctgctagctccagcatctcccgtgaccgggaggaattcatcgtgacgacagagagaagagacgcgtgcagttc

SEQ ID NO: 45925 - DNA, 381 bp, Oryza sativa
ttatcagagtaaaactatttgaatagccatgcccgcggttatgggcggtcaaccagattcaccgtgattagtttcaccctagtctagtctaatggaattgaatagtataggtgggtggttgggcctgttgcaacgtggtatagcgttggacagtggatgattaatattgattaattattataattgttttactactttcaactactgtttataaatgctcgctttatgcaaacgaacctctatagctatcccttgataattccctgcatcatacccctattccggtatgacttgctgagtacagtgggtagtactcagtcttgctctattttccccaaaccccagagtttgagtatgcgtcaaatggtggcttctccgagg

SEQ ID NO: 45926 - DNA, 1501 bp, Oryza sativa
aatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgtgcggtaaccgcgccaaaccgcgcagtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctgtcctgcagtcctgctcatctgccttcactcctcctcatcgtctttttttttttttttaactccttatcgtcgtagagccctagattcgcacgaggctgaggtcccgcagcgcgagcgatccaaagatatccgaggtgacgccgtgtcatccctagttagccgagccaatttttgtttatagctgtggattacaaaatcctcttctcatctgaaacgttctcatctactatactatcttcaggttcaggttcggcctcgcttttgagcagaaagcccaaaaggtttcagcttgggaagagcaaaatgcggtgagaccagaataatagatggactgtttctactcactccgtttttctcaatgtaaattattctagcatttttaatatttatattgatgttatgaatgtggaaaatattagaataacttacaatatgaaatgaagggagtagtaaacttcatttacaaatcccattttaagacgaaatatttattttatttattttttgacaacgaatttaattcggtcaccacgaataccgcatcaatattgtgctctctgtcagatcatcagacgcaatattgtgctctctgtcctggaatctctcggccatcagttattcagttggcaggttggcagtaattttgacgaaattcgttgaagaatgatagcggtggggttaaaaacgaaatcttttcgtcctctcaccataataaagtttctctttttatttgttggtcaagccctttttgatctttttttttctgtctcatgcttatcctccaacttcgcggcgcaccctccgcaaacgtaagccaaaaagatcaggaaaagagacagaaaaatcggaataaaagagtgatagatagatagatagatactccgtagatactagatcagcagcgatttttttttcagtttttgttttttcatttcttcctctgtcttgtttagatgttggggttggtgagcccttggggggaatcagttggtgactgactcgagaagttcagaggttgttgtctccgaattctttaaccccaacctctcctcttctcttctcttctctcctcttcttccttatactgcttcttgggctcgccgctgcgctgttctttggtcttcttggatctctgaccctaacatcgtatccaacttctccagttcttgttcttggaggggtgaggaagaggaggaggaggaggtgaga

SEQ ID NO: 45927 - DNA, 554 bp, Oryza sativa
tatccatattttctagcgagcagttcagtacataaagaaccaacaaatgctatattaactatctattatatacttaaaaattcattaaactccctacagatcctcttaaactgtcacatggttttctacaaacactcatgagatgccatgtagtgctcaaataaattaaaagttcctagaaattatgataaaaaaatcaaaccattgattttcctttaaataggtagatccaataattataactgctacatctcacaaaaataaatccggtacccccacctccacccctaccgtatgtgagcatgcatgtacgtacgtacctccaccgtcctactcatctctgggatccaattctcatatcctatttttaagataacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatactgctatc

SEQ ID NO: 45928 - DNA, 973 bp, Oryza sativa
cagttacaaataaatacatcatttaaactccataccgttaataggagataactttgactgtaattatatttttaacatgggtcttaggcatatgaaaataacatgaccaaaaatgttgtaaccaaagcttttgtaatattatggtttgtttatgaaactattcagatctataagatatagttaatggttcaaattatatggggaaaaaatatgtagtgaaaaactaagaaaaatggatgtctaagattcgtccatatcatcatgagagtaaatctacgagtaaaatttttactcgtgatgacatggacaaatctcatatgtctatttttatctaatggtagttttcaggttttcaatatatatatagtttctaccacatattttttcccaattatgtgttaatgacgtctaaaacatcacttattagtgtcttgagtgagcatgttttttttaagaacaaatcttgtatgaaacaactcaaatttaatatgaacggcctcaatcaaaccctaattgaagcccaatccaaaaatttgggctttttttcttaaaaaaaaaaccttgctccaatcgtttcctcatatgtgtctcaaaattggaatccccttctccttctttctcgttcttcataagtgaggaggcactcgttcacaatttttgcacagcaaaggaagaggatgacacgtgagaagagatcgtgcgtagggaaggtatggtggagcgatttctttttgtgtttctgttgatactaatgggtgggtcttttttaagttaattttaaaatatcttttggagagattaatattttcacatctaaaattatgtttaggattaaaaaaataaattttagggatggaattttgggtgctctcggaaacaggtcgagaggacggaattgcgacttaatttgccaggctgtgtatgggctgcctgccaacctgctgttgatgctgtgctgcttggttcctgcagc

SEQ ID NO: 45929 - DNA, 1501 bp, Oryza sativa
cgccgccggcagccgcttcctctcgctatgctaagtcgccatgtgattacaacaggcacgcccctctatttatgagagatcctaggatagagttcgactcttactctaatcctaatacctattacaactgcaagtcctaaactgtaaccgactacgtacacatattcgacacaaactctaacaaactccaccttggcgaatatgccatgccaacctaaatttgttccatgcgcgaaccttcgtgtaccaggacttgagttgatcctttttcgccgctcacgccgagctgccccgacgaaccttcaccaggctcaccgtaacaagagactcccgctatccctgcaagttcttcctcttgactccacctgcaacagtgctccaccttctctcatatcaccacagtcgtcttgccaagcgaaattggatttcttcctagctgtcacatcatagactcccgaagaccatgttcaacttcatcttctgtcttaaatttgacttgatctaatccatggccagataactgacgtcatcaccaaatagataaatcaaactcaccagacataaagtgaatcctttcttccttgttgtcttatgaaccgagctaataaatccaacatccacacttctccgcatccgtagactgtatatctgatgctctaggcatatatcttttttgaacacatattttttacaagagggagtagttagcaggtgataaactgataacgagatagtaacaaggcatggatgaagcttcatttaagactgtatagtaccttcgccacacacaaccgtcgttcaagcaagcgtcgccatcgtcatagagcgagcgaatggtgggttcagggtcagtgccgaggcggcttgtgctgaccaatggtgtcaccgctgctgccatcatcaccgtcaccgacctcttctctcaggtggggttcctgtaccttctcactcggtcggcagtaaaaatccataattttttttactctccctgttcttgcctggaaccatggcttggtttgtgatatgaatctttatctatgttaatttgtctcagagacataagaagtgtgtttataaatattactttttagcccattgcttcagactaccaaaatgcgagggttgattgaacctataggttaattcattattatatgttagtgacataagaagtgtgcttataaatattactttttagcccattgcttcagactgccaaaatgcgagggttgattgaacctataggttaattcattattatattttagcagattgacaagcgactggtagtctaaaatcactgttttcttctttaactatagagcgatctacagagcaagatttatacttctgctttgacgaacaaattattaggagtgtcataggccgattccaaacaggtacaatatacatcctcacaagaaacaaccatctttgattttatacatttgacacatgtatgtagaagggaaatgatataaatgtatttagaagaaaaaaa

SEQ ID NO: 45930 - DNA, 400 bp, Oryza sativa
agttgagctttatttatattggttcaactaaatattagatataattgcttagccctgcttagaaaccttagcacatttatgggataacttatgattcactattatttcatgatggtttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttata

SEQ ID NO: 45931 - DNA, 1501 bp, Oryza sativa
ctgcctcctcgccttggagcatctcgcgctggatcccgcaggtcgcgctcctatccacggccaccgcggaacgatctgcgactgacgattgcgatttggtaatttttttgatgcgtcggactcgtgaatttcatacggatgacctaatttcggtgtctgatgttatccccctttgcatcttttaggaaaatttatggaatgctaatgaccacggcaatcagcaaggaggcaattgcccaggtttctcccttctacgattcacttctgatgttaccttcgtaatcttggcatgtgaaattttttaacacatcctaggggtaccattgtaccaatgcgaaggataattttttttatttaaattgatgacagagtgtatataacatgagtcacgttttgggctttgatcagatatttcctttattaagaaatcgtgcattcttactttgggatctgttccgtcgggttgtttgacattgcagttcttctttgtggattccttcctttaatctgaacaaaaaggactcagagctgctatgctgagttcatcagaggtatatgtgtggcaaattccactctctatatttgtctaatcattttctaggtaagctgtaagtaatctgctacgatgaagtcatgctcacaatgaacaatcattactgtgtactcaggctcactaaaatttgatggcttttgcatctgcaatattttaatccttatgctcatgcaacttaacctttcatatcagtgcagtacaatccaacttttgattattgatacgtataatcttgagttttcaactgatcaatacaagaaccttaattgtaagtctcatcttttgcacttgactctgtgtatacattatatattgactaggaacatggaaagtttcaaattgctgtcagatatatgtttcctaagtttgatgatttgattaatcttgcagctaataatcaccattgatctcagctaaacacctcttacataattgtttagcggctatttatctagaatgtaaaaagcaaaaaaaaaaaggccttgtttaatggcactaactgcacattggtaatgtatcatactattaggtaaatatgtactgatgtactttacactcctattatgcaaatgctaagttacaatatgtactttacactctattatgcatgttataaaaccagccccgaaatcaacatcggtagctaaacacggaagaaaacgccataggagatccaaaatgatgacgacaccgaggcacgatatttgataatggagttcagccgaggcttacatctccggggcactgattacgggcgctcctccccgatccagcatatacagcgtatcagagttacaacgactcacggccggtcgccgccggcagccgcttcctctcgctatgctaagtcgccatgtgattacaacaggcacgcccctctatttatgagagatcctaggatagagttcgactcttactctaatcctaatacctattacaactgcaagt

SEQ ID NO: 45932 - DNA, 1501 bp, Oryza sativa
tcataggaaacattatcacaatcatcatcactctcactatcattaaaagatgttaccttagatgagtcctttgccatgagacaaagtggaccgaagagtgatggagcctccttgatggcaacaacgaccatcttcttcttcttggagcttgcatcatcaccaccttcttcctcggacccggatgatgcgaagctctcctcatttgagtcccattccccgatgaaagcctcaatcttcttgccttccttcttgagcttcttcatgagcttgtagcctccactcttcttcttggatgacttgtctccatcatcatccttggaagggcattggaagcaaagtgttgaagcaaagtgtcccttctcaccacactcaaaacacctcaagttggagagagtcttgttgggtcttctatttcttctcctattggagttggagcctcttcctctctcctttctccttcccaagagatcattgaactatctagcaagaagggcaatctcttcctccaagtcctcattggcttattcaccttgcccttgccctagtcttcaacttcggcttggagggcaatgccctttttagaaggtgaggcttcctccatctccttcttcttcaacttgtacatgtcattggtgttgatcttccccaagaggcttgccggtgtcatccttgacatgtcggagttgatgagcatggtgataaggggtctcatacttctccggtagagccctaagcatcttttgggcaacctcaagatcggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtgccctcatggatctccgccaacttgttccaaatctcatatgtggtctcaaggtttctcactctatcaaactcctcttggctcaaagagttgaacaaagcattcatggcttgggtattgagttggaggttgcggtgatcaatctccgtcaagggcgtgccggtgatagcaaagcctacatccacaatactccaaatatggaagctcatagctttgaggtgagtagacattttaattttccaaatagaatagtttgtgccattaaacatgagagccttccctacatggttcacctcgttcgacatcttctctctaggcggtgaagcccaatcaagagagaccaagctctgataccacttgtaggatcgagatgtcgactagagggggggtgaataggcgatttaaaactaaaacaccactaatcaaaactaacctaagttgctaagcttggtgaaggtcaactctaactaagcaactaagttatgttttgcaaacctaaggtgatagtggttcaattatatctctaggaaagtaaatcacactcctatgtcaatgtttagcaatccttaggtgatatgatctcaagtatgtctctaga

SEQ ID NO: 45933 - DNA, 1501 bp, Oryza sativa
gatttacactggattaaattttttagattaatttttttagatggagggagtacagaagtgagattgagagagcgatcagccagtggagtgagtagctatagctgagcttgagtgtagcttagctaggggtgacgcgactgttgctgggacacgtggcgtgccttggttggatccatgggctgtgcatgcgtgcgtgtcggaaggcgacatgatcaatcgcctgcatgcgccctgactcttctgacgtacggctatggtttaagccaagctataaccagaaaccggccggtcaatgtacgtaacggtcatgggtcaatatgtgcagctaagctagctatctcaatcgatcgtcgagttattcatatcgtttgtagtacttttcttcgttgctatctagaataaaatttaatccatattaaaataacaaatctagataaaaataaatatatctttattcgttgttgtaggataaatcaaatcctcagtaatattttagaacaaaaataataatagtaggatggtatatcatggtttggccccgttggttagattcctaaattaatttattttgaagcggaagaaatagtagctcaataattgcaatggtcgattcataccattcctagctacctatgtatacacgttgattctgatcgattgggcgacgatggattacacatgcagctagtgtgtgtcgtatatacttatagtatactatatgtactatcttcgttttcaatagatgatgttattgactttaatatattgtttgatcactcattttattgaaaaaaaatataaagatattattttttatgacttgttttcgttattaaagaagtacttttgcatgtatgcatcaattttaaaatctgacaagtggtacaccaaatttaaggatatcatctatttaaaaaaggagagggtatatacgtatatgcaacttggggtgggctgaggaagatcaacatcgagaccgaaaagaccgtagttttttctgtttatgtttatgtttagcgtttgaccgtccgctttatttgaaattcttttatgattagtatttttattattattagataataaaacataaataatactttatgtgtgactaattgttttctaaattttttcataaattttttaaataagacgtacggtcaaatgttagacacaaaaacctactacacatgagacggaggtagtgctacgtactttttctttttaaacaacatatacttatatatgaacgtacttgctcagttattggacgtatctggcaggcaggatgcaggtatacatatactatactactagtagtaacaaataattaacacatcgaagttgtctcatcacgtcaaatatatgaagaggggggtcgtcacgccaggcgatgctagagtccacgggagttgaatttgtctgtccgattcctggagctttccagattgaatcgggtgttgtttaacctgcagtctaggccgggtcaatctaggtctctggt

SEQ ID NO: 45934 - DNA, 252 bp, Oryza sativa
gcacacactgacccgtacatgcaaccgcgagggtcggctctgataccatttgtaacagccctccctccagaaccgtgtagccagtctatccgacgggctggcccacttacagatacctctccacttacaatttcatcctcgcttcgtataaaagggttaactcggaagtgacatggttggagggaagatgccttataagttggttccaccagtgctagcaaggtggtacgaaacttgcgcacacagctcaca

SEQ ID NO: 45935 - DNA, 974 bp, Oryza sativa
ccaaggggtctgaaccagtataatccttgtcttttgtttgcgtgatgtcgtattacgtagatccttgttccaacgtaccccaataccctctatatctgatttacgggtatctcccgtcgacataaacacttaaaacattttgtataccaaataaataccacaacatgtcttataacttgtaaaagtcgaaataaattcatgctatctgatctaaaaattattgactaaacttttttgaattcaggataatgtactattttctgcagtaacccaaaatgttacagaacttaggcctaaattacataatgatacaacgaaaattccttaaccataaatcatgttaagtctgtacctatccactgtaaagaaatcattcattttagaccatgctgattttttttgcatatattggtgtttgtttgctatcagtgaggaaattgaagaattaaatttgaaaatatactattgatttgttttttctcaaaaatattcgggatgtaaaagttttgacagaaatataccgccggtctcgcgtaaccattgcgtgagaatgacgtgggcatgacaacgcacacggtttcgcgcgacaaaagcgtgagaccgcgcgtactaaagcacgagaccgaacggtctcgcggtaccagctagcgattctgaatggctggccagattcaaaatgtttaattaccctgactagtaatatgcccatactaaacgctacggggtaattctattggtctttaatatttttttaaaaaagattcaggttagcaaaaaatatatttatatgatctgtgcatttgaactttaatattttataaagaaatgggtggaagtacaaaatagtacacatccacgacatttgaagaaacattagttatatctctgaaggcaaagcgccctccattggaggaagtattttgatccatatgtaaatgacaaattataaccaaacgtgagttgaaaccaattta

SEQ ID NO: 45936 - DNA, 565 bp, Oryza sativa
ataccagccgatgccgatagggttttgagcaatcgattatatatccaatgtggataatgatataaagacaatcgactgatgataatgtaataaaacaataatatgatctagttgaaaccaatcaactaacaataatatgataaaataagtgatctgatggttaaagtatacatcagcgggaggtctattgtcatagaatacacaagattagataattaatgaagcatttgttgcaattggctaaaaccaacttgtattcaatttttataagccgattcaacgtccaaataactcatcagctgaaatcccgatgaaacccttattataatcaaagacaggttagcctttatgatttaagcacgactaaggatgatgcatcacaaagtatgctaagaagcaaaaagtctaaaaatcaagtcttcgacaaattttcaggatggtggataccttagctaatctaatcagataatttagctgatactagcataaaccctaaaatgaatatcagccgatatgatcaaattaaggtgctaagctatattaactaagatatatgacaaatagg

SEQ ID NO: 45937 - DNA, 1501 bp, Oryza sativa
cgcgcaccccgtatgtgtggacggtgtcgtgttcttctttgccctgtagccatctgcttcccctgccaccggccggccgcgcggccagctgtatcctcccttgctgctgcacgcacctggcgcccatgcaacgcacagcgcctctcgcgtacggcccgtgggggcttcgccgatcgggcatctgcgtatgccggccgctgctcagccccgcgtgtgctcatggcctgatggcccccggtggaatattgatggtggcatggggatgccagtgtgccacgtaagtgctgtttgagaacatcacctcggttcagagttttcagagtggtaaatagcagcatgcacagcactgtactcgtggtggtgcgacgaatttattgtgtgatgagaatcctggatgtggaattgaatgcgtctcttgtcttgttgtccgatggatcttgataaaatgccaagggttggttaagcaggagtttacaatttgtatgatgtgtcctgatggtgggatcatcagaatcagaatgtaggagtagcaaggaccaaaggactagcatcttttatttctgagcctgcattgttcatttcttgctccatttgtctttccgtgaacttcattttctctaagagcaaatgttcaaggatgggtagttaaatattcttatatatgatgttgaaagagataaatggttccagtttagataattttcagttagctgtggccaactactgtattcagcgaggctgagctgacattgcggtgaaaccacacatcaagatttcatatatcgatggatagcatcaccctgcagaattttgaccagattccttcttccagtaggaggccccttctgtctcttgctatatgaatcatggcacagtgccattgccacaggacttgcacagactggctagccagtccattggttaccaagtctccacatcaccgacctgaccagacatagtagtaacagcgacatttgttactcggccagctatgtttccaagtcccgatggctgttgttgtgccctgttctgtgctactgtgttggtccatcctgatggtaccccttatcccgcggtgtgtggagcaatgtaggtgaaagagagagcatgcggtaaaaggagaaactgtactaggcatatcagttcttgtttgctgagttactgtccaaaatctgagaaaattgtttgatcaacttgtgctaacattatcgttttggctatgttcatatcattacaagcagaaacttgtgtctagagcaaccagaagtacattctttagcacagtctaatgtttggcgcaaatgtgcatcgctcctgcaggcgaagggggcggacgtgaacggcaaggtgttccgtgggtacccggcgacggccgcggcgcgggaggggcgcgcggaggtggcggcgttgctggtgcgcgccggggcgtcgcagccggcgtgcgaggaggccgtcgtggaggcggcgctgcaggggcaggccgccctcgccgtcatcttca

SEQ ID NO: 45938 - DNA, 988 bp, Oryza sativa
tcagctcaattcgagcccagcgatgcttcaaagacaaaaaaaaaacaaaaaatctaacaaaaaagagactagtacaaataagaggaacaagttcatacataagagaatcaaacattcacatcagagaatcaacaagtttgaggaggaggaggagccccagacggtccaccgtggcaacgtcatagaggagcaggagcagctcaatgagcagcggcggcatgggggcgaggacggcgatggcgccgtggcgcaggagacgtggttgacgttgaccgacgccagcattcctcccgctcccctacccgatgaggtcgacggcgccgcagggtgcccctgcgtcggaccaaccttgtcggtgccacgcttctccttccaagagcacggcggcagtggtagagaagcgaggatggcaatgtctccgtggtgcgggaggcgtgattgacagtgacaagcgccggcactccccccgctcccccacccaatgaggatgatgacgtcacgaggtgcccctacgctggctcggccccatcagtgccgcgctaccccttctgactccgttagccctgaaggcagaggggaggtggtggcatggtgagtcacggctggttatttggggaggagacaagatgagaagggaggagaggtaagggaggtggtggcttggggaagaggaaggaaagggagaggagcacgaattggatgagaaaggataagaaggaagcataaagagaataagaaggaagcgaagagaccgaggagataaggatgagaggacgggagataggtgttggttgtattgaaaaccgacacttctacctcgtatgaaagtgccattttttaataggaatcgacacctatttgaatagcaatgtcctagcttttgccgctggcacccccgcgggagcccgtgtgggtgagaaaagcattataaatgtcagttttagctattctaacacctatatatagtgttgtctcctttttttagcag

SEQ ID NO: 45939 - DNA, 722 bp, Oryza sativa
ttacaaagataaacatgctgcttttataagcttattcatactcattctcacccaatgccgtcctcggcctgggttttggtcaagtgccaaatggttccttctctgttgtgatacatattgtaagcaaaagcacgaagcatcatagaagtacttaaaagtaatcttgcgtacgaagcctatgtttttatttaatccaggcaaattttgattagctcaatggcaatgaccaagaacagcttaggtctcagaggctagcgcctgcctagcaacaaacgggtctcgacaggagttgagcttggtggctaaccatttcgaacatggctagttggagaggacaagcaatgcctatcagttataatatcaagctacacatgacttgaattggttagtgaacacatcatcaccgtcctatatatcccaaaaatgtactatgtgtgattatgtgcatgaatatcctcagccccaagctccttgtggcacatggctacaagtaatgtagcctcccaaaaaatgcacaacaccccagctaaaaccctagaaaacggcagctaggatcgatgctctattgcctagagagtagtagctacctagccatcttgccaatgacaaggagataaggcctttgaactgtttgttgcacacataataattgggtatgtgctcgaggactagcagttcttgttatatgtatctgcgagcaatttgttggtatatgcatggtt

SEQ ID NO: 45940 - DNA, 536 bp, Oryza sativa
catcggagaaggagggggcagcggaatcccgtagccctccacttatgaaggtgaagcgtcatttgacgcccccctccaattgtaaggggggccggccaatttcaagaggaagaagtaaagtcgccggagccctcggttcataagctagcatcataagtgaagaagctccacaaggagaatattgagtttagggaccgcaacgcggagctacgggtagaactcgctgagcttaggaataatgttgatacccttagtcgcggtttgtgcgctaaaatcaagcatccatttgtagaaatgggtaaggagaatagagattatgcaaaatagatgtctcctctcccatgaataaagtagtaggtgcttagttttttttttccaatcatgtaagcacttgctataaataatgtggctcattggtgttaaccccaatgtttgccaaagtttttttttttgttttaggtttaataaagttcaggtgttgaataagtgtgggggagatatcccagcttctgacgtgcacatactctgaaaactga

SEQ ID NO: 45941 - DNA, 315 bp, Oryza sativa
tggttggcctgggttggcttgggacgagctgggacccagggtcgggttgacaattcggtctgaatcatcgtaggccttgggttaaggcaggttcgtgagggttcacggccttgtttaataacattgtgtagctctaggatcgtccttacaaaatggctttgggcaactaagtgacttttaaatgctgtttactgcaaaacataacccctatgttattatccccttgtactcctttgcattaattgtgcatctccggtgtggcttgctgagtactgtggttgtactcattcttgctcaatccttcccctcttcagt

SEQ ID NO: 45942 - DNA, 1501 bp, Oryza sativa
atgccaacaagaaaagggtcagtactgttagatcagacggcgacaattttggagcttaaagatccaaacagtatgcaatagataggtaagagaaaacaaagagttgtgattaattttcttttgttagcctgtctgtgttgtatagatcgtaacaaagatatcctataatctccattggcttatggcagcttgacagaacttacaagttacaatcaatgcaatctagcgtacagtgatgttatctctatctgtcgctatcttgcaaggccagaaaatagattttcaatattgaaagtagttgcgtaaactgtgtcttaggaagaacatcaatatttgtggtacctaaactgatgactaacaaggtttgtaaaaatagtatagctgactagtttactgaagaatgagagtatgtactgtactgacataaaagtatcatttctgcttggtcttcaagcttcaattatgtcatgtcataataaaaatatgtaattttatactaagaatgaaaagttgaaaacattgtgctcaatgaatgccttccaatgaaacaaggatgtcagcaggacaccacaaaccttagcagaaaattatatttgtttctttcaaattgaaaccaatcaacaatacaaagaagttgattttctctgtatatgtgttgcatgctcgaagttcagcttgatgaaatttaattgcttttggacaatcacccattcagctgccaatggacaagtaaatcattgttttagccaccatgacctctctaatctagtatggttaagggtgtggttgaatttgaaaccttttctttttgctactgatgtgcatttcagacaatctgtattaattgcatcggcccatgattaaaaataatagctactccctatgctccctttcacttgacactagatactattcatgtacaaactttgaccattcgtcttttttataaaaaatatttaaaaatatttaaggagatattatattatcaaagtactttgcatgttaaatataattaactacttgcattcatcaaaacatcataacttaaaagtttttattggtcaaagataaaatcaaacttgtaaacagtgtcaagtaaaagggaataatgggagtagcaaatatgttttggttatcttttttaaccaataatttttagggttttaggttttaatttctcttgtttatacttttcatatgcgtatcctgttcgagctgatgccatctccttgaagacgcattgtagagtagtggatgcttagattaaaaggtaaaaccacaattgggttgttccatgatggttaatatggaggaaatcaactgtaagttacaaacctgagttttggactgataatcaagagtaatagtaggttaacctaattggtagagtttattatgtaactcatgcataagcatttcgtgctcataatttgagcagcaatgattctcataggaagcgtctttaaagacgacttctcagaccaattaataaattaagagc

SEQ ID NO: 45943 - DNA, 1501 bp, Oryza sativa
aaggactgtacgagctatactggttgtgcattgccgtcacaagtgtatagttccggtgctagatgtgccggggagacggttaaaaacctgttatggacagaaacaggaatgaaaattatcgctttaatattcttgctcgttattcctccaccaggtgtatctgacttggcaaaccttgagagttatatgcagatgatgtattttgtaactaatgtgtctgtacaatggaattttcttttcttttctccatttttacctgtctgacaggatctagtatggcgcaagatttgttgccaggaaatggtttgttaagcagaacatagatcatcagaggaggcttcttgagctgacattacatagaagatgatcaccataaattattctggcgaagagctatatttttttttatgttaccatatgcattaggatattccacttttagtaatcaccactactgattcagacgaagcacacgactagcttggaggcatatattcagaacttcagatacgatataggagtacctaccaggaaacacgtacaaaccagcagtactgtgatactgtccgatctttcctctgaatgcggacgaaggtgttgtacatttgtctgcttcccccacacctctgttgctaccttttcgtcgtcgtcgtcgccggcggcggcgaggagccgaggaggatcatccagtggatgtgttggccggcatctcaggcgcagctcagcaagggtcggatcggatccccgtctccctcggagatgtccgccaccgcctccccagcctccgccctcccgttccgggccggcaagtccggtgtttttcggcccggcccaaccgtgcggagacgcgttcgtgtctgtccttttccggcccagcttgcgcaaccgaggcccatcgggcgagatcaccgccccccaccgtcccggagcgccggcgtgcggcgagcctcgagggcgacgccgcctctcctcacgagccacgaccgtgatgctctgaggccgaggccgaggccgacgccgacgaggaggacgagccgaacggcccgaaccatccgccgcccgctcgcgttcaggggtaggaggggttggggggaagagtagtgaatagtgatcaacaaccagcctccatgggaagccccccgcggcgagccaatgcgctgggctgcctgccacggcggttgtgcatgtccatgggtaagaccgtaaaggcgtaaagagcagctattttaccattgctgtttcatactgaagtagcagtctaattttcacctttttttgcctaccattcttgcagcatgtccattgaaattttgctcagtcttcctcttcgataggagagcatggcctcctgcttattccctcgtagtcctcccatgcaccgatgaagtgattgagcgagtcatctgttacattgggggtggttaagtggtttgctgggttgggttgcattgcagccctgcggcctcgaaggaaggcacttcagatgttcgatgaaatgctt

SEQ ID NO: 45944 - DNA, 1501 bp, Oryza sativa
cccaatcggttcaaagttccagatttctccaaattttcaggacaagatggtgtgtcaacttatgagcacattagccgacttttagctcagtgttgtaaagcatcggttgtggacgctctgagggttaggttgttccggttatctttgtctggatcggctttgtcttggttttcctctttgccgtatgggtcgatcaatagttgggccgatttggagaagcaattccacagctatttctatagtggggttcatgagatgaaattatctgacttgacggtgattaagcagcggcatgatgaacctatgcacgagtatattcagagattcagggagatgaggaacaaatgcttcagcttgagtttaactgacgcccagttagccaatctggcctttcagggtatgattgctccgattagggagaaattctcgtctaaagactttgatagcttgtcatatctgatacagaaggtaaccttgcacgagcataggtctgtggaagctaggaaatgctctaagaaggttaatcatgtttgtccttacatatatgggtcggatgatgatgaggatgactctgaaatagctacagccgaatgggtgaggagtaagaatgtcatatcgtgccaatgggtaaagagatctggaaaagaagagaggtatgactttgatataaacaaggctgataagatttttgacttgctacttcgagagaagcagattcaacttcctgccggtcacataattccatcggctgaagaattgggcaagaaaaggtattgcaagtggcacaactctgggtctcatatgactaatgattgcaaggtcttcaggcggcagatccaagcggctattgaagggggcaaaattaagtttgacgactctaagaggccgatgaaggttgatggcaatccttttcctgttaatatggtgcatacagctggccgaacagccgatgggggccgtgtaaggggttttcggatgaattcggctaagattatcaacaaatatcagaggaagtataacaagcagtaggagaagcattatgaagcagatgatgatggttttgatcctcattggagttgcgagttctttagattttgttggaatgaaggtatgaggctgccctctcttaaagactgtcctgggtgcagtgatgttgccgagaattcaagccgatcatatggtatgggtagtcggctaaggcagacaagagttcctattcatcaaagatcgggtccagtgaatcaagatcatgaccaagaggacaatgaaatcaggaaaaatcagtggtgtccttctggtattttcacgaagaattagaaaagaagggttcaaagattgaggaacagtgagcgctttcaggaggttgaacaggaaattaaccatcggctgaagaaagcaaagccgaggcaggagtggcgtgttaagaatcaggttcctgtagccgatgaggctgcagccgatgaggcaagaaagttagctaaggggaaaagtgtcgtaacta

SEQ ID NO: 45945 - DNA, 755 bp, Oryza sativa
agatcgagacgaccagcaaccagaacatcggatcaattgttgttgattgcactcgggactgccggcgaccgggatttaattcacatagacatgtcaccgggaggtcgagtcggcgaaaccgagccaactagctgggcagatgtcgtgcgaacctcacccaccgggtgtctgatgttgaaggccgcgtaagccaccggatggatatactgaccggattagtccgagtctgtttttcccttccctggttaatttaatccttctggtctatattgattatcaatattttattcttgatgactaatcacgggttaatgcctgactttcctttgtcttctgtttaatgtcgattgttggcgagtccgatcatggatcgtcaagctttcagccttgctgtgactcgggcaaagaaaaagcaccagcatttgatcgacaagcaattgacacggccttatcagctcccgtggctagcaaaatcatgccatcaaaacacgtgcatggatcaacgtgcacaattcatctaatcatgccatgcatatgagatattaagcatttatatttttgatcgctaatcaactcttcctggtgtttctgtgtttgcatatattggttggattgaggttgagccgtgcggatgatatacacggccacggcaatgacctgcacctaccatagttcgacgcagaggacccgttttatttgtcgtcgggtacgtcacctccaccgttgatgggcatcttcatcatcactgctggctt

SEQ ID NO: 45946 - DNA, 1501 bp, Oryza sativa; identical to SEQ ID NO: 30408

SEQ ID NO: 45947 - DNA, 212 bp, Oryza sativa
aagggtttaaatagggttggaagggaaaaagggcggccggcgggaaaggaaaccggcgcgggaggtccggccgccatcaatggcgccggcgagatttgcgggagcaaatccggccgtttgaaagcgagagagagagggaaaaatggggggaaagggggaggggatcacggggaataattccccccacttaattgcacgcgggggcggcggga

SEQ ID NO: 45948 - DNA, 1296 bp, Oryza sativa
actctcaaaaaatagtgcacgccgtcaataaactctttggaccgccggtcagcgtacatccattgccgatccatctacatgagtcaaaaaaaaccgtacacaaataattattcttacaataatgacagtcatacaataattataagatatctttattcatacaaaaatcataaaatattacaccaaataattcttaaaaactatttgtaaagttttaaactaattttactgtattttacttcttttaattttcattttagtttgttttctattatttaagattaactttcactagagttttccttctcaactattttataaaaccttgtttagcaaatgaactaaatttctatatattttttcttccccacacacattttctctctgatcaacttacaactaaattttggagacaaaaaaagtgtgcaaaacataggtgcaaatgtagtatgacaaaaaaaaacattggaggatgaagttgcaaaccctttaggcacctccgatttgtatgtaatcaccaaaataaattcaatagaaattttggcatgacctcccctcttttttgaagaaattttgaagcttgctcgggcagttggaggaggaagaagacatatatataggggtgggactttagtcccggttggtagcaccaaccggggctaaagatcaccaggatctttagccccagttggtaataccaaccgggactaaagttacgatctttagtccaggttgggacgaaaaaatcctaaaaattttgataaaaaggaaaaaaaatccaaccattcatatctttttaaataggtcgaccccactaattttaactgttagatatctcaaaataaattccagtacacccaaccccaccatatgtgggcacacacgtacttacgtatccctcaaccctccaactatcctcggggatcccactctcctctcccattttcgagccaacttttcttattttcgagctaacacataatatataaataataataataataataataataatcatagagttaaatgaccatgactctcaagttacatgcacttttctcaatttatttgcaaattttcatttcctgtgtttttctgcaatacattgaaacatccgttcttttcaatactcattttacacatgtattcctatcatatttgaaccttttctattcttttttttcaatcttgtgttacaaaggaacttttattattattaaatcataattcaagatccatattacctttatttactatataaaatttagataatgtagccgttctgactacaaatat

SEQ ID NO: 45949 - DNA, 270 bp, Oryza sativa
gtatccccggtcgacactttcatcaaaataaatattgtcttccaaaataatcagggcatatttatacagttcacaagtaacatataaataaattccataaaaaatgaatatggatagcacaaaatcaaattcataataaattcttcccaatttttttcattttaaattaaaataataaacatatttgaggatgttttattaatggtatattcattggttcatcaaaatatcaaaatcgaaaaaccaaacaattagtagaggtggtggcaa

SEQ ID NO: 45950 - DNA, 1501 bp, Oryza sativa
atgacacactagctcaatcaatggtcagatctctattagtattgtcgaaacaagatttcgacaatactaaaaggggtggctatcaagctaagaaagtggatgggtttggagacaaagaattttatataggttcaggccttcttattcaagaagtaacaccctactcctgtccggggatgattccgccgagtgtattattgattgtatgatctgggaaaaaaaatcgtcccgaaaggaacccggacacctccttatataggggaaggggtccgtattacaaaatacagtccatatccctaacggaatatgtgattacagatagaatacaattgtaaccgactaagacctcgggtatttccttgacatacaagttagaaaactaccccgagtcctcataaagatattctatctatatttggtaccatatacccaactaaattataactgtcgtgtagatatgggatatccataatctccacagtagcccccgagaccttcgcagatgacgaaatagccttctcaaaacaaaaatttataatccgagtgcttcaattcaagctgatccagcttgccgagtgctaaaatcaaagactgcgaagggcgaaaataaaacatggtgcatcgagtagatgcacctaattaagtgtagccccccgactatgtgattagttgaaaaactaaacatgtagtcaagaaccgagtggtttcatagcgaagcatgcatggtactcagtaaaatacccagccgactgcttctcaacttgaacatatcaagaataaaaaatacgaaaagggccgagtgataaacactcaaatggtccaaaaatagacatatttgataggaatccgagtaaaaaactcttaaaatgatccaccaaacatgataaaaatcatggtaatcaacgagtctaatagtctaagccatgactctcaccataaccaaattaagcatgtatcatgccaagagaatgactcttaataaattagtcatcccgaatcaacccaaacagcttttgcagcctaataaggcttacaaaaatagtataacaccttcctgtcgggcacctttttgtttgcatcgtgttaattccaaagaattatcaaaccgcattaaaaaggattttaacagcattgggccacatcattgcgagcacaaattgccaaagcaaaagcgtctaagtccctagggatcacaacgggccacgctgaaaataaaagtgggctgaagtactatgtttaggcccaagcccattagtactcccgataccctaataacaccgaagagaaataaaacgtctcttcgtcttccccgccgagactctcgccattttccccatttcctgctactgtacaaaactgcgccggcaaagctagggttcatcaatccgctccaacccatcctcaaaaactccacgaaatctctctacgcgcccacttctccgattcctcatccctttccagccatatctcggaccaaatcagaccatccagttcacattca

SEQ ID NO: 45951 - DNA, 343 bp, Oryza sativa
attcctgcagccccctagatgcttcagtctccctccacctccacgaattagcacttaatcctatatatatattcctctataaatttctatgtacaccctctagaacaattgggttttgtttagttgaattttgccaagtgctattcaccttgtctctagtcctcgctcaattagtcatgatcgactatagattcagagcccccaatagttggtgtgttgatttgccgggtcgattagatctaccacttcaatcgcaactattccttgtgcttattcacctattcgcaatatttagattgcatcttatattgttcttgcagtgttctcttgtctgcattgcagg

SEQ ID NO: 45952 - DNA, 1501 bp, Oryza sativa
agacgcttaatttctgcttctcctgttctccaaccgccacgtttcgccgccggccgatcgaacccgtccaacgcctgcgttgcgtgcaaaacgcgagagcccagtgtacctgcgcaacccgcagcgatccgctgccgtgaggttaatttgttcggaaaggcccgaagagatttttcatctaggctggccgtatagtcggctgccggcggcggcgaatggaggttgggggcgtgacggcacggctctcccttccccaaatgggccaaattgggcagttcatgcggataaggagagaaaccgcacaagcagccaaaggctgcggtttggagccactcgcctctctcggtgcgccaacgaaacaagccacgcttattacctcctcctgctgctggcctgtgctgtacgtaagtgcccatgcacgcacgcgatcgagctgattgatgcgcaccgcacttgctccccgtctgccttatcgtaaccaccacgtctactgatccgtctccatatgcacgctgatgcatgccgcatcgtcatccatctcatccaacgccttatataaacacacgccgggcaaagcagcaaaggttagtggcgtgagttgagtgtcatttgttagacaagctaatgcaatttatttggaataacatatatacagttttagctgatgggacacagtgagcttcccgcgcttaacacgaccatcgccagtgaacaaacacggttatgttagctcagaaactgcaaactacagaacttaattgggtgatgaatttggatgtatgcgcgattaattcagcttgaattggcttgtacaacaccagctagctgctttgcgcatagacaacgaaacttggccttaattagtcattttggtgaggcttcagtactcagattttctgaaagggcttaattacttaactttgtattagaaacctggagcacctcttcattagtccatccataaattcctctctcacaaaagaaacgaactgtgtatggttactctctgaaaataagccaggagcttttgacatctatgtaggttggtaactggtaagtaaaacaaaatccccagcaatcaacggtcggccacacctacaaattaagtactttgaactgtggttccttctttttacaattagactgcattgctatataaggcagtttatgcatggattatggttgctatgtttgttgttgtgcatatgacacttatttttcaaattgtagtggctctgcaaaacctagcatcatgataatttccagagtccgcttcagcattacaaactagtgcaatcttgatctctttggagaaaaatgacaaaatttcatccttgccacatcatcaaagacgatagtcttcaaattttacactacctctcgcgtatatatttggagttatacaacggaaggaagcacgctctctgcacactcccattttctactcacacttgggatcggtgctcgaacgaattccactcgactgactccatggccacca

SEQ ID NO: 45953 - DNA, 524 bp, Oryza sativa
aggcgcgcgccaagcacacgcgcggcgcacatgcgcggcagggaggcggctcgggcttggcgcggcttgggccgattggccggcccaagagaatagaagggtaggcggcctgggaaaaagaggaagaagaagggagtggcccgggagggaaagaggggcccaagagaaagagagggaaggaaaaagagagggaggaggaaagaacttcggccacgggccgagggagagagagaggactttgggccagacttggcccaaaggaggaagaggacattttttagatttttttctttttaataaactttgttaattgttgttgttgtttaataattatttccggcgctctgaaaattcaagtaaaatttgagggctccttttagaccaaggagaatttaacaaaaattctccgggccacatttgaatttttcttgcacgtattttagtgtttgccaatttctttccgaattttaattaattctattattccttttagaaaatgaattttatttcgggatgaatttatc

SEQ ID NO: 45954 - DNA, 242 bp, Oryza sativa
  unsure (1)..(242): unsure at all n locations
tctctctggaaccgagaaaaggaagacgagaagaaggaagaagaaggagaaaaganaaagaaaaagagaaagaaaggctgacaggtgggcccatgaacagtacattttcgtcttttctagatttaattcaaattccaatctttagaagcccatatctcctaaaccgtagatctgattctagtgaaacttggacctaaatttatctaaattcaaaccctacttttatacgctatacatcgata

SEQ ID NO: 45955 - DNA, 607 bp, Oryza sativa
tcatcatattttacaaagcagtcggtatatcacttggatcatattattcagggattcacaccgcatatgctacatattaatattaagtcgcttggttgactataattatcaaaaccactcggttggttggattatttattccttgactatatgtttggtttgttcgattaaccacattgtcgggggttacacctattaggtgcatctagtcgatgcacctgactatatttttcagccctccacagtcttcagatttggtaaaagtactcgggagaccatgacgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttaggaaacagataccgtattggttaaggtttctatcttgtaatcctgccccccatcctatataaggtggggggaggccctctagggggcatatata

SEQ ID NO: 45956 - DNA, 255 bp, Oryza sativa
acagggattatactagttcaggcccttggtaggtaatagccctaatccagttgatatgggattatatgatggaaatcacagattacaaagggaacagtggaactcgatgataccgacgagaccgtagtcgagttggttcgactagatcacccggcgacttggctcctgtaggctcgcttcgtaagctatggtgggtgtctcggcggtgaaaatcgatgccttaagtcctcccgggggtcccttttataccgcagg

SEQ ID NO: 45957 - DNA, 1501 bp, Oryza sativa
agaaggcagaagccaataactagtcctgaattagtactgattaatcgatatgttgtcttgtgttgagaactacatattggttcagaaatcgttcggcggcattgccgatttttacagtaattgatcagtacactgttaactctgtaagtctttttttgatcatacagtttaacagaaatgaccagctaaattcagtggagagagacggcatgccattgagggtctaaaattctgcaatgctatctgaactatctgaattttgtgtgggtttgccatcttggttcttagttctaacactagtttgtatcccgtagctatggagtgcactttgcaagttcatttgattagaaatttagaaagtttatcacagatgcaacatgcagtagtgtgttagttcattttcagagataacttgctacagcagaaactaactgaactgaactgaacaagttcaaggatgcaatacagtagtgaagtactgaagtggttgtactatagcctactgcatgtttttgcttggcattgcttagcttcgcaggaaactgaaaaccacaattaccattccaaaacccaaatacccaatccgtcacaggcagccgcataagcctcctgtttcttgctcggccaaatcatattgctcactaagaacaagaactcgttaacgaactagccgaacactccccgccttccgatctgcgatcaacggcatcggtgcgcgcgcggggaccacgctaagctcgccggtggccttccaagtggggtccagtgcaataccgtttcatcccgcaacgcaaggcaaggcaaggcatccctcttcttccacctccaaactacatggaactaactggttggcatcttccagaaccaccgtcttccaccgtccgatctgtgatcgacggcggcggtgctcaccacccacgtttgataagcagccaggtaggccagccagcgaggcctacctcgccatcaccattgccaccgcgccatcgccaccgccacattccaaaagcagaagcagtccaaggcgagagacagagtccgcgacatggttcgatggagttgtcggcttctgctctgggtttcggtctttgtcttgaccctcacccagttgggggccttcgtcgtcgtcttcggcgagggggaggacgccatacctcgcgttctgattgccgccgccgtcttggctacgtaccacgtcctgctcactttccggtgagcggagtcggcggcggcttgcgcgggttcctccaccgcgcgccgccgggttctgcccggaacgacaagggctgcgcgaggcgccacaagacggcgtcgagttcggcgacgagcgcggaacccatggacgagggcgaggccgacctcctccagtttctcttcgtcacctccggtgtctcctggggaggcatcgtgggggtcgtcgtcgccgtgaacgcctccgtaccggctgcgcgggtgtggatgctccccggcgtcaccacgctggaccgggagctgggcggcg

SEQ ID NO: 45958 - DNA, 1501 bp, Oryza sativa
gagccttattggcattgacaagagcagatcaatcatcaccaaaagtctaaaacaacagaacggatgcagttaatattgcaggaatattcatttctcattgcaatttcagaaatcatgatgcagcatccaacaataagttcaggaattcaccaaaactccgaaagcaatcatctctgcttgaaatgttcaagtttttactccatcctaaagaacttacagaaccgcaacaacatagcagaaaagtatatattcagagttgttcatcaaaagtcttgagttacaatttctgatggtaacacaaaacagatgaatgtgatactacgaccacctaaagaactgaacagaactcttcaatggaacccgagttacgatttctgacggatagaaaggcggatgaatgtgatactactatgagtctatgaccaccctaagaattgaacagaaatctccgaggaacctaagtacctaactaacactgatcggctccaataaacgagaaacctatgcaagaaaatgcctaagaacacgcgagactagtaacagaaaactgccatcagaaacaaaaaacttaacgatgaaacagagaacctgcgcctccacatcgtcgatcgagggcctcatcctgtcaggccttcttgttgtcgcggagccacttcgcgatgtcgcaatcctcatggaagtcatgcccaccggagagcgtgcggacatcgtcgcgggccaccatcctgtgctgcagatcgggcatgcgtcgttcagcgcccggtccagtgtcctgacgccgccgcgagcacggatgtgctgaaacctctgagcgttggggtctatcaggttcgccggcgacgccttccacggcagcatgcagcgggcgacacggttgcatattctgcatctcatgccggcttgcggttgcggaggccctcgtcgacccaggccttgtggaaaacgtggtcgcaggaaagcgcgcggaccacggcgccggccatcatcttctgtttacacagcttgcactgtggtcgcagcgcctgatccagggtcctgacaccgccgagcgtccaaatccgccgcctataccacatactcagcgtctctcaccccgccgccaggtacggccacggccaccccgccgccgtccacatcctcagcatccgccaccccgcacacagaaggtgaaggaagacgagcgaggccatggcgccgacgaggtccatggttgctgcgctgatcgcctcctcgctctcttgctctgctctgccttggaagagaaggtggcggtggcgcagtggctggtttgcaaattggaaggctggatggcccacttggctagttataaagcgtcggccgcgagcacccgtgccgtcgatcgcagatcggacggcgagggtacagacgattagcactaatcatcaccacttgctaactaactcctgcgaattagggcgaattagttaggagttctacttcgtcacggcaagtgatctaccgtcggatctctgatcagcgg

SEQ ID NO: 45959 - DNA, 1501 bp, Oryza sativa
agccatgctttagttcctttttaaaaaattgcattcaaataacagtgcattagcacaaaaatgtgccgttgtctgctgggctatttttctctcaaaggtttagaagtgacaaattaaaaatcttggactattgaagtcatatacttggaggatgatcccctggtcaacgacgtagtaatatgcccgtgtatcttgttctttagatacagatcttagctaggatttgggatgaaagcaaaaaaagatgcgttcacatgtataacggcacagaggaccaattagaacaatcagatttatatccctgggattcatgttctgggcagaaattctgtttaaatctgcaaatattattttataccatatttttaaattagataggatgtggaacttcctgctactattggtgtttcagtaatctgtattggcaatacagttgttctcatggaattaatatgtttgcatctattcatataatctcttgtccaataattttctgtacctttctgggatatattgtgatgtaactatagcagttgttcactgattaatacaccttctaggtctgcactttgaatctttatgtggacttccaccaactgaacttggccactgactaactatgattttgaatggtattgattggatgtgtgatggaatcggttcacattttttgtcctgtacaatatgagtgtgatgtgtgaactgttagatttttgtgatttgattactggcacaatgtgatgcaatcggttgaacttctttgtcatgtgtggaaacccggggagaatttgttgtctatattttatacacgcttgtaaaatttaattgtgaattgagattgtaaatatggtgctctagaaaaaaaaactacagttagctatggatttaaattaatactctcttcgtttcatattagaagtcgttttgattttctgcagtcaaacttcttaaaagtttaattaagtttatagaaaagtctatgtacttagtacctattcagcatttatttaataaaaaaatatgggacccacctatcatactcttcttcccctcttcctctctctctcctctctagctcttcctctctctcttgcagcgcgcacggcaaggacgggcggtgggcgtgggcggtcggcgaggatggcgtagggacgggcggtcggcgaggacgacggtgcggacgtcggcactcaagacggcatgcacggtgcggcggcaggaaggcgttcggtgctgcggtccgggagggagcagcggcggcaagggacacagatgcagcgaccacacgggaagcagaggcggcagcggcgaactccgcctccgccactggtcgggatggcgctcgggatgagggtggtggctggtggcggaggcggctggaggcagagctcgggatgaggcgaggctacggcggtgaggttggctctgcaagcacgatagaggaggcgaggcgacagcggaagagcgtggctgcggaggaagtgaggcggcggcggcgacg

SEQ ID NO: 45960 - DNA, 1501 bp, Oryza sativa
cgaagctatgagcaagaggattagaactgtaaagcctagaagtagaggaacctcatcagcaaaagaaggttagaaggcggcaatgcgacgccggcacggacgcacggcagggaaacagagccaacgagccagccaaccacgggtcttggtatctccatctcgggctctcagctggcatctccggttcccgcgccgacggccggtggcggcatcatgacagcgagcgggagcggatttgtgcagcgtgagccatgggctatgacagcaggtggcggcgaccagcgatccaacgatgagaggtggagcggtggacagccagacaagcagagaggagccgcccgacgatctggcattgctggctctatggctcgccgttgaccaccgaggcgatgaaggaacggcgtcccacgttcgctcggcacggtgcggactcacgggtgccaggcgttggcggtgcacaggtgaatgccgaagggagttgcggctcctccccaatccctcaaccctagcgcctgctgcctactcacgccggagttttgggcttttcttgttgggcctgattttttaggggggtttggtctctgggccaaaattgggggtagtcccgagcccactgggactaccccctagctacgcctctggataggcgtacgtacagatgttgggaagtgcacgtgtggggcccaggagagaaaggtgaggagggattttattttgatatgatggttaaaatcactaggtccaccgttttaaattaaaatctatggtcatatatttttggtttttcttataatttctataatttattggagtgccacttggcggcttaagagcatttgtaggaagtttaatagacttttagtatataatagatagatagataatagataagttcactttaggtctctcatctttgatgttgagtttgaattacgtgctcaaaccatagtaccagatataacgcatgtctcaacttgcaaaaccagtgtacccaagattcaagatagtatagtgtccaatttagctgatgtggcaagtgagaccaatgtaagccccatatatcagggctatttcttcttcctccaacctcctctctccatcaccgactctactcacgctcctcctcatctgtgccgcagcagctgcaaccatggccttgccggagtaagggagtcttcctccatctccccacctcgggccaccccgtcaccacctagcagcttcctagctctggcaccgacggcctcatcccatccctagcacggttatagttggattagattaatcttaccgcatacaacggccccacctctcccgtaggtctgtacatatgaagtacatacttacgtacgaagccgctcacccgatcaagttcgtttttctctcctttcccttttatagtttctaacgataattgagataacattcattattagaaataaaaaattataactttgtgtagactgcatcatcctatacgtccataatgtttgaagaaagt

SEQ ID NO: 45961 - DNA, 174 bp, Oryza sativa
gtaataacaaagaaaacgtaacacccaagtcatgatctgttacatattacatagatataagtaatcccctataactagtcggataaccatccggtgtgggtatggggtacccataatctccacagtagcccctgagaccttacagtcgaaaagataatcttctctcgaactaga

SEQ ID NO: 45962 - DNA, 263 bp, Oryza sativa
ccgaccattgcctcgccttcatcatcgagtggccatggaggtgctcatcaccatggatagtaatggggactcttatagtgtcacacccaaccttacccaatctactttttaacaacgatggtaccatgctcttttactcctctctctcttctcactcattttctctttttttcaccagattggtgtgcaatgaccaacaagcgataacgttgggcttggctttgatggatccaacacagatccactagggtggcgatggagca

SEQ ID NO: 45963 - DNA, 1501 bp, Oryza sativa
catctcatttttgccatttgatatggtctaagcctacatgtaaatgagtgagtttagtgtcatggatggaattacaaatgaaaaattaaatctcatatacaacactgatctatatttgtgtttgctcttgtacaatgcaaagcttctgtttcaagtgcatcttcatgacaatatccattgcctctgcctcgttgaacagtactacctagttgggaaatacaactatcttgtttgatctaaatgcttatgtctatattatttgattttctttttttctttaacttgtgtttgtaggtgatgcatgatgcttttggagttcgcttacatgctgggaagcaggcagaggtttgtctttctcatcctgaaaggtttcagccttctgtttgaacaggatataatagaatgaaagggttttccatggcagcttctgattgtatcttcatggactaataaacagaattcgattatctatagctggcatttaaatttttgacatgcagtgttgtttgttgggctaatatgtcagctttaatattcttgtccttcaacttctgtttcttgggctcataaaatttgatatccttattggttcaacacttttggcctgaattcatggacctatccacttttatgccagcaagaaaatttagataatggcaactgtatgtttaacttctgcttggcctgaactctttaccttttcacttttatgtggagaataaatttagacaatgccaactgtatgttgtagtttgaactttgaagtgacatttccttgtgagaaaacgttcttgttcttctggtcactccgccatcagttaatgttgaattgtagatttggatggtccagtaaatatgtgctatctgatatgctctattttattttaaatgactaaagtcagagcatactaatattgttgatgcaaatctttcaggtattgaatcaaattgtgtacgagctaccagaagagcatccattatcagagacaaagccattgcgtgaaattcttggacacacagttcctcaggttagcttagtttgcatgattctgtcgaattttagctatttctgtggccttgtaaatactgatattcaaagcagaaagaaccgtaggaagattctctaagcataaaggcagatactagatacaccttgtagcaccctaatataatgcaactgtcgaaagttcatgggtatgatacaaacacaatatcgttaacaaacacttaaaacttctctgaagaaataaacagtaggttaagtcataggacatcttacagatacattatctactctgttttttttttggggggggtggggggtgcgaatatgcagttctcattgtttcaagaagaggaggttttgcatgtgcctcagcatttttacactcttctactaccatgctcacatcggctattgggcatttcttatgcttgtcagaatcatcaccagatatacattatatgctcgtaatctaaatgtaatttcgttctctttttt

SEQ ID NO: 45964 - DNA, 402 bp, Oryza sativa
ataaattggacaagatgttagaggaccacagaacttcgttgtacccaggttgcgagcacgggtacaaaaagttggataccactctggagttcttgcaatggaaggcaaaaaatggggttagtgacaaggcatttggcgatttattgacactagtcaagaacattcttccggggggaaaaaaattgcacgagacaacgtacgaggctaagaagatagtctgcccgttaggactggaagttcataagattcacgcatgtccgaacgattgtatcttatatcgcggtgaggagtatgagaacctagaagcatgccctgtttgcaaagcactaggatacaagattagacgagacgatccaggagaagttgacgggcagctaacaaagaagagaattcctgctaagg

SEQ ID NO: 45965 - DNA, 622 bp, Oryza sativa
acgcatgtgacatgctccctagtaatagatcttctgggtgatatataccaagtgtagctcatatgaatagcttctgatctcagtgattatcccttatgatatactccaaaataaatataaaaattaaatcccgactggcgcaagtattcggttgataacccttacgaggaataataaatagtccagtctttgagcatagaaaatagacccatgatcatgaattcatgttgcatgtatccggaacaagtccaaattgaaggtatgatacttgtgtttgaactagtaagcccctgagcatatagcttgtccttctgtcgtagtcacaattgtccattgatagtagctgacgcagttggcatagagacaagacgaccaatatagagataatattgcccactagaggtgacaaaaatattagtggtagtgaagatagtgatactaatcaaaagtgatgaagttgcacagccgtggaggcgatgaaaccagtcggcagcagtcaggtcagccatcaatgaaaatgaaggcccccaacaacaacgacagagcagtcggtggtgacaaaagcaaaccgatgatgaagacgtagacgcgcatcaacggtgatggcgaaatccaccaatta

SEQ ID NO: 45966 - DNA, 208 bp, Oryza sativa
gctactgcaacttcttcctgactagtgctagcaggaaactcacctgcctgtcaaacatgggtgctgctgttcatcttctccgttgtttttgtagcttctaaggaacaagctgccaggccagctgcatcacattgtcatcgatgtatggccgcaaatcccacatttgacagtagccctctatctccgacgatgatgttttaacccaaaa

SEQ ID NO: 45967 - DNA, 264 bp, Oryza sativa
ggtgaagagttcaatttccagatggatgagacataattttgcaatcatggatatatatgtctcctgagaaaggatggatgtagatggttccaccggtaatgatgattttgaggccgttttcgatctggaggacatgctatggcacattgaaccagagctactactacgtagagcacgaggtttagagaattgggagtcattaaagaagtcatcaaaagatcttctttacgatgaatccaatggatgtggtaaggacatcacagt

SEQ ID NO: 45968 - DNA, 1501 bp, Oryza sativa
ccatgcaatctttagtccaaaaatgtgctaaacaggatccaaatatatggcatagttgccttctttttatcagacttagataaacaatatctatttaattacaaagtaaagtgaaaggagtatctctaagttgtcatcgaaccttatttgcacaaatattactagagaatataaatagtcaaacaaaatttaaaattcaacttcgttatatgtttagaaatagtaatagcatattagaaataaggatttgtagaatatttaaagattgatacgcttatatttttatcgtatccttcattacatctttatccttaagaagcatcagaacgtcacaattttataaccagtgatatagtgtcgggatacaaaaggaaggtgagaggctaagaataaaacgagaagctcatctacatcaattgtatgaagtagtatgagatagaggagtggcaacaaggacgatattgtgcatcttacgcaagatttaaagtgcaacccgaaagaaaatcgaggttagtgaatggacctactagcgatggtgatgatctattgatggtgttgtttggggtttgttggtggctatattttagggcatattacacgcttgcttgaaagtgaagaagcatggccagcttcacatattgaccgcacatacaagtctaaggcaaaagacaactatattccgcgctctaccttgtttttctagggctcaaaccgtaaacacaagttgctatgggtttagggaaaccactccagttttcatcctaatcgacatctttaacacaaatgagaacttgatcgattcctcgtattgttcaactcacaatcatacaacatgagagagtgtgaaagtcatttggaatagatatatgggatgttgagaaagacagtataaaaatgatgtaataggtataatcatcatttttatcatgatttgccgacattctaagataccaaacaatcagcctcatcggatgagcatatgaaaaaaaaaaacgccaactgacgtattagccaaaaaaaatatataatttgtgattagaacttttacaatttcgtggcagggggaggatggtaaggccccgtttagttccccaaaattttttccccaaaaacatcacatcgaatctttagatgcatgcatgaatcattaaatatatataaatgaaaaaactaattgcacagttagggagaaaatcgcgagatgaatcttttgagcctatttagtccatgattagctataagtgctacagtaacccacatgtgctagtaacggattaattaggctcaaaagattcgtctcgcggtttccaggcgagttatgaaattattttttttattcgtgtccgaaaagcccttccgatatccggtcaaacatccgatgtgacatccaaaatttttttttcacgataaatgaaaaaaaaaaaggccatactgcccggctccaattatccatgaccgtctcgttctcctttcctcactccgatgcacctgccctcgccga

SEQ ID NO: 45969 - DNA, 1501 bp, Oryza sativa
ccccctttcctttcctctcccattcgcctccactccattgtcgccgcctcccgtgctttgttcgctgtcgccgttcgccgtcgcgcgtgtcggaggagccggcacgagcgattcaaaggcggcgtattttgtggcatatggctgaacaaagcctagggcgaatagaccggcatccagtagcggttcaaccttggagaggctttggttcaacctgtttttccctctagcagacaggaagaaaacgccataggagatacaaaacaatgacgacactgagacacgatatttggtaacggagttcagccgtagcctacatctccggggcactgattacgtgtgctcctccccgatccatcatatacagcgtatcagagttacaacgactcacggccacttaattaatcatgtgttaaaaggtcgcaccgttttacgtgcaggagggatgggttcccatcctgcacttgcgaacacacccttagcattcaatattgatagagaagaaattggcgagagaacctgcgttcgaagggattcgaacccaggccagcatgttgctcctggcagctccctgccagccaagctaggtgccgttcttgaaaatgcttttctcaatgcagtctttttctgttgagggtgtgtttagttcacgccaaaattagaagtttggttgaaattggaatgatgtgatggaaaagttgaaagtttatgtgtgtagaaaagttttgatgtgatggaaaagttgaaagtttgaaaaaaaagtttggaactaaactcggccagagtgggatatgttttttcagtttcacagtcaaatcatcacaatgctcctgtctgattctgttacatgtcttgcttggccagagcttcatcagttggggattagctgcgattagagcttcagtagtacctggtaaatgctgtacctggcaaggtagagagacggctagcttagactttagagtacctgtaatctgtgagattcttgccttcgataggcccaggggtgtcctaagttaaaatggcccagcccaactctgccgcctcacacagccgcaagcatgtgattaccagagttgctggcacgatgggcccacccgtcatccacacgagggccacgccttgctaggagcgcgcggatttcccggctcgacaagaagggaaaggcagaagccgactcgaaacaacgcgaagcggcgcctctgactcgcttccgttcccatctcttcctctccctacctcgctccgccgccgccgctcccctcccgacccgcctcgcttcctccctccgccgccgccgccgccgccacggcccggccggatcccacccggccgctcgattcgaggtcagatccaaaccccagccctcccaggtccgaatcgcgccgaatttttttctaggttttggtacggatctagggtttggcttgccgtgggaaattttcgtggggggaattctgtcgaatttctctcggcttccacggtctggttggattcctgctca

SEQ ID NO: 45970 - DNA, 312 bp, Oryza sativa
actgtttgtacatgcaaacatatacgacaacataatgatccaattaagtagtagacgggctaagtgtcaccaaaacaaacataattgcctaaattttatgacgagtaacaatcaatactacaaaatcaatttttgcataagatcaaaatcgattttcgcagatgaccagacggtccacctacaccaggtgtacgtgtatgcgaaaatcccatttttttgcatgcagctagcgtaaccacatgtgagacatgtggtcacctataccgaccgcttgtgaaaataatttcaaaacaccaaatcggctaccctaga

SEQ ID NO: 45971 - DNA, 1501 bp, Oryza sativa
aaaagtcgaggatgatgagcttgacctttcgtctggtcagaaggaggggtgcaaaaaggtggctaaaagtggagcaattagctaattaattaattaactgttagttttaggtcactcctatctcatgtgattaagggaaattcactgtgtatgtacagcaaataggctgcagtttttttcagtgatattgtttactggccatagttcacaaaaatgttattttgaattgaagtttgaaattataaacgcctttttcaagtgattaggtacttttgtgcaatgtctgtataatccttgtaattattggtgtgatatatcagaactaattcctagaaattaagctatgcgtataagatcttgctttgtgttaacgatttttcattacttcttaatacgattaaaacggattagagagacaagcctagagctgttagggcttgagcatataggattgcactctatccctaactggtcatggtcctcttgatgccactttccctaaaccataaaaggatgaggtaccagttcagctgtggaggaggttgtggagatgaattctcataatccacaagtaattaaaattggtaaaaatttgcgtggggataggtaccatttcatctttttttaatgaacaccatttcattcttattattgtgttgttctatatatggatggttgggttgaagttacatttgcaattaatatattagtcaaatcacttcacaatccaactcaatttatttataatagtagtttgtttgggaggtgatacatatataggtcattcaatataatctaaggtattttaatttgtttgaagcaatctagagggccggcccattcagctctacttttcatatataggtcattcaatataatctaagatagtctaaataagttttccgaaagggcaaatatgtcaaaattttcatatcatttaacctctgaaatctacacacacaaagaaacagtaaaaaataaaattattaccttcattttttaatagataacacgattgacttttaaaattattaccttcataattaaagtttctttaatgataagacagttcaaaacaaaataaatcaaatttattttttttaatacgacatatggtcaaacgtcatgtccaaagtcaacggtatcatctattaaaaaccggagagagtatttaatgtcaggtgaatttgaatatttattttctaaaattggtggtccggtaccatgcatgatgccccttttcattgtcctcttgcaaaaccacatcaaactaacaatttgatgatggtgtggatgaattttaatttagcactttggttttgctaatttcactagtacggtaacctccatagttgccggttgggaactggccttaggtgtcggtttcccaaccgacaccgatatattggcacctatgtccggtatatgtgccagttttggaatcgacaccgatagagattatacgtgccggttcttaccccacaaccgaaacctgtagtat

SEQ ID NO: 45972 - DNA, 1501 bp, Oryza sativa
tcaggggttgctagctggcgcgcgcgcgccagctgctcccggcccataagcccatcagccctctttttctttttttcacgatttttttttcgtttttctttttcgcttttttttcgcttttttattactttttttaatctttagcacgcttattttttaaaaaaatgttttgagttgaaaatttttaaatctgagttaaaagttttcaaatctcgagtcgaaagttttcgaatcggagtcgaaagttttcaaatatgggatgaaagtttttaaatctgagtcgaaagttttcatatttttcaaatcttaacttaaaaaattttaaatccgtacttgaaagttttcaaatccgatttgaaagttttcaaatcttgagttgaaagtttttgaatcttgagttgaaaatttttaaatctgagttgaaagttttcaaatatgagttgaaagttttcaagtcggtgttgaaagtattcaaatctgggttgaatgtttacacatatatagaaaaattcggaaaaaagaaaaactaaccgtgtcttgccgcctattgggccgtgtgggctggcgcgtgcgcgccgccggcgcgtacgcgccaattaggattcctggatagcatcaaccatagttggaagtagaatctaatggccacaatcagaattggatgcagaaaaagttcatatatatatatgaaccaatgttaaacaaggtttgcatatgtttagatacagagagacttcctagagacaaacttaaagccaaagtatagtgctgctcaacatattaattgatgtcacatggtgacgaagcagaacttctttcaaacatattgcactcttttagtcatgagacagaaggcccaaaatatcttcttttcccttcagattagacagtaaatttagttagattgaatactacatggtagattattctaatataatctcaagtatagatataatctcaagtcagatgctgcaaagaggttaattgggctttcgggcccataagcgctccttccgcgtgtgcgtgcgccgtgcgctcgcgttaggttcccctaccgtccgcgtcgttatgtttgatcgtacaaaaatcggaagaaaaaaatcatatgcttagcattttcccatctctatatatgcatctgttttctacggtgctaataaattagattattctgttgtttgttttgcatgtaccaccaggggcgacgtgctcaccggccggcggccgcctccatgatgctaggcggcgatctcatccccgcgtcggccgtgtttgtcgctgtcgtcggccgcgtttcgatcgtcgtgcacatggtcacccgagttctacggagtttctggttgctcgcgggagttagaacgccgacatcaccagagtttttaccttccaatctagcatcatttatcatattgatatctaaatataagattaatctcttggcattttctattgttcaatgtaatgccgcggcactattattgccgactggtgcctttgcact

SEQ ID NO: 45973 - DNA, 1501 bp, Oryza sativa
gtcctagaagagaatagtttcggcacaagtatgtggcaagggcgatcatccacggttccgccggaaccaaccaaaaccagactaaaaaacctcaattaagctaaggattagcatagccaccagtcaattagtttgttggcttgctgcaaaattaatacaatcggtttgacctttttctttcaacccaagatgaacaacttcaagtatgtgctgcggaatcaagatagtgcattatgtgttcatgcatgaactgaagtaacccccattagaaataaagggtttaaatttctcaccgtgtgcaaaaactgatggtataatctattttcctatattgatgaaatttcacctgaaacatgcaaagtgcataagttacatatcttatcactataaaaaaaataaagatcatttaataaataaaaaaattacaatcctttatataataaattacattgatcatatagccagaaataaagcatattagcaacgaagcacaaatcaaatgatgaaaccttgacatgcaattcaaaacacacaccccaacagtaaatgaagaaccaaaagtccatgcactgctcttattggcagtttggcacatctagaaaaggagcaaatggagccaatagatagagttttaacctctagatgtgattgataaccttaacccaaaaagggggccaacacatagtaaagtgaagatggaataataactaaaagtgcaaattttatcattcgaacaactaaacatacgttaggacaactagtttccccctggaaaacatagctatagtaaatcaattgatcaagaatgaattttgtgcacattattttcttactaatgttgcgaccgcagggattattctgcatggcatggcataatcaaaccacatgttaaaggacatgtaaagtcacaaaaaaataaagaaaaaaagtatgccatgaaattcaactgaaccaacattttttcctttacatagctaagagacttggttatattgtttacaggatgatataccttgtattggtttacaggatgttgttagtaagttcatcgccggacatccctgacttgatacttatccacaaatccaagaccaaatatagtgatacttatcaattcgtgaattcaaaaactagaagggctcatttgcactgacttttggtggtgagggacgtcgagcggtgtttggttgtaccagatccaacggagggcaaacatacgtaccgtgatcaacgccccaagtgatgccatcctcaagctaaggtggcgggctgccattgccatggcaccatggacggcgaacagtgaaaatcgcaaacaaccaactgcccaaacccccaactttcgcgcggtcgctgagacaataagccatggcgaagccgtttgggggcctagattccagtggaggagaacaacggaaggggcatgggtgcagtgtgggctgcctctagagacagcgagtgaattggcattggcagaggggagagagtgggggctgggcga

SEQ ID NO: 45974 - DNA, 1501 bp, Oryza sativa
gacggcgacgaggaggaggaggaggaggagaaggtggtggcaggagagagcatctgatttggggctcttggatagctatggatggggatttacttgttgtcttgtgcggggttcgtccttcggatcggagccggtggggaaggaaggaaggaagagaagtggactgggagtgggaggcgtggactagtcgccgaggaggcttgaggtcaaaacccacaggcttcgcacgcagttttgacctttttttttagtattgtactccacgggccaaggcccaactggtcagccagacttggcgtgcatacggcccacaatttggttcatgcgaatttccgctcaaataccagggtgcactgtttgtccgagagagaagattaaatactccctccggtttttaatagatgacgccgttgactttttctcacatgtttgaccattcgtcttattcgaaaaatttacataattataatttattttgttatgagttgttttatcacttatagtactttaagtgtgatttatatcttatacatttgcataaaatttttgaataagacgaatggtcaaacatgtgagaaaaagtcaatggcgtcatctattaaaaaacggaggtagtatataaaaaacgagataagtcattagcttataatttattagttaaatattaattatttaaaatttaaaaaatagattaatataatatttttaaagcaacatttccaaagatttttctttaaaaaaacagaaagtgtgcttggaacgaacgcacacgtacgcgactactcccgtctcgaaaaaaacgggagtagctatacaactgtcgacagtttttgggatgaaaaactttcaaatatgactactatgtaattacattgtaactactatataactactatataactaatatgtaactcaagtgtaactcaaaatagcccgatgggagaactggttaggtgaacaagcctccaagttggaggtgttgggtttgatccctactgcacgcgtgtgaattttttaagccgttttccctcactagcacaaatctcaaagcatattagacagcttaaaatttgaaagttttcacccctgaattttttaagctgttttccctcactagcacaaatctcaaagcatattagacagcttaaaatttgaaagttttcaccccctgttaactgtcgccagttgtatagcaaatccgaaaaaaaaagaaatcatgattatgtatttgaacataccctatgtttagtaaggatttggttttttttttttgacagatgaagtatgttccaaatagaattaggctaaaacgacctcaataaaatgggtttcctattcttttcttaaaaatctttaatttgggttttcttaaaaatctttaatttgggttacgtattatataattagatttatgacctgaattaatccttgttacacactttgatgatcgcacttaatccttgttaacacatcttggcttacattttggcaaaacacaata

SEQ ID NO: 45975 - DNA, 1501 bp, Oryza sativa
acaacaacaattcagagttggtgtactagttgctatggcgcaacaccccctgtggtagttgtagttagacattggtgtaccagttgctatggtgcaacaccctgtgtggtagttgtagttagactgtcaatgtggactcctccccaaaatcaaagttatcctcttctcattgaaagatcggaaagccctatataataattactatacttgcatgttgaagtttaggtatttagtgggttgtatctatatagaacatatagatttgtgcaaccatgctccaaacaattagtgtgtatcattacaatatttaaagcacactccactaacaatccacataaaatgaactactataaggtattgtgtaaataaatgtttaacaaactcttccatattactttcttcgtttcataatataagtctttctaatattgttcacatttatatagatgttaatgaatctagacacacataatgtctagatttattaacatctatataaatataagcaatgctaggaagtcttacattatgaaacggagggagtacaaaattgattgtgcttagtccctttcttccatcctcttaacggtgtcatctttttttaagaagtagtaagagaatatcttgactttctttttggtggtgctttaattttctagagctttttataagggcactcaacattttggtttttcaaagctttacatcctgattagtcaagacaatccctttgatatttgagctgtaataccatccatttatttgattttctccttctatgggtatcctaaatttaaactaactctggcctactctaaaaactttagctacatatgagcaccatgacatgtccttagaggtggagaaagtaatcaaataggatcctagatctaaactgcttacttgcccacaaatgccgttgttgtacttctgactggggagaggacataggcgatgtaagatagacaactgagggaaggcaagaagccagtgcttaagaaagtagaggcggcggcggtgtgcgtgggggcctagagactaggagagaatcgatgtagccattacagaataaacttattatctatgccagccttaaacctagccgcaaaatacctatagaaccatagtaccctttcgcacttgtatctcctattgatggaggagtggtgctaggagatactgaagtcttgccggccgttcgatctatctcgaccgacggctaagaatggtttcatatatcccttttagcaaccacgaaaatcctttacctacaagcactaaactaacctaatactctcatctggccacaccaaaggtgacttgaataaaagtgaaaaaaaacggtagggagaagaagttgacagcagatagatagtcatcagatggatagatcaacaacagagaggcaaggcaaaggagatggatggaaggaagaaccacactacaacatcgaatcgaggccgagacggaccaacacagacaaacaactgcacacacaagc

SEQ ID NO: 45976 - DNA, 560 bp, Oryza sativa
ggaagccttggggtaattgatcaccacacagtgctgaataagttgagattcagaagactattctttacactaaaaccttgcatagatggttatcgagaaggttgcaggccatatgtagcaatagatagcacttttttgaccggcaagttcaaggacagctatcaactgcttgtgctgttgatgggcatactggatgtacccagtagcctttggagtgatggactcacagaccaatgaaaactacaaatggttcatggaaagactttagggatgctattgctaatacagaaggtctcacaatttgtacagatgcaaggaaaggagtacattctgcagtacataacatttttcgtgatgtagaacatagagaatgcatgctacatttggtgaataatttcaaaaagaggtttcatggaaaggtgtttgatgataacctctggcctgcagcatactcatataatccatattttttccagaagcacattgagaaaatggatgaagcaaagccagaggctatggcttatttaaggaaaaaccatgttaggctttggactagaagc

SEQ ID NO: 45977 - DNA, 1501 bp, Oryza sativa
gtgatctctcaaatagtactagaagttgtacgccgtcgtagcaagtgcggactgcatgtggccgtggtgcggccgggagcagcgctcgtgcgtgacatgaattctgggcccttctgcttttggatgtgcagtatgcatgggggcgattataagcgcatcaagtgcactgtgatagtactgtagtacgactgtacgagagacccgactcctgaggattcttggccaaaactggtactaccacctgaatgcgcagtagcttgtttggaagctgaccgaggaaagagagggaaaaatcacgcgcctgtagttctgaaagttttgggaaagagatagattgaacagaagagagtacacaaacggagagttagcgtaatacacgagaactagcatacaaagtacatacggtctcgagagacgattgaacagaatttcccgtcatgcatgtacggacttggagtgtatatagctaatgctaaacttgccacttgaccagcttgtaccacaggagtacgtacatgctagtgtgctactgtcatcacatcggtcctagatgctcgctggtttgtgattctataaaccgtatctagctcaaacaaagccggccgctaaacacgcacgcgcgtatgtttaattaactagacagagtcacaagacaaggacagaagaccacgggttgcaagtaggagaagacctacttaaacaactcttccattattacaagcttataaatacgataacaacaggtgacgtacaactgagcaactgtcgatccaaatgcaacgaaccctgtgcgcattcgaggcaccgatcgatctcatcccctataacgcccggacccacccgggccccgatggctgatcgattaaccactagctggatcacccaaaccgtcggcgcggttgtgtatagtccgagcagcgcggcgccggtgtggtggtggtggtggtggccgactggccgcggtttcccaaatgcgcagcgcgcgaggggtcccgcacgcctcccgcgtccccgcatgaccgagcgcgcgcgcgcgtcatcgggacgagagagagacgacgtcgtcgtcgtcgcgcgcgcgggccagcgccccagccagttgccgcttacagtaagaggggggagtgtatagtacgatccacttgtcgtccacgtcgtccgcaccgcaccccatctcgctacccatcccccacccgcgcgcgcgcgcacggcgcacggcctccacacgccccggcccccgagaccgtatcacgagcgcgcgcgggcgtccagcttttctcccacgattccacgaagccaccaccaatatttccggtcgtccgatcccccctacccctctccgctgatcagtcgctcgctcgctcgctggctgactgcgcccgcgcccgctttgctgcgctcccccggcacgcgacgacgaaaagaccggcctcaaaagcgacaccacgcagcagacgcagcgcccccgcgcggagaagctagctaggtactcctgtctggt

SEQ ID NO: 45978 - DNA, 1281 bp, Oryza sativa
tgtggatttcgatttgaagtccagcctcatcacgatggcgtaggctagcccgttctgtgccaagcctaatgaggatgccaatgctcatatgcaacagttcctagagatttgtagcacgtacattatcaagggcgtcagtcccgatgccgtcaggctgcggctgtttccgttctcccttctcgagagagcgaagcagtggttctatgccaaccgtgctgctgtcaacacctgggacaaatgctttacggcattcctctcgaaattcttcccgatgggcaaaaccaatgctcttgtggaaggatttccagtttccagcatacaagggacgagtctattccggaagcatgggaacgactgcaggagtatgtggccgcctgtcttcatcatgggatggacgactggctgatcctgcagaatttttacaatggactcaccccaaagtcccgcgatcacctggacgcggcagctagaggagccttcttctctaaaacagttcaaggagccgttgaattaatagagaagatggtctccaatatgggttggagcgaggaacgactccagacccgtcagcgaggcatgtaaaccttcaaggagacggaattacttgctgccaagctgtacctcctcatgaaacgcttggacgaccacgagaaaaggccacaaggcaccgtcaaggccttggactctcacatcacgtgtgaggtctgtggcggcacggatcattctgggaacgactgtccggaaacctgtgaggaggcgatgtacatgggcaacaacaccgggtaccgtccacaaggaggtcaggggtggaaccaaccacgcccatattatcaatgaggtaaaaacaacggtaacttctctaaccagccctccttgaaggatcttgtttttgcgcaagatgaaaccaccgatgcactaagcaaaaagcttgctgctaccgataagatcctagagaacataaaattcaaattagatggctttgcctacgcatttcaaaactagatgagctttaataagatgaaagaaacccagttagctcagttagcatccttagtccctgcaactgaaactgggaggattcttgggcaacccgactcctccattgaaaatgttaaggcaatcacgacgaggggaggtaagtccactcgtgatccgccgtatcctaaccttgcaggaactaatgggatatcaaaagaagcgtcatctaatgactcggctgacaaggagattcagccagaaaagaccgtgccgcaggagtactgcgacacgcggttgctgctg

SEQ ID NO: 45979 - DNA, 1501 bp, Oryza sativa
cttgactcattggagtattccaatttatttctctgtctttatttcttttttttcttcttttactgcgattttttttcttatggtgcgatgtttagtcaagtgtgatcttggttattttttctctcattttcttgatatttgagtgcttttgatgaatgtttctgggtctactgcacaggttacacgtacatcagcagctgtgcaatgtagtcatccaatacatttgcaacagcgccttcatttttctgttatatttacgccgcatgcatgttcattagcagccgcccaccgattagtgcaatattctttcgggggcagcaatattttactccattttatgttgaaaaaaaaggctgtatgatcgttttagtaagggtttagactacaaaacggatgttcgatgctaccaggtttgataaattaaaataaagttcactctatatatctgaaggtagaccggcgccataccctttttatttgccgcaggattttttttcgaggggaaatttgccgcaggcttaatttcgttactgtcgctctgtcgttcatctttgtgttcgttttcaaaataaactcaagtttaccatgaataaaatacttatttgaaaccccaagttccttttcggatcaaaataaattacctacctatgcaaagtgaaatatgatcgataaatcttttgtttgtgatgggttacttttgcaacaaaatcacaatatcgtaagcaaattacttcagcaaaaaatatgcaaatactatttttgtgtgtccggtctacaaacacacatgaagatatattgatatataatcaaagtttgtatataagtataggtgactttgtgtaccctaagaatttcactcattgaccaatattgagagtatagtctcctagctaatctgattctgcaatctgctgatttcaccaactatatccaaacttttgtcttcggtttgtttttgtttatatacgtgatatcttatgggttgctttcaaaccgggtggcttggaataattggatggaaaactacgggctgcacagttacggtggttttctggtgggggcaatgagaaatgggtgggtccttaggattgtataaccacatatgtacacatatgtacgcccacatgcttcttgcacatatttatttattccgaaatatttactaaactatctattttaacatgctattaatatttatttgttttgctgacagcctaacatcactaccatggacctagctactttcctcctctttggttttcaagccgttatacattgcctttacgcgtgtcctatcagccatccactagtttcagaactaacaggataagttgtccttatcttattagactctatttggtgtacgtgtagcatctacccttcactagatataaaactaataaattatacgtacaacttgtttataatgtccattatgcacccttcatatataaaactagtaaaactatgcgtacaccttgtttgaattgtgtacatctat

SEQ ID NO: 45980 - DNA, 1501 bp, Oryza sativa
gtgtgtaacaaggattaattcaggtcataaatctaattatataatacgtaacccaaattaaagatttttaagaaaacccaaattaaagatttttaagaaaagaataggaaacccattttattgaggtcgttttagcctaattctatttggaacatacttcatctgtcaaaaaaaaaaaaccaaatccttactaaacatagggtatgttcaaatacataatcatgatttctttttttttcggatttgctatacaactggcgacagttaacagggggtgaaaactttcaaattttaagctgtctaatatgctttgagatttgtgctagtgagggaaaacagcttaaaaaattcaggggtgaaaactttcaaattttaagctgtctaatatgctttgagatttgtgctagtgagggaaaacggcttaaaaaattcacacgcgtgcagtagggatcaaacccaacacctccaacttggaggcttgttcacctaaccagttctcccatcgggctattttgagttacacttgagttacatattagttatatagtagttatatagtagttacaatgtaattacatagtagtcatatttgaaagtttttcatcccaaaaactgtcgacagttgtatagctactcccgtttttttcgagacgggagtagtcgcgtacgtgtgcgttcgttccaagcacactttctgtttttttaaagaaaaatctttggaaatgttgctttaaaaatattatattaatctattttttaaattttaaataattaatatttaactaataaattataagctaatgacttatctcgttttttatatactacctccgttttttaatagatgacgccattgactttttctcacatgtttgaccattcgtcttattcaaaaattttatgcaaatgtataagatataaatcacacttaaagtactataagtgataaaacaactcataacaaaataaattataattatgtaaatttttcgaataagacgaatggtcaaacatgtgagaaaaagtcaacggcgtcatctattaaaaaccggagggagtatttaatcttctctctcggacaaacagtgcaccctggtatttgagcggaaattcgcatgaaccaaattgtgggccgtatgcacgccaagtctggctgaccagttgggccttggcccgtggagtacaatactaaaaaaaaaggtcaaaactgcgtgcgaagcctgtgggttttgacctcaagcctcctcggcgactagtccacgcctcccactcccagtccacttctcttccttccttccttccccaccggctccgatccgaaggacgaaccccgcacaagacaacaagtaaatccccatccatagctatccaagagccccaaatcagatgctctctcctgccaccaccttctcctcctcctcctcctcctcgtcgccgtcgcgcgcccacgctcgcgctcccacccgcttcgcggtcgcagcatccgcgcgcgccgcacggt

SEQ ID NO: 45981 - DNA, 1501 bp, Oryza sativa; identical to SEQ ID NO: 45937

SEQ ID NO: 45982 - DNA, 1501 bp, Oryza sativa
aagaaacggaggaagtaaaatttataagatatgaaactgaatccactcaaaatttaatcatggattcttgattctttgtggcatctcaaccttgtttccgaggattctgatactgatgacgaaactcgtccgcgtgtctaatctgccgctggccggtttccatgcaacgtgggatatgaaataccccttgttggaaaggaattaagttgccgatacgttgattgtccagcacattggaatatggacagtgctcctaactcctaatacttgtcctcatctttcgagtgttagtcaactaccgtgagacatacacaggacccaaattaaactttacaacaaataggaatggtcggtataagtaggcgtgttagtccacctggctgatcgtagcctgccgtgcgttcggagttcagatcaccggcgctgcctggaaagtcacataccagtacagaatagtactccggtagctggtataccgtacgataccgtctacggagtggactattccatgtctccgtcaaaaaaaaaaaacgcgtacctatcgtagatcctggctgattcggccagtgaagcccccaaaaaaccgagacgtttacgacggcttcgcgtacgcgccggagagacgggctccacaccacaccaccgcccaccgcgtcacgccgtcgcgtgagattggcttacattccctggccgccgcacgactgacgcccgtgccgtgcagcagcgtgcgcttccgcgacgacaagggctcacgcgcggggagctggggaggcaggtggaaccaacgaacctgcatgcgggggggttgtggtcgatcgatccgccacccgcgtgcggtgccgcaccgccgccacgaggccgttgatagagatatggcccgcgcgttgctacgaacgtttgccgtgccggtgccccgctgcggcgtgttggccgcggctagctctgcctggcgacgcgcacgcacgcatacgcagacgcaggccgaaataacgtgcaaccgcacgcaaaagcgacggtgaaacggtaacaagctaggccccagaccgggaccggacgacgtacgggtggatggaagcagcgccagcgagcgaagcacacgcttttcccctcctctgaaacgctacgcgtcaatgtagtcatcaaagtctatcgatcgatcgggataacataaaaggggtaaggtaattcccaacccaatgaatattgttcatagcattaaataaactgtcacctagaataaaaaatgatgtggcaagtgaataaatgagaaaagagaaggaaaccatatcttgcatatcatagtttctacacaacatccaagacatcatgtgagataagtagtattaaatttaagtatggaatagtggtgtttgtattggaaggataatgtctcgtactagtttttcaatgatgtggagtttataaaaatcatatctagtgtgttgggttaggaataacgtaagatcgagtaggacgaatcccggtgtcccacctagcaaac

SEQ ID NO: 45983 - DNA, 1501 bp, Oryza sativa
ttgttcttgttctttttatttcattatctatgccaactattgtatttatttgaggtgcacctgacgcccaagaggttgaacctgaacgacatgcatctccaccaaagctatttacctagtgagtgtcgctcaacttttgctctaccaaattcttcattcgatgaaaatgcatgatgttggtggtttgaaggtttctgtgctagggaaaaccataagggaaaaaaattaccgtaagagagcgcggcaacaagtgttgggtatattgagctgggaagtcatgacagtggatgttggaaatatgaggtgttttgccatgctatctagctactactagtagaaccattctagatcattgttttttaatccaatggatcatatttattatattactggtagtagaatattatttttctactggtggtagaatttataaatcaatgttggatatcatttttctagcacgaaaatactggtagtataaaattaccactattttttgatttttttttgaaaaagattacctccactattatcactagcttgttcctattctctggaaaaagagcaccgtaaaatattagttgttcttgttctcttggttgggacgtggagagttgtttgtagatcgagttgaaagttggatcatccatgaagtttttttatgtgtaaatcattggagtatgcttttgtgttgcaacttgtttatacatatactccatatggaatgttgaacgcaaggccatggccaccgtacctggcaaaggcctgcccgtcaaatataatcaaaggtaactgtaatattattcaatttaaagcaccagggcacatatagtttaggatcggatgctccccactttctgctagaataggtccttcaatgtattatgtatagaatctattctacgttgaaaagagatttcctcataacaaaaaataatcactacactatgctaaaaatgcgttttttttcccagccacacttagtgctctaatagtaataattacgtacttagccaactatagcaatatatggctgtacatattgagctatacagtggtgtatagtatatgtacagaatctattctacgttgacactagacaagttttatctcataaccaaaaaaaaaatcactacattatgttaaaacatgtgttatttttctcagccacacttagtgctctagtacacctcataattacgttagccaactttagcaatatggctgtacacgttgagctatagtgatatacaataatgtcaaacttgctgcatccaagtatggcaaggtattgctatacattgccacatacgataggcttttactccttcattaaatgcgtccacctagtaccaaatcactttcagctttcaaatctcaaactctttaaattcccagccttgaatccacctgacctgtgcctcgtactcccataatcccatttcgcatccggttctagctttccttggcttcccatttcctcgatctccagcgatgtcgc

SEQ ID NO: 45984 - DNA, 1501 bp, Oryza sativa
ctagtaaaatagagatgtacagagtacaataaacttctatagaaagtttattagcagaatatgcgtactgtcaacagcccttaagtgaaattctgagtttcgtgtgaaagtttgaatcttgagaacagctgacaagtgagtttagatgttcagttccgcaatatgagtgattgtgtgtcaagcaacttataaaatgattctagaaggcctactgcccttggaatgtgacttggactggtgttttaggtagtagcttgaactcgggggggtgagatcatagaactacagagacacagaaaagggtaaatattttggacaaaaaaaatagcagactgattttatattataattgactgcaccacctattatgcatattaaaataaaagaaaattggattttcaaattttgttacaatagagcagatattgtgacagttcaaaacatgccaaaatgtttgttccgaaagaaggctgttttagtctttgagcaaaatctcgcttgatagataaagaacaggactaatatgtttagaactttagatagacatacttggagagcagtgaataacagaatgttgtagatcaaataaagccaatttaccatcgtcatcattatctaagaacccaccctaacctataatctttgaatgacgaaaacttgattctgaattctagatgtcggcatgcactgaaataaaccacacagctgtaccactaatttgcttatcaagcatctacttgataaaagaactgctataaaggaagacaggaattattgatttggtagaagacagtgaacaagtgtcaagaaaatcctctagcacttttttattgttgcagtccaatattcccaaccaatcatgctcaagaaacctcttttgtaatttatattgagaaatgatcctcactgcaatgccatcaaatagtaggtacgctctaacttcttgttgtctacagtatggagatagaagtatagaaccttggcaagtattgccctaccagggggctgatgcttacttatcccatttgcctacaactcttactgaggaagagttacagaaagttcttgttgagaatgagaaacatgaggtgtcaatctaaaagacaagtccaaaggcaatctacttttcagcaggagcgtatcatgtctagggttgcagatatagggaataagtgagagtggtcagcagattttattcatcgatgtggaatagcaatgaacactccttatttttatgtaggctatgagagtggacataccacaatatttccagtgatggcaaccaatataatacagtacacctgcctacgccttaaagttaagattccaagtcttcaggagctaacaactcctgataccacgaatgccttcagcacttagattgtgagtatatatagggcacatacctgcactcatcagttcacccaagttcaacatttctgctcaagttagcttcttagcacagcctcttcttgctcaactcctgaagatcatcaatctt

SEQ ID NO: 45985 - DNA, 1501 bp, Oryza sativa
aatgataaggaaattttagttagaaaaatgagtgttcacacttcaaaccagtacgagtttattgctactaaagatgttgacgtagcttcacgtgtgctcacgattagctagagtctagaggagcaagctcacacgcaaaacaaatcggtgtgaatgacgcctttctcctttctagattttcctttttcataacattattttttcttctttgtagattcttttttacattattgttgatccattcttttacatgttataaaagtttagtggtattcttattattagctccgtgctctagttctagcgaattagaggctaaccaaacggttttggctctgattgctgaaatgctataacgtcactagtaaaaactgtgcgccaaaacctagcacatatgaagcaaacacattcagttttccaaaaaaaaagagagcaaatacattcatgtgatttattgcattgaaacatggatagctctataattacccgtcaggtgcaacccacacaaaacaattatagctatacctgtaaaaaaaaagaaaacacattcttccatcttttgaatgaacacttaggagtaacttagttaattctaacctccattacaaaatcgttataatcggatatcactgatacccttcaacttttaacacaatgattgtttcgcttatactcataataagccgtaacgactattcaacaaacaactaaatgtaattcgtaaacaaaatttttatatatgtgttcttagcaatttaaaaaataaatatcgaaaaataaagtaaacaacttaagtgcgatttataaaatttgaatccaatttaagctttaaaaattaaattttatgtgcgatttacaagctgaataaattttgggtgcagtaagctaatttaaacgggttcgacgaccgcccttctagagtgaaaagaatgtacggagcagtaaaagtttctgggcactgtagtcgtgcctctgaccaaacggcccttctagaagccgtacaaagaccaacaaaatccgcgcaagacgaggcccccaaccgcagtcccaggtagacctgacgaaatccacccgatttcccccaatttcctccccttttctattgcaaacatcacaaacccctgtactacttcgcatcgcaccagacgatgattccggtccacgcgacacagcgccctcaatggcctcaaaaccgtaacaccaccactaaaaaatccaagtaaaacgcggccattcaaaaattttctcaaccacaccgtgaccgtgcgcttctcgcctttcgccttcgcctccaaggaagccggcggccgcataaaatcccctcgaatcaaaccgcaaataatcccccccaatatctcacgctcccccctcccctgctttccctcgcgcaccgaccccactcggatcctctcctcccctcctcactgcctctctcccgtccacgagcggttggtcgatcgatcgatcgatcggcgcggtccttcgccagccatggcggcgg

SEQ ID NO: 45986 - DNA, 272 bp, Oryza sativa
aaggtacgtttataaagcttacttccctcggaattttttgctttcattagttcatcgagctaggtcaaaatcacgctgccctcatctcttagcgcgctgttgcaatttagtttgtttgatttttgtttcaagttctactttcaactgcttatatacctgtgcgatggtcttaaactatttaatattggttggttgttcgtaaatcagaattatgagttgtgttattattttgaaaagacacactttacatcaccttcacagtgcttcgtatg

SEQ ID NO: 45987 - DNA, 1501 bp, Oryza sativa
atcccccatctcctttctccttctctctaggtgttggcgacagatttggccgagtttgccgaatccagcgccgcctctcctttctctagtcgagtttggcggatatggtcacgagttcgctagatctgatcatgagccccgcggctaccgtagcttgaggacagcgacgagtccggtggccacagtggctcaagtatggacaagcgcgcagagcggaggaactcgtcggcatggaagagctcgctagcgttagatctgatcttgtcaatgcgaacgagctcgttggcaattgacttagtccctgcctggtaggccctcctctcctctccttcaccatttctctttcttctcgtgaccaatcgcatcgcagggatttggactcccccaatgtgtgaccccaaccatgtcttcgagctaaggcgcgtggagaaaactataacctctataggtcacgttcggtaccgtgagaccacgctccaatcgggaggcttgatatcactcttcatggtgatgcattggacatgaccttatacatcttctatcactaaaaaaaagagagaaaaatatctccaaggctttcaagtgatttgtacctcctttgtaaagaatctcattggtttgtgggggagataaagctattgccaatgtgcgatcagtgcgtcaactgttgagtcataggtctggtttagttcccaactttttctttaaactttcaacttttccatcacatcaaaatttttctgcacacataaactttcaacttttttctttaaacttccaattttagcgtggaactaaacacacccatagaatggccactgttcaatttgcgggcacaacacaagcgcaatacgaaaaagaaatgcaaggaaaggagcgtacactgatagggcaaagcgaaactttagatcgccacttccggaggagtgtactgtgtacaatatcttgccgatcgatctagtaacaaaagttggcacttttccacttgtaattaccttttctattttacaatttatttttgttaggcacacgatccatcagtgctccatggaataatttgaccgagcagaaaagcaagtgagatgctcaatattgtaaaggccatcttgatcttgttatccagccacatgatagaaatgaagaacgtgaatatttttttgatcatgaggaatccatgatttccctcttgttgccgagggacgaacccaagtacatgagttaaataagaagcaaaccaactttgtgcactttttaaattttctcgtcaggaatatgcccctttttaaaatttgcttacgaggacaattaaaaatgcaatcacacactcagatcggatattctggcagacgagaagcactgaactgcttttggaccatctgatgatcacgcactgctattgtacagggcacgcatgtctttcagtgaatttaaaataaagagggataatgccagtggccgctgacctatttggaccatcaaactgatactccctccgtcccaa

SEQ ID NO: 45988 - DNA, 177 bp, Oryza sativa
aattaatttaaggacatgtttcttagctgccatcggttggctggtcatggacaccgaattaaccatacaacttctctcttctcttctctctctctctgagacggctcgcaaattatggtagcggcattacgtccacgccacgaactggtccttaacccgcgccgacctccacgatca

SEQ ID NO: 45989 - DNA, 1501 bp, Oryza sativa
ctcctccctcccgcgcgcgcgcgtcttgggccgctctgggccgccttcttgggccagccggcccgttaagctcggccgagccgccctttctctcgggccgcgccctagccgcccgagggaagtctatattccctccctctccccttttcttttctttttcttttccaaaaaaaaggatttaattaaatccttttcctttagaccaaaaatccaataatcttagaaattcaatatcttcccaaccgtaaatccgtttgactccgttcaaattccaaaatttctcaaatctcgagatctatctaatggcacgcttagaggtcattaatagggctttattttcgccatttgttgagttgtcccgttttgcgtatagtttccgagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaataacttgggtaaaactggagttttacaaaagacttggaaaacccgacacctgggtcggcgcttgcgaactaaatgaatttccaaaaccgcggaccgggaaacgtaccgggtgtacggtttcccgctctcgcacttaaggaccgattccttggaatttcatccaaacataagacaagtatgaccacatgggtggaatgggacacccctggctgagtaactagcttatcaggggagccttgatgccgagagacatgtggattcgccggggtggtgtcggggaggacccctgggcttcctagcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgtgtgaaaaggggttcggtgtttgaaaaatctgcagctgatgggatgagctaggcccgggtggccgtttgaaaagttgttggcccgggtggccgttgaaaaagctgttggccgggtgccaaccttgtttaaattctaaagactgatacattacacatactccgaccggacgagacgcactgtctcatccgtgtcgtttgagaagcactcacttagttgtttc

SEQ ID NO: 45990 - DNA, 1501 bp, Oryza sativa
ttcgagacttacccttaaaacaagtggttgagcatttgcctgaccgtgatcaattaaactgctatccttgaaaataaccaaacttcggttattttcctggaaccctgacttggagaactcatcgcttcatcaatcagttcaaataaggtgatgccggtgcactttcattccaagagggcttggaacataacactgatcagttgttgacaggaagttccacaaaagtgactctcattcagtttccgaacatacagactcttgattgacctttccatctgcatgactgttctgttctgccctgacttcggtgtcaactggttgaacgggctgcttagttgatatcttgaaataagcactgatcacttaatagatcaagctcaaaagattatttcctcgatataacatttcacttctttgcttatcctttattgactcctctgggttgatagactataagctctaaagttgctttccaacaaatactgcaatctgtatgactgttggaaactgactttggcgctatcaagagtttctgctctttctctttgatcataataactccactttcaaaccttgagttgggatgatttatcgagaaggattctctgtcgtacactctgctggctaaacctttccggacctgacccttgtatctttctgacccatgtatggaatgatttcttagtcaacttccgagaggcattgaaatgatttctggaagctataactgttgccttaaattaagtaaaaccattcttgatccatgttcacaccactagggtgttgtttccggtcactattttccacataactttcaaggttatagagttctaataatccatatatgatatcactctcaaatattccatccatcttttcatcgtcttggggtacccctaacactgcacctttattgggagaactttaatggttttcaatttaatttaattgatttaatgaactttgttttatttaaaattacttcttgagctccaaaaattcaagagaaatttcagagaatatttagggcacaaaggatattgcaaaaatattttcggccatgattttaaaaggaaattttaattccctcattaatttacttgataaaattaacttttacataatttctagatatgcgctatttaataatttttgatcccgaacgaaaattagggtgtgacaaagagagaccaagaaagatgggaacggtggggagtgaagggatgagcggtggggagagtgaagcgataaggataaggtggagagagatggcagtttttatatgtcgtgtttttaataggattaattggattaatgccattgcaaacatgtcatatataaaaaaaatgccagtattattcgtgaaacatagtgcgtgccattgaaatttttgaaaatttgaaccatgccactccgtcatgatttctgtcatagagatagatgccaagttgttgctatatcaccgattcaatttcatcctttctctctcgtcttgcataga

SEQ ID NO: 45991 - DNA, 395 bp, Oryza sativa
tttgtgaaacaacactaccaaaatatatgtacttaagtgtcaagtatcaaagtgtgtgcgattttctacaacttggaccataaaacgtgtagttttgtgaaatttattcaaaacataagtatgagcgaacgacggggcagttcgttttcaatcgagctcttgagaggaacggaggaagcaatttgaggccgttggatccatgatcaatgcttcagatggcacgagaatcactcgcctctctctcacctcttcttcctcagctccgttccctacttccctccctctccggcgtccgccgccgccgccgccgccgccgcgccggcacaccatggcggcttcgccgtgagctcatcatgagcttcaagcacggctccgactccgatatctccctcccg

SEQ ID NO: 45992 - DNA, 1501 bp, Oryza sativa
cgccttggagatcagcacggcctccggtggcgggagggcaccggccgcggcggcggcggcgggctcccgaagaaactcgaagtctctggggccgaggcgagaccggggtggcggttgcggcggcgcgggtggctcgacgaggccgagcagggggtcctcggagtcgccggcggcgtgggagcaggtgcggcgcagggaggcgcgtagtgtcgctaccgccgccgcgcggcggcggatcatggagcggcggcgtgggcggtggcggtggcggtggggcctggagctccgtccatggaggttttgaggggagaggggattaaaccctagggaggggcactcccgtaaatatctcggtaagctggtagtggggcccactctccagtgggagaagggagtgtttctctcgctgagccagtgagccccaccacccgaagctacagcgccacacttccctcatctctctctctccctctccctctcctcctcggcgcggctcggcggcgctcccctcgcctgcgcggccgcgcagcggtagggcggaggcgccggcggtggctcagccgacggacaccgtgggttggccctctacgacgccatcagcccggctcaccagcctccgctgacctctaccgctccacagaccacagcaaggcagcaagaggtaaggatttctgaaacgaatccctttccagttctcacagtccgcttgccaattattgttgatctgaagctgaattggtcactgaatcaatggtagagtttgagatttcagaaatgtgagtttgagaatttgaagtatttgtgggggaaaaaacttgttatggttgtgcgtttcatgtatgaaacgtttttttaactgaacaactggctgcaaaatcgtacattcgccactactcgtagcatctcatgctacctgtttgacgtatttgcgcagcggagtcgacactgccaataggagttgctctggtgagattcagctttttgaatttatcggagactattgctctgatggtagttctgtgtggtacaaccgtacaaatagcctgaagtagttaagtgttttcatattctctgtgtttccctgtgcaatggtaggtgccgtgctaggaaagttgttagtgcctcgtaattgcctttgcccttttaccatacctgtgaatgacgatggtgtgttcaggtttgaaccaaccatactgcattaatgctttaggcttgaggatttaaattacattgaacagcttggagtcaatcacgttttgagtacattggaatgccataaaccactgtatagtgtatagtatactgccgtagcaaacaataagctattcccatgtcaggatgtttgatggctgtctgatggcaaagtattttcccatcaaacggaatttggaatgcctagcaggctaatgcatcccttcaatttggttttgaggcatattgtagaattatcaattttttgcattgtcactattttcatcgtctgttccttcagataatccat

SEQ ID NO: 45993 - DNA, 1501 bp, Oryza sativa
ctgatgagaaattgagaatgcattcaagcttggtaccatcacgcatttggtactggagcagcgaccagtggagtgggtgctgatgagtgaatccgagggctcctctctcggcgtgccaatggagagagggacggtggttggccaagtgggcaccctccctgagtcccggaaaactttcactgcgtgggcagctcaaacgcatttgtcagccacatggagcacagctatggtgtcccagagggattttactacggtgcattttgcaggagtaaaaaagagtttatataaacctttttttttgccagaaccacgtcgatatagaacggtataaaccttgaccttttaaagatagtgagtataagccttaacttgccaaaccaaactttagacatggtacactttcttaatcagttgtttgagttaacgtatggctaaccatatttttcatgtgacccacgtgttaaatacaccttttctttttctcttaagcttgtgtaagggtggctatccatacttcttgtgacaagtcagtaagtcacaccttatctgggtttaacaaagttaaccatcaatcaagcgaccccagtacctcatttccagccatggattatgttttctgtttgcataggtacctcattgatggcgcaagggcacttcaaagcatttactactttgagagaatgttgcagaaaaatgtacaaaaccgtgaccatttctattactcccactgaaaggaagtaacaggtattaacatcaatggctacccaaagcgaaatggaacacatggatggacacaacattaggccaattttgctgttcatcattccttatgtacactcttcagtaatcccctagcttgcatcgttgcacggggaaatgtatccaacaaagaagaaaataaaagggaaaggggaaaaatactatacagactgtactccattaaacacaagagcaaagtcgatttatgtactccaccgcgccgtactttgtcttaattatgtctattactaatagagacccccataataattctagtccatagaaaaaaccaaaatagctatgtaattttccatttttaagagagagaacgctaaaaaagaactcaataaatacgctcagaaaaatacggagaaatcgccttctttggacggatctctcctctgctcgccatcgccgacggccagagttccacctgcctccggcgaaggcttctccaccacacccgctgcggccccgccgtcattggccgcgaacacctcgttgacgaccttctcgacgtcgagcacctcgccggcctcgtcctcgtcctccggcgggggcgggatgaacggcgggcgcgccacgcggaggatgcggtcccagtcgacgccgttgaagaacgggtgcgccttgatcccgcgcgcgccgatgcgcttctcggggtccttctccaggaggcgggcgatgaggtcgcgcagcggcgtcttctcgccgacgagctccggctgcttggagaggacgc

SEQ ID NO: 45994 - DNA, 1501 bp, Oryza sativa
tgtttggtctcaaaaaaaagaattatactatatacctttataaatttctttttcgatttcacaaagacacgtactactacacaagtgcattaaccccactgaaactcacacaaatgctcccctaacccatctttaaagaaacgagaccaatgataattttttttgtctcactgaaatctacaaactctttctcagaataaattcatttttcatccattctacataaatcaataaaaaaattagtagagtaccctcaattttaccaaattctaatataattatttcctactttatctagtttttgtgtgtttatctcctaattttaaaaacttcaataaaacgattgtttaaaattcaaattattttagaacaaataagagagtgtaaatataatattattttagaacgaatgaagtaatcctttgagagagaaaaaataataagagagaaagacttttgcgtcggaagcactacgtggtgctcgttttacgtcagagatgagggcaagattacgcatatatatactgtatttcgttgtgggttggtgactctgttcgatggagactaaaaaagttcttttttttttcttgttatgcatgttgtcatgttgaggagtagaaataactaatcttttatagatagcgcgatgagatataattcaagctaaaaaaaatactactccctccatcccaatatattaaaacctaggatcggatgagacatttcctagtactacaaatctggacagacatgttttatccggtcctaggttttaatatattgggacggagggagtatcagtttgatggtccaaataggtcagcggccactggcattatccctctttattttaaattcactgaaagacatgcgtgccctgtacaatagcagtgcgtgatcatcagatggtccaaaagcagttcagtgcttctcgtctgccagaatatccgatctgagtgtgtgattgcatttttaattgtcctcgtaagcaaattttaaaaaggggcatattcctgacgagaaaatttaaaaagtgcacaaagttggtttgcttcttatttaactcatgtacttgggttcgtccctcggcaacaagagggaaatcatggattcctcatgatcaaaaaaatattcacgttcttcatttctatcatgtggctggataacaagatcaagatggcctttacaatattgagcatctcacttgcttttctgctcggtcaaattattccatggagcactgatggatcgtgtgcctaacaaaaataaattgtaaaatagaaaaggtaattacaagtggaaaagtgccaacttttgttactagatcgatcggcaagatattgtacacagtacactcctccggaagtggcgatctaaagtttcgctttgccctatcagtgtacgctcctttccttgcatttctttttcgtattgcgcttgtgttgtgcccgcaaattgaacagtggccattctatgggtgtgtttagttccacgctaaaat

SEQ ID NO: 45995 - DNA, 782 bp, Oryza sativa
tgaggcacatctggagttcattctactttacctttggcatccgtcaacccagcagcatagctcttatgtttggtagttggtcaaataggtttaatccaagaatccaaaagttgatttttgtgggtatagctgcaatttgttggacggtttggctgagtgggaataatgtggtttttattgcttacaattttaactcgtttttgcaagtaattttcagcgtagcacattgggcaaggctcttgtcactgttgtgaagttgatggcaagatggtgaaggcttattacaagctcctcgaatcaagagtgctgaagttttatgctgcatatggctggaattttaagagaaggattcacgcttagttctgtttctttccttttgagtgagcatttgtttgatttgatattgaactccccatattctgggtgagtctatgtacttctttccataccttttggttatcactactagaaaaagcatttttcccaacgtaggggtattattttcacagtcggacatgacctttgaagccaaacgactgcctacaaaaatataaatcggggtgaagttagctgttcgcagacggaccacttaagcggcgcggcggaccacttaagcgacgcctgcgaaaatcaattttcgcaggcgcatgttaggtggtccgcttgcaaaaatagtacctacctccttatcctctcctcccccatccttatcctatcctcacctctcctctccaccactcatttccctccccacctctctctctctctctctctcacttaga

SEQ ID NO: 45996 - DNA, 1501 bp, Oryza sativa
acaagatacatcttttaccttatttttctattataatatatataataaataaatgcatgtttacttttattatagtactttaaaagacaaatatatatatgttgttctagttcctttaaactaaatatttttaaagttattgatggtttaagttataaaagtttgatctcaatcttatccaaaatgttaattaatatggagccggagggagtacttagttgcacactgtagctggagcgtacgtccagctacagatcatcaatgcccaagtgtcgttccaaactgttcctgattccgatccgctaagtcctggtgcaccgctgtcgttggaacgatgcatttagtgcctaacaacacgtccatgttccaggtaagtagcagcatcaagcaacgggagacgaaagctaatctgtgtctggccacgatgtcgtcctagctctatgactgaccaccacttctatcaagtttgaaccaattgtgtgcgtgcgtgtttgggtgaagaggattaatgcgtgtgtccggattagcttttatggttagcaccagatggtattcatttagcaacctaaccgacagtattgtggccaagctggtagctacatggaaagcaagcagtaccatgaatcagcactgtgtatatgtggcactaaggggatgtttaattgatgcctaaccttgccataactaagtttaggctagttgtggtatggtggcacaagtgtgacttagaaatagttgaccacaagtgtggtatacttagttctaaatttgagagcataacatatgggtctcaaagttaagaaagtgtggcataacacaattacggcagcaaaccaaacacatgcgtaagaaactgtggaatcactaaagtgtggcgtggcaaagtgtggcaaccaaccaaacaaccatttactctcgcaactgtctcagtgtgcacgaatcattcaaataggataagcgagaaacgctaaaggtgagtgtttttttttttcgcgatagatgatgaatgaaactgagtttatatgacaattatttgatcgtgcaaacaaatgaattaaatattataaagttgataatttgatctataaaaatgttttacaaaaatcgtgccgttggtatcttacataattcgtgttggtgcgcgtgataagatccaaacagatcgccacaccataaaccagttggactctgtgattaccacaacaatcatgaactattaacagaacgaatatccgaactttttcgtaaggatcggaaagatgagcttagaagggcaagggagagaatggatattgttctggaaggacaaaaaaaaaaagtactactcacaaggcattgccaaggtaggcgattgtcgattggcaattagcaggaaaattggaggatttaaagggttaggcaattggcatcatgtggaggtaacaaataaatgcacataagcttgaataaacaggggcacacggttggaaaatcctaataagtttgcgcacaagccatatat

SEQ ID NO: 45997 - DNA, 1501 bp, Oryza sativa
ccatgggaaataagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgtaatgtatcagtctttagaatttaaacaaggttggcacccggccaacagctttttcaacggccacccgggccaacaacttttcaaacggccacccgggcctagctcatcccatcagctgcagatttttcaaacaccgaaccccttttcacacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgctaggaagcccaggggtcctccccgacaccaccccggcgaatccacatgtctctcggcatcaaggctcccctgataagctagttactcagccaggggtgtcccattccacccatgtggtcatacttgtcttatgtttggatgaaattccaaggaatcggtccttaagtgcgagagcgggaaaccgtacacccggtacgtttcccggtccgcggttttggaaattcatttagttcgcaagcgccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctcggaaactatacgcaaaacgggacaactcaacaaatggcgaaaataaagccctattaatgacctctaagcgtgccattagatagatctcgagatttgagaaattttggaatttgaacggagtcaaacggatttacggttgggaagatattgaatttctaagattattggatttttggtctaaaggaaaaggatttaattaaatccttttttttggaaaagaaaaagaaaagaaaaggggagagggagggaatatagacttccctcgggcggctagggcgcggcccgagagaaagggcggc

SEQ ID NO: 45998 - DNA, 1501 bp, Oryza sativa
tttaccagttatgcaagtaacacaaaaggacatatgaaaatcttgctgtacatctactctgcttctaaacttggcttcgtttcgataaataagatgttctgtttttgctcataaatgaagcttcagcctattgcaatcaacttgaatatgaagttagatgatcaatgaacttttcgttgtttccacatgttgttttttaacgggaatacatcaggggagaaccctgatgttagatttctcctgtaactgttgctgcaaaggcagaattggttgttgtccatgcttctccatttgtacttatacacgatgttttcctctcatctgcagtgaagttactagagatcctatgttctgggcttttgcaacagctagtggtttgctaggtctggcaattagcttctcatctgtgtggtttttacatcggactggcccaacaacttacaggtgatatgatactactaactctcttccttcaagttgccaataaaacatgtttgcatttgcattaaaataatatttgcatagttgtcactccagcaaagttgactacatgttgatatttttttttatttggtttccgttttcagccttgttggttcactgaacaagatacctatttcggtggctggtatcttgcttttcaacgtaccagtgagtgttgaaaatttgtttagcataatttttggtgagtacttgcttcatcactgctgaattgctgtctaattttctttatgaatgtgtgtatacataacatgtctcctgattgtacttaacaggtctttttgctgggatattctttgcaaaggcaaaaatgtcctaatgtgtatttatgacatgaagaggtctcactgccgctttacctatcaacaattatatactgtaaagagatatggtcaatgttcaattgttttttggtggatcattcatgggttttgtgcatagtccttgttcataaggttacacactttgtgtatgcgttcagttttggtctataattgtggtgaggcagaaagcattctgcaaaactagccaccggttggaactctctgcaatctgtctgctcatgaagttgaacagaaaaaaattgtgcaaaataaaagaaaaggcttggtgcttccaatctgagtcgccaatcaagcgggctctaggccggccggagggatcatgtgaagatgaggctgccaatctttgtgcaaaactctccagattatttgattcatagtttcataccaacacctaaagttgctattttttttcttgacagaaaagttcactccaaattggagtatatgtatgtaagataagaaaaaacaatgtcatcaggtattcaggtttaacccttttaatcctcctcacactgaattggaaagaacaagaaatgatgtagtataccacattatcacgtcaaaaatcactttggaccacacctcacacgtaggcactaagttaacatacacaatcttttaccatatgctttgtgagacaaaacacaacatgatca

SEQ ID NO: 45999 - DNA, 1501 bp, Oryza sativa
ccttctttttcatgctctagcagaatgagaagctggtagattctgaacaaatttcataaatcaaaatttgaatgcaaatacactgagtttatcgataagcttgcgaaaaccggtcggctttgacgaaattccgaatgaaaccatcgaaatttcaatcgataactggaaaaaagagaggtaactgaaagtgatttcctttttttaatttgttgttcttttctttcctactataaattagtaaatacatggaatatatctttttttttcaaaaatttatatcctaataggttttacgaatattatattatttatttatttttcttttttttatcaattcaaatttaaatctggatgaaactcatcgaaattttagacggcttctacttttgagcatcgtcgaaacctcgaaatttcacggaacttgaccgatttttatcggaattctgaaccctgaactacacatctctttaactttgacttatagcatcaaattactttcattacatctaaagtgcaaaaacggaggtagtagctttttacgaaggattaactttttaattcacaagtaaacaccgtgtaaaatgattcgagtgaagttacctaaacaggataaataagtgaatgttttctttgtccatttcaactatattttgcgtgtaaacttcatgtaggcacagtgaccgatcgaaatattttttagaggctgaacaaacacatgcgcaaacgaataatagaggtttttaactgatggaaacactgagatcctcccctatatagtctatacatattgtcgtgtttacaatttaaaacccgaaattctaaaccatgataacaaaaaaaatttagagcgcactcaaaagagctaatcgagcttagctactgctcgtattctgtcaacatgttgtcaacatgttttcaggctactagacgatacatttcgtgagaaaattttttatataaaaagtgatttaaacaatcaaatgaacctatttttaagttttaaaaattaatactcaattaattataagttaattatatttctcattttacatgtagctaattagctaaaacgttctcggcgctctaaagtacatgaaaaacatgtacttacacgttacacgagaggaagaaacatgtgaaatggtcagatggacatgttacatactatcatcaccataatcatatgccaacaatgtaaacaatgtacttaccctaaaaggctaaaataacaaggtcaaacccgtgtgatgagtgtgtgaattctccagggtgaggtgtctcacttgacttgcgtttgactccaacaattctcctccacccattgccgccaaattgaccttctcctcctcggctctcccgccgccccgcgactttctctccggcctcccttccgccgcacgccgccgcgccccgatccgttgaccccccgcggcctccaccgcctcatcctctttgcgtcgtctccaagccccttcatgccgtcgaaaggcatctccccctt

SEQ ID NO: 46000 - DNA, 1501 bp, Oryza sativa
cacatggtttcttttttttttaccgtattactttttctattttagtaaatttatacacctaaaatttatacatctcaagtttacacatctgaagtttagagaccaaaagtttatatatccgatttaaatttgaatttgaattcaaatattttttatatatagtatttctatacatctaaagtttatacacctaaagtttatagacctaaagtttataagtcagaagtttacatatccgattcaaatttgaatttgaattcaaattcaaatttaaattcaaatattttctatatatagtatttctatacatctaaaagtttatacacctaaagtttatagacccaaagtttataagtcaaaagtttacatacccaattcaaatttgaatttgaattcaaattttttatatagagtatttctatacatgaatttttctaactttttgttttttaaaaaaaatttgtgtggtgtactgtaataggaagagaagaaggggaggaggaaggagggagaagagggaggagtatatggggagggggggatgaactgatcgcccagcgtgatagctggcgatcgagcacccattagaagggcccaataaaccctggataattgtcattgagtggcacactttcattgagaagacgttattaggaattgtagaagtggataattatgctatctgttgtattgagtgtcactgtcaccgataaagctttgctggttaatgcattgtatttctccatcaacgcttcatgatacaatggtatttggacgtgtttataaaataatatacgtataatgtgggtggcctagcggcggccggttacacatagcagcgatcggtccgatgctagtcttcattcattcaggtatgtattcaggtatcagtgtgtgggtgatagtttttttttttcgtttttctagttacgatatctcatatctcatagttgtgatcttataaactttttcatgtttatcaatataaatttcgtgttatctagtcgttaaaagaaccgtataatgtggcaaaaaaaatgtataatgtgtcagagtttgcacgtgtttatcttgctgccccgaaacgattaattcagtgatttggcaacaacaaaatgtcgtggcggataagcatatccgtcccaaaaaggaaaaaaagaaaaggaaaaaataatctttagaaataaagcccttactttttccaagaagcagaggtaaccgtagctggtattccgcggctaactcaatccctttctctggagtcttggagcggcacggcggctgcgcacgcgacctcgcccaccacctgctcggcgaaacgcccggctcggccgcgacgtgtcccaccgcaccgcgcgcgcacgccgcgccgcgcccgagcccctcgccgcctccgcgcggcgcgccgcgcacctatttaaatgcggccccgatcccgcattctctcaactgcactagtccccaccaacggctcggtccagtagagtttatcccccaccta

SEQ ID NO: 46001 - DNA, 1501 bp, Oryza sativa
caatatcatactgcaagaggcaatacagtaacaaatccccgagagtagaggtccagttttgtttccccacttgctttgctgcttctgaattaagctgtcaaaaacgtcagaagtcttcctcgacaacctggaaaatagcattcaaaacaatccaccagtcaatttctccttccttccatatgaagctgagacacaaagaaaacaagtagtactactaaattagattagattacttgttggaagccgctttcctggcgacattggcggcgaccttgatgatggagttgttcttctgcttgaggaagccgtggatgatcttgtagacggaggcgtcggcgttcttgactgcgacggcggcgacgctggtgttgggggacttggcctcctcgatgtcatcgtactcgggcctgtagtccagcgacatggacgccgcacctgcaaacgcgagagcagtcactcactcctcacagctcactcaccatgtcagacctgagatcgaacagcaagcgagccgccattgccgttacctggaagagatcctcggaagcagaggagggaagaacacggagatgatgagtcgatggggggagaggggaatgggaggagatgctaaaatggaggaagggggagatgcctttcgacggcatgaaggggcttggagacgacgcaaagaggatgaggcggtggaggccgcggggggtcaacggatcggggcgcggcggcgtgcggcggaagggaggccggagagaaagtcgcggggcggcgggagagccgaggaggagaaggtcaatttggcggcaatgggtggaggagaattgttggagtcaaacgcaagtcaagtgagacacctcaccctggagaattcacacactcatcacacgggtttgaccttgttattttagccttttagggtaagtacattgtttacattgttggcatatgattatggtgatgatagtatgtaacatgtccatctgaccatttcacatgtttcttcctctcgtgtaacgtgtaagtacatgtttttcatgtactttagagcgccgagaacgttttagctaattagctacatgtaaaatgagaaatataattaacttataattaattgagtattaatttttaaaacttaaaaataggttcatttgattgtttaaatcactttttatataaaaaattttctcacgaaatgtatcgtctagtagcctgaaaacatgttgacaacatgttgacagaatacgagcagtagctaagctcgattagctcttttgagtgcgctctaaattttttttgttatcatggtttagaatttcgggttttaaattgtaaacacgacaatatgtatagactatataggggaggatctcagtgtttccatcagttaaaaacctctattattcgtttgcgcatgtgtttgttcagcctctaaaaaatatttcgatcggtcactgtgcctacatgaagtttacacgcaaaatatagttgaaatggacaaagaaaacat

SEQ ID NO: 46002 - DNA, 1501 bp, Oryza sativa
aaacaaactaacgaacaattaaataattaagaacagtatgcctgcaccgactacacccctgattattggcatgcaccgttttggatgattggctcatattttctattacaacttgcttgccatgtgtagggtttagttttatatagctcttacaagaattgaactatttcatatgaaattacaacatttctggtgatttctagtctctacatcctctgtaaaaaaacaattctagctataaacctaccagagacacacgtgtcaggttcatagttagaattaagtttttctataagatggagcaagtctttgactgaacccattttaattccattggttatatgtggtgtttaaggggagaaaaggacgtataagtaaaccttaacagacaatagttacaaaagacttccaaatattgaataaaaaaagaacagggaatagttggtgtttcctactcctaatcattgtctttttactcaacaaatgctgatcagacaatctggaggaatcaaggagacgatgtttaattgtaatttaagaatagcatacatagctacttaaaaggcaagttacaaaaagacaaattctaactctcttttttagatgaaaattctaaaactctgttttttatatttcacaagtctaccaaacatgtggtttgtgagagatgaggcatcctggaatgaactgactatagtgtaatgttagaaaaatttcgaacaggtactcctacttgttacgcctctttctcaatgggaaaaaaaaatcgtacttgtcatgataagattccaaaaaaacacacagtcgtggcaaatcctaatctgcaatctgcaagtagatttttttttacataaatctgcaagtagatggttctaaggcaatctctcatctcatgactaaactttgacaagttgtattagtataatcgaaggttaaaaaaatgcagtatttgtaaaatccgaattaactaactgataaatactccatgaaaccaacacatggatgcgtgtggttgtcgcatagttccaatagaaaagagaaccccaagaaaaaaaaatctttagattcctgtaatagcatatgctttcccattaggtagagagagcaaaagagagaaccttctccgacactgctccccggaccccacagaccagtgaccccaccagtcagcgacacattcaccaacactcgtgggcccgcgttgcggtgaaccgtgaacgcagcgacccccactgactatgacactgggtcccacctgtcaggcggtaactgctttccaagtctaaagtccaacccccgcacgggtaggaaaggaaagaagaggagaggagacacgcaaaagcaaagcaaaccactcgccgaacaccaactcctcgccgccgccgccgaggaggaggaggagggagcgagcttgacgccggcgccatggcgggcgggggaggtagggagcggcgcggcggggggaggctgctcgtcggggtgctgctcctgacgctggtgg

SEQ ID NO: 46003 - DNA, 1501 bp, Oryza sativa
tatcctattcttttgtcaatgaaacatcagggcagcatcgtacttgaattctcgtttgccatcttttagagggcatcatcttacacatatatgtctaaattcattaacatctatataaatgtggacaatgctagaaagttttataatatgaaatggaggaagtagatgatttgtccgtgcaagccaggagctctgcttcttctgcctctacacaacgccttaggaatttccaagatgacaggagaacttgtccatctgaatttctaaccacgagtccgattgctcctctaccagtttctgggttgaaagctccaacgacattgagcaacgacgctgatgattcaagttcccaggagcaccttgttccttcagccttcctttcatgccaattgtcttccctttatgattatcgctggtttgtcggacggggagcagtgcttcagctaaggtaaacaccaccaagcctttaactgaagcctggccaatcacgttctccaaaggatgaagagtatttccgccctcgttagctggtgcctggtattctagtgctgtcctagttagctggtatccccagaagtagtttaagtggttgtttgagaagttggtttttgtgtgtgttctagtgctgtcctagtttagctggtattccccagttttcctgaagtggttgctgtgttcgttttgttttgtttcctgtaatgaactctgcttgatttggaccttctcttcgaaaaataacaatgtttaatgatagatgcaaaacttaccagcgcaaacccaaatccaaaattttaatttaagagattgacatggctcgtaaacccaacggaccaaaaccgaaaattcaggatacaaggagcctatgcaatcaagaaccaaaaccaacagtagcaagaaccaaaatttaatttaagagaattggtagaggccgcgcgaaagcatacgaatgcaataaagaacttaaacttaaccaacaatagcaaggaccgaaatttaatctaagagagttggcaggggccgcgcggacgcgtaccccctctaccacaaattatgacgtccactctcccacttggggagatggtaagctaacgcgcccaccaagtgcaatgtgggccattggcctaggccacgagccttcttgatcgcccgttgaccccgtccaggtaagtatggagcaatagtgcacggggctctctacttatagccatctctcccacccgcacctcctcgactccgcgaggtggtactaatccccgacgcttccacccgttttcggtaggaattttttttatttataattttttttattaaaagttttacaaaaataattttccattttgaaaattgacgggagtagtcgcctaccgccctctgggagggcgaggcgaaaatgacgtggcagccggccgttcgctctcgggcgacggccgtcaacgaaatttgcaggcggcccccttgccgccctccgctagggcgattttatactgtgcggggggccgcc

SEQ ID NO: 46004 - DNA, 786 bp, Oryza sativa
aaatcacctaccatatggtacagtagttcatcacccggttggtgttactaaccgagactaaagatcatagggccctgacacagcctgacatggaatcaaccgggactaaaaatgaacttttgtcccggttggagttaccaaccgggagtaaagatgatttttagtcccggttggtaacaacaaccgggactaaagatcttcctcttattaaccaggactaaaaatcatttttagtcccggtttttaatggaaccgggactattgtggatatgggtcgaccgaccaaagatggtttctctaccagtgatatcattgtcaccacctaactagacgaagtccatctccactatgtgatcgtatcttctgctaaacgcgaatgttttaaagaatttcacgtcctgaaaatgatttgttttgtttgattcgcgagattttcatgcctggaaagcatggattcttcacatgtgccaacgtgcaacgctgggatccttgggataattctctactttacgtgctcgcatgactcgcctactggatctgtggtgttctttttttaccccaagaaatctgaagtttctgaaagtaaatgaatctactatacctagtatttttaaagagtatatctcctgcacacaggatcaaatccggggcgttggaagctgatcggatcacggattattcacggggagagatgaaatcatgaaggaaatgggggtagtgaactgatagatcgatgatggacaggtacacgtgaggcccattgcggcgacagcgaagaagcagcca

SEQ ID NO: 46005 - DNA, 183 bp, Oryza sativa
tcagccttttagaaccgaaaaactccgatagccaaaatgttaatataaaaaatcacataaaccattttgtgcacataattactaatttgtcatagttagcatgagctacaaaatgacctgagcctttcttgtaagttgtagatatcagtgatatgttatagcccatcatttttcccttatagg

SEQ ID NO: 46006 - DNA, 1501 bp, Oryza sativa
gcttttaaccacgtggtcgtgggttcgatccccacggacggcgttcatttttggaagcatcatccctttttttttttttgctatatgaaggtactagaaattaccacattaaaaaggaagtatttgcagttttgcaccattagtccaatcattaaaagatgagaattatgatcatccctttttttttttgctatatgaaggtactagaaattaccacattaaaaaggaagtatttgcagttttgcaccattagtcgaatcattaaaatatgagaattatgatcgaactcatgtaagcacaggtgttactagttactagtaatgcagagatcctgaagcatatttatgttaccagcaaattacttcctccgtttcataatatcattttccatattcatattgatactaataaatctagacatatatatctatttagattcattaacatcaatattaatgtgaaaaatgctataatgacttgcattgtgaaacggagggagcataaatcagcaaggaaaaaaacaaaatagacagaacatacatggaaaagaacaaaaagtagacagtacatacatacatgtctaggagctctatgtatggatgtgagtttcggcgagactctcgctgggtggatcatgaatagcatggtgtttgtacattacacgacaaatcgtgaatcttaaaactaagtctagttatgcaaatgtgcaatccaccatgatagttgtattaataagagaagtacaaatgcagacatgcagacgtagagctcgtttgatggatattgtttcacgtgaaagtaaaatggtttaattgaataatggtatatattatgaaaaaaaacatgaaaaatcagataatttgtaaaacacaaaatttgaaaaaacacacacacacacagaaaattattaggattttgatcaatacatcctcacttccaaatggtgcggttaatgtgaagttgcaaagccatcaaaccactcaacagccacacaagatgcaagacgtgttttacttccattcaaaaataagttttatctttttactcatatcgtatatatcaacgcaaaactaaaaataacatagtgtgcggtgatagtttttttctttcctaactacagtgttagtattgtaattttttcctactctattttatgaatcaatgcacctataggtattggtccttcaaaagaaattgaaaagtaactaaaatattatttactttttaaaatcttaaattaattattcatcattttatctacttttaatgtattcattacatgtttttataaacttcgatataataattactaacaaataaatttattttagaataaatgataaaagaaaacttattttaagacgagggagtagtattttgaactcaaaacggttaatcttcttccattgcccctcctctctgtcagtttcgccccgctccccttcgctctcgctccgccgcgggcaaccaccaatggcgcctcgccgccgccgccgtgccg

SEQ ID NO: 46007 - DNA, 400 bp, Oryza sativa
acacatttatgtcagtcctgttcaggtgaaactggatggtgctttactagtagctgtgtacatttgggagcatctaaatttggggaaactgtttataaatttgaacaatgttcgataaattttaaattgtagttactaatttaaagagtcaaatttatatgcatttacatggagccatggaggatgtggtattctaatagagcatcaggcacagtggtcagtggggacattgtagtatggaaattacaggaagtgtaggttgcacattcctgcttctggtggaagcatgaacatctaatctgagtttttttctgaattaagatggattcttagacaggttctgatttgtaatgtttgatttacttgatgtattgtcagtgttaattagcaaatcattgca

SEQ ID NO: 46008 - DNA, 176 bp, Oryza sativa
tgttcttaaaaggcaccaaatagcatatcaggtcatcagataatcctctggattgatttcctactgcttcccctaatgcttgtagttgctacaaaaattgtagacaataaaaaaacgaacttcccagaatgcgaggaagttatagatttcaattgaagtacgctttctcaatgaga

SEQ ID NO: 46009 - DNA, 424 bp, Oryza sativa
tacttcctcaaacaatactccatgatgaaaccaatcttacatacagaggagagaaaagaaaaattggtttggacaaaatgggaatgcatttattagatatcgtcgattgtcaattatttatgaaatgataaagctatcaagagttacaagtgtttgtaaacatatattggtggttttctaattttttgcagatatattaaaaatgtgctgcatatatacttttctcacacacaattcatgttttctgctacaatgaaccatctttagggattgtgtttactacctatttaaaggttcattggcaacaagttctctcattcttccttttgtgagttaatgtcaaaatcaatcagatatattccaattttctctttggaacaaaatgaaatgagtgccatgcagaagactgctgaatgtgctactt

SEQ ID NO: 46010 - DNA, 241 bp, Oryza sativa
ttcctgcacccccgagcggctttcgaaggtgctcactcgcatcttcttcgaacagtttccggggcaacgccatgcgcctgctgaggtggcgcgatctatcctcctcttcgggtcggcaggcgagcagcccccagacttcgccccagaggccatggttcccggctggtttgaggaaatcaccagtggcatgtcgatcgacactacgtcgcttcggtgtttttgatcttcgtcggggccagga

SEQ ID NO: 46011 - DNA, 454 bp, Oryza sativa
ctcaaacttggctctgttcggcaacgctgctatgcagctgtaactggctgcgctgtacagccagtgcatatattttctctatcatgcactgtagcgcagctacacaacaactacaatttagctgcagcgaacagaccccttaatatttactaaacaatttggattacaattattttgggacggatgttgtacataaattcttccttcaattattctttttttcgggggggatcttcagttattctttcaacaaattcaacaaagcatttctctttgaattttttttaaaaaaacatgaatattagggaatgatctaatattaaataattagaaggggacttcgaacccaggccgtctagcccaccaccttatggagctaaccggaagataacgtatgcttcctgaaagcatcactatgtgccggtcgcaaagcaggcgcagcgacggcgagcaa

SEQ ID NO: 46012 - DNA, 600 bp, Oryza sativa
tcattgagggcgtgagctgtcaagtgtcaacatgattgctctagttatgtgcttttcccctcaaaatgcactgatgtagcttaatttcacttcaacaatttatagaaggaaaaaaactagcataagttacttagccacttatacaaaattacttcactttagcttaagagaaatattcgctcggtttttagtaactcttaacattaaaaaaaatatcctaaaataatataggaacttttaacattaaaatttgtcctaaaataaatatagcaatttttctatctattcattcatcttaaccaattaatcacaagttcacaaccgtctcctgtttagtttcttcacatattttctcttctcagccaattgcaattaatcttccctatttaattccacatatatatttgttgaatatttgtttctaacataaaaaagttattatattctataggacatatggagtacgctggtctagcgtcatcttgactaactcaagctagtcattgtaaattaaagattatatcttttggaggttaattgtttggccaatcaaatcatatcacactttctccccttaatttctctgataaaaatcgtagc

SEQ ID NO: 46013 - DNA, 1066 bp, Oryza sativa
  unsure (1)..(1066): unsure at all n locations
gaaacgagtaaaaaagggggagcggacaagcggcgcggctaaaaaggagagcgacaaaaaagccgcgcgcgcagaaggcgggcaataaaacaccacccccaaacaccagcgaganattggattggatgggcactcgcacccnacaaaacanaaaagggcncaannngagaaaaagagggnccaaccgaaaagggcgcgaagacgcacgaanagaaaaaacaccaaaacagaacagaacgccaggcgcaggggaannccaaaggaagggaaaacacaagaaagccccaaaaaccgggnaaanagggggcacaaagaaagaacacaagaacnagaggcacaagaaaaaggaaacaagagaaagaaccccanaacgaanngcccccaaaaaccccaaaaaaccgggcaatgcaaaaaaaacgaganaacccgagcctttgttttagaaacccatttaggaaactttcttataggactaaaatcctctaggcttagtttttttttctcatattatttatcacattgttgaacatattatttgctccacgcttcggaaaatgcattttttgaaaaaaaatctattgtattatttagacccacttgttttgagttatttttcaattttatttattaaagtatttaatttatccctataattaagtagataatccccgaaaataaatttattcaataatacgtttcaaactgaggctaagttttctatgttattcccacatatcaaaaggtgccttagcatactccctctttttggtaatctcttatattttcttcgaaagcatacatttcaaaatattgttattatagagagttcacgacacaattattgcattttttttcgatacctgcttctaattaaatgtttcgaaagagataattaagctggtcacgttatgagtttatgcatccaggttcttttctatttaattttattaataccttaatttgtattttgttgatctaacatatgggcggtgagctaaagacagataatgtgaagagataatatctatttttactttcctcaggctttatgtttcctgcaataagc

SEQ ID NO: 46014 - DNA, 1275 bp, Oryza sativa
  unsure (1)..(1275): unsure at all n locations
attaaaccatatacattttggtgcttgtcattccattgaactttgtcaaactcttgtgagttgtgtagataattctcatgctctatgatcaagatcatacacccacatatatgcacatgctaaactcctacactgggagctaagcaatattccattccatttccatattaccaccaaaataaattctccatactttcatatgttttcttctcctaaaaaaatccttttgaaaaagaaaaaaaaaagagagagggaaaggcatggttatgaaaaaaataaataataaaaatanagttatgctccattaagcatgagcatgacactgaaaaaaaaatgtagccatgccctctcctaatcaataaaagaatgattttttgggagaagaaagtaagcacaaaggagaagctttttctttattttcctttatataccatttccatcatataccacacacacatattgcatgatcttgatcttgagtatgtttagtcatttgctttagtctaagtttttatttagtaataaaggcgaatgcaagtatgccatgtttgatccctaccgagctccacatatcaagccttagagtaggaatcaaaaaggcaaagtggtgaggaattcattttgatacacttagagagactgagtgaatcatttgaggaactaggctttcttatgcaaaatcatttgaaaacttccggaataagagttgaataatgattgggtgattggtgctctaattgttgttctgtctttcaactgcccaaggcaaggagaagcagtgtctcgtgggaatcaggggtaagggtaagccaccgtaccaaagattatttaatctgagagagagtacatataccttgcacctatatctttgagatatgcagcatagtagcaactcctgatcaacaaccaagtctttgtttcctttcgtccttcacttgggacgagcaaaggttcaagcttggggggttttgttgacggttgttatcgatcagttttgaccgtcaatattgccaaaatatagaactagtaatgcttgcaacgcatatatctgttagaataataatattccactagtattaggtatactaaccttttgcagacaatggcaataaagtggaggagaatcgacatcaactcagacgataaatcaatcagacgttgtcgataaccagacttatgtatgaatgggccacaaactcagaattgacacgatgaattgggccaaaatttacaagtctacatagtgaagcaatagaggaggccgccagccgaaga

SEQ ID NO: 46015 - DNA, 588 bp, Oryza sativa
gattattgagcagattgttgctgcggataatctacttgatgatagggagaaataaaatattttgataaatttacttaacaaataacttaaaacaagtggtctaagcaatacatcaggagtatatttttttggagaaaatgtattttttgaagtgttgagcaaataatccatttcaacaatctggtaaataatctgaaaagaactaaacccaagaacctaaaaggttttttatctgttcgttcacttctgattgagacgtggcacaatcatttcttattttcgtaaaagccggcgtttggttaaacacttaaactgattgagcgtatctgtggccattaattagctttctatacttgtagaaatgaatatttatattataggatctgtaaaaaaaatatacataaaaggtatatgcttctcccatccttatatttatcttttcattttgtgagctttagttgatttattttgtagctttttccaacgtgagtacttttttatattcacaatgttgcaacccactttgtagtagttggtcatacttgtctaacttatgtatactagtttacaacactatgctttgcataa

SEQ ID NO: 46016 - DNA, 534 bp, Oryza sativa
aatcagcagcccaatgaatcggacgaaccctgttactgtcacatgcatgtctagctgtttcttctctttctttcctactctctttaaatattctttctcctaaattacttattcaatctacgatccgatcacaccgttgtattcattgcaattaaatcttcacaacaatatatcatatgattatattatgtcaaaataaaaacatgtgttttaaaccgttaaaactaaattttttatacgtggtagtgatatgtttcaatgtgtgtcttcattgtgttccacaaaattccttaaactacttgctactactctctctctccactttctccacctcatccatacatacgtgcatgtattttagcaagcttcaaaatgattatttttctctaaattacttatccaatcaacaatccgatcacactatggtattcgttgtaattaaatctttagaacaagatatcgcatgattatattttgatgaaaggaaaacatatatttcaatctgttaatacttgttgtttcatatgtgatagc

SEQ ID NO: 46017 - DNA, 364 bp, Oryza sativa
tgacggagcgtggggctcctcaccgggagaccgcgcaggcccccctttgccggttcggccgggggcgctaagtgaggttcttcgccctcgatctgaggaatgtcagcgagaagaagcgcacaagacacgggccacgtagacaggttcgggccactgagaagcgtaataccctactcctgtgttctggtggatctgtgtgtgaaggaaaacagagagctccagagccagagagctcgagagcgagagagagttcaggctctccgatcaagtggccagcctctcacctccccccccccttttttgtctccttaggcctgggcctcctttttttatctggttaggggtcaccacatgggcctctctc

SEQ ID NO: 46018 - DNA, 527 bp, Oryza sativa
cgttgggtttctgcctgcctgtggggaccggccccacctgtcaccgggcctaaggagtggcatcatgcccgatcgcctccctcgaggggggcggtcgccctggcgtgacgccgggggctactgtcggtgacatggggccgggggtatcgtgactagaggcttgggtagccgcgatcactcacgtggcccgaccccctcgggggggtcgggcccgacggtgacgtggccacctctccctctgtctccccgaggggtcgggccgctcctgtttcggccccgagggctggggcaccccgaccccctgtggtgattggcgccacgtgtgtgggttaggtgagcacagcggcgctcacttaaccgcatttatagcgggttagacgagcgcgtcacgccgcattcaatgcggcgcagcgcatgcttatccgatctgtgaccagtcgcggtatgtgaccggtcacagaccggtcagatcgcgggttaggtggcaacaggcggcctgtcgcacgcctcgccccgtcccgtcggaa

SEQ ID NO: 46019 - DNA, 850 bp, Oryza sativa
tttcaagtttatcaccttgcctttgctggtttagctgtaccaaaagataaaaggaacaatttccaatgaattacatatacattttgtttaacaccaagtgagctttatataatatttatcaatagacttgaagacttatatatatatttgttataccctatgccttattcgaaacgaatccagtatgcttttttgagtaatggcctggactgcaagttgatttactgtttatgactattactattcacagttaaaactgcaaatttatagaggtgttaggaaatggaagaaagaaaataaaaacaaacagctgtttccatgtctcctaggaactctcagttgctacctaaaaagccaggtgtttcacttgcttggtaaaatgccaccgcacaatttggtaccactgcttaggacctggcacagtttggcaccgttgcttggaacataaacagaaggtctctttttagtgttctgctcaagagctttaagacctctcaagctcacaaccattatcatatgcaggttgctaaaatggataagctcagtggttctgcacgtcttattatcgtttcagatcttgaccacacgatggtttgtgtttttcaactcatatcttagacttgttcagagataattgcagcctgttatatgtcgttttaatccttcttcaattcaaacttgcaggttgatcatcacgatgaggagaacttatccttgcttagatttggcgccctgtgggagtccgtttactgtcaggattctctactagtattttcaactggaagatcccctactctttataaggaattgaggaaagagaagcctatgctaactccagacatcactatca

SEQ ID NO: 46020 - DNA, 359 bp, Oryza sativa
actttctctaatttagtacacgtagcgatttagaaatagggagagctgctagacctagttgttggtctatttgtgtttttttacatgtaaaagtatttttgtttatattttctcattaaatagaaaataacacatgaatgaaaatatggaaagacagaagggaagtgcgtacagtacatacgcacgtacgttcgacattacgtacgttggttccgtatatgatggttccggatgtttttttttctttactagaaaaaatgtccgtgcgttgcaacgggagaaaacatgagaaattaaagaaaaggttaagaaaaatttacattatgtaattaattaaaatataaaatcatacctataca

SEQ ID NO: 46021 - DNA, 1501 bp, Oryza sativa
ttttgtcaatgatcaagccaagacacatatatagaggtaagtcttaactcgacaagatgagataaacaaagcaatggatagagaatgctaagtcgtcattgtcagaccgctcatttcctgaagatgacatacacaatatcaatatagactcgatgttgttgtgcaagtttctagtacgatgttcatgtacctaatgcaaacattgcatattaatgaaaaacggttctcagctattatggcaatgcaaaaggtgattctgtatataattctgatcctccatatacattttgttaatgcagtatcttcttggcgacaacaacagatagattttcagcaaccacacacacaaacaaaaatgtctccaaaaatcaatattcggaaaacttcagaaacacatgcagtctttaaaattggccgacgcatatctgctgcactaaacgaatatacatcagcccggaattgccattgatagaaagaatccgaagcacaaaaattttgagccccaaaatctcatctatacacccaggtcctgctctcctcttgataagcttccaatcttcgtcatcctcgcagtgagaagaaaaatgcaaaaaatactgtgcagataaacgggtccaaatttaggatacaaacagagagtttttatttttgtcagaaatcatatatacaaaaccaaatgactcctaattctcctgtcaatgcagttatatctatcacatcataagcacataaatacagaggattcttgctatacggaagcaagaggcaagtaatttgagatttaattcaaagattggctgggtagcatgtacagaaggcaaaaataaattttgttcatctgttaccgcaagaaaaccattcatgatgcaatcgctaacagctgaagacactactgaatatatctgctcggtgacatattcagctcgctctgcttacaaaattcaggttgaagaacagcacaatttggaaaaaatgcttaatcccatcagtcctaatcccattcacagccttaacaacgattagtcaaagattggacttttgcttttacatagctctgaattgtacgaggcttctagcaacaaaaggaaaaaaaggctgaacaccaacaacagagcgcacaagcgtgtaaaccaataactaacaatcaaaaaatgatgtcgatcagcacaacacacttaaatttctgtgaatagatatcatacagaggtaaactgttgcatccgtacattgaattgttcttacaatacaaataataagattagagaaactgtgatgatgggtttgagattcgattcagacgaaggtcctcctaattgccctaatgaaaagcttccagtcttcgtcgtcatcgtcgctatctgaaggatgatcccagtgtcccatcacctcctcccgtgcttcatcgtagagcctgaacacctctgccctctcaccgaagtagtcgtagtccacctccacgaatccttttcgagcgtactcgtcgcagacccaagcctggaac

SEQ ID NO: 46022 - DNA, 1501 bp, Oryza sativa
tctgccctctcaccgaagtagtcgtagtccacctccacgaatccttttcgagcgtactcgtcgcagacccaagcctggaacttggcgaacttggcatcatcctcgtaggcgttgcgggcgcaggtgtagaggagcatggtggactcgtccttctcctcctccggcgagggcaccagcgacgggttggcgcgcttcagctcccggtacacggtgcagacggtctcgttggactcggcgaggatccggtccacctcctcctgcggcaacagccacatcttcttcgccggaggatgctgctcgtctagtcctccgtcgacgtggaagactcctcctccgccatattgaatatatagcttaattactcatcgccggataggagtcggagtcggagtcgggggtggtgcgcgaccgaggcagtgtcggaatcggaggtgcgagcgctggcttgctactttgcaggtctgcctgcttaatttgttctgccttatcactcgtcgtattaatagcctagttggtaactcctgaatgggatcaacacatcgagtagtaacggagaaattttactactctttctttgtttcgtattactagtcttttttttttactggacgtattactagtcgtttgatttgttttcaaactttattgagtttgattaaatttataaaaaaatttagcaacatctaaaatattaaattgttttcattaaatctaacattgaatatatttttaatgatatgtgtcagggttatggataccacatacctaataatagttgactaaatctcggcaggacccaccacataccatgttttatacggaaacaaccttgtggtacagaaggagttccgataaggaaagataaatagagttatatatggaaacgacaaggattactcggattgtatctatattggtttccctaatctacttggaaaagggaacactatgggtataaatacaagaccccctaggaggagaggggggacggaacaatagatgaagacacaagatcaacatacaagccaacatacgccaagacaggacgtcggatatcgacttcagagataagcatggctagtcccctatggtgtctacggatactgataggagagacatagcgctatctttgattttgccggatgcggaatcgaggaggaaggctaccctgttgttgactacgagtcaacacttcagaccgccaagtcgacaacagttagataggctactccaaatattatactggtgtgattatggtgaataagagcaacgaccggcttcggccaacaggagtagggttattaattacctgacaattcagggaaccgaacctgtataaaaatcatcgtccccatctcttttacctcaatctcacatatatcctagtaccaacgatccccatattatacaaataccgtagacgtgacatcaaacgtcgacagtggcgtgccaggtaggggattttggtgcttcaggatttcgacgagatgggttcaagaga

SEQ ID NO: 46023 - DNA, 1501 bp, Oryza sativa
atgttttgaccgctggacaaatattttttgtgtttaataaccaggaggaatatacgggctatttggtttcagaatcaaattaaaccactaaaaactgggtgatctcttccaataggattatatattcctccatatattgtattttactactacttcacttagagcatggccaacaaacatccaaaatttgatcccctaaaccctgttatggaaatctctaatgagtatttaaggcatgaaaatatcaatctctcgaaaaaaaagcccatatatattgatatttctaaataaaaaggtgggccgctttaaaaaactaccaacagaatcattctctcgtccgctcctcccggttattcgatcaacacccaatgtacatgataccttgtgctggcgccactataagaatctgcaatttttttggcggtcaaaaactaccaagtatagcatccgtcaagtaaatactaccaaatttagaaagttaggaatattacgatttccttgggctaatcgttaagattaattattctgtcaaccgattgccaaggaaaacccaccaagtcttaaaattacggattcttgtggtgcgcgggagttcgcctagatgtggatgaacgaaaaaaccgaagttggcattccaagtatcgagaatctagcagggaactgatggatttgttttttttttttgacgaaaatcctcaatttcttcacagtagatctttcctgtgtacagtgccctcattgatcagttaattactacagtagattcatcaaatgaatgaatcataagtagtgccatctactttatctatgttggatcggtagattaaatactccctccttccctaaatgtttaacgccgttgattttttaaacatgtttgactgttcgtcttattcaaaaacttttgtgaaatatataaaactatatgtatacataaaagtatatttaacaataaatcaaatgataggaaaagaattaataattacttaattttttaaataagacgaacggtcaaacatttttaaaaaaatcaatggcgtcaaacattttgggatggaggaagtactatcacccaacttttctgatccctcttacgggcaggcccagcctaatttttgccaaaattatcaccatgatgaaaattaattcaacccttggagactggcccaaggcctacaggagatcgtctctaatccgtgaactatcatgatgtatcaccacaataataatattcataatattcagtacaatcgaccaaagttttgcaacaacataacaatgttggaagtaactcaggaaattagttctcgcagacaaaactatcgacacccaagatctacattgctccacgagaactttctttttaagttgtccaaccaatctataggagtctaatgtttaggtttaattaaatttggggtaggattcgagcaaattaaagctaggtattcagcttcctctaatgaaattataaaacctctaatgtctgattttattgatt

SEQ ID NO: 46024 - DNA, 1501 bp, Oryza sativa
atttagctatagaaaatcattcgacagccatttagccatttagccttccccttccccttttggtgcaggaagcttccttcctatagttcagagctcatataaaagaaaagtccaatcttttcactaatcggttgctaatgtgatcggacgggttaatcatatagtatatgagttatagtattttcatcagaaactcatagttggaatcgcaactaagcttttcaaatgttcaaagcaaattttctcagatgtcggatggaactaattaatatcttgccaatttagatatatacattttttcactgtgctttaatctgagcagccaaaggtccgtaactcgattcttggatccacaaaaggttttggtcatggggtggtctaaagatgagatttttggggctcaaactttgggtggttcagattgcagttcggggctgatgtaaattggtgtagtgcaaatatgcatctggtcaatttgtaaagactgcatgtttttctgatgtcttctgagtattgatttcgggagagatttttgttgtttgtctaccgttgccgaaaatttatctcttctctccaagaatttatttactgcactgccaaaatgtatatggagattcagaattcttcagaaccgcttctgcaaggccaaaacagctgagaaccgtttatcattagtatgcaatgtttgctttacggacatgaatatagtagtatggacttgcaacatcagtctatgcccttactttatgtcatcttcatgaaatacgatacgtttgcagtcaccaatagcatgcggtttatggttattcagaacttcagagttcttttctttccaacgcagtcagtttttccctctcgtacgtgtttcagagaaattgggttggaggcaaggagtaagtttgataaaaaccgtgaattacacaaaaccacaattatagtcttggcaggtggtacataaccccaaatattatggtcttagtattgaaaaaaaaatcagatcaaatattagagcacaaataacaaaataaccaagctcaacatggatagcatcccagttgatgaacataattatctggtaaacggtagtgttgactgcagaatataccgctgaaattgactacctgcgagtgcgagtagcgcctgtctgattcttttacgctcgtagtccccttgagagtatttgcttcttattgggaatgactggagtgtgattttttttcctgctctcagttggacgaatcaacaaaatcagacatcaggagtttcattagacgacattgaaactaaacttaaacattagattcctaggattgcacaatttaaaaaaacaaagtccacgtggagaaatgaagatcttggatatagataattttgtcggcgagaactaactgcaagagttcctgccaagatatttcttgtgctaatattttggttgattctacaggggtctagctatacattggttgataaattttctcctaaaaatttatttgggaggtcc

SEQ ID NO: 46025 - DNA, 1501 bp, Oryza sativa
taatgccgcagtgcccattggatccttctagtcataacacctaagtggagtacatgtcactaactgaactccagaattgataagaacacatatgattagaccccaattcaactagcgatagatgaagcgtgggcccaatacgtgcaaagaggatgcctcaggaagacaggacatgacaccctcatccacaaaaaagacttcccggtgaagcaacaaataggtgaccagtgcggattccatgtgtgccacaacatgcgccttctgtacagagaaaaggtgaagactttggctgagtttgaggtcggtggtctcaattgtgatagactaactacattttagtacttatatatgatcgatcaagtaatctggaattatgacaatgtagggcacaataaccaagtctctgcctaccagctttgaggagattcgtgaggagatagccagcttcatcctccgtgaaataattaaccccaaaggaatgtttaggcttaaactaaaatgatgagcaatgttgaacttttatgtctagagaatgatgaacacttattatgcaactgtgatgatgtaactgtgatgcttatatttatgtatatatttcatatgtttatgttaagacttgctaaataaatatttgatccaattaactcggttttgcaggtgaaatacgataaatatttaaatggatgtgaaatatgtgaatggatatgaaatatgagatggctgtcaatgtgtggttgtgtgaaatatattgatgtctgtgtatgtgaatgcatatgtatgaatgggtgatgctggggagctggggatattagatatctgtatttgtttctgtcatttttgcagcgggcatggctagcaaaggcctgaggctagccaaaaaaacaaaatttatttttttttgtggattatactcatctttgacgggccataactaaatgcccgattgagatgatgttcatctatgatgggctctagtttaggcccgattgaggtcagcagtcatctgtgacgggctctagtttaggcccaattgagatgagtgtcacatgtgacgtgctctagtttaggcccgattgaggttagtagtcatctgtgacgggctctatttgtggcccgattgagataggtcatctgtgacgggctatagtacgcttggtagactgggtcaaagctatcggtgacgggcttcaattagggcccgattgagataggttcatctgtgacggccatttgcccgattgagattacttttcacatcagtaacttctagcctatgacggacgccgtgcccgattgagatggggcttactgcctgattgagatgagggtatccgttctagtggtccctggtgccgttgccggaggagaagggtgagtacaccatgctcctctacaagtggacccacgactcctatgaggacgaggccaagttcgccaagttgcaggcctgggtttgtggcgagtacgctcgcaaaggattcgtggaggtggactatgacta

SEQ ID NO: 46026 - DNA, 1501 bp, Oryza sativa
tgcttctttgcatactttgcgatatatcatccctagtcgtgcttgaatcggaaaagctaacctgcctttgattataataagggtttcatcggggtttcagctgatgagttatctggacgttgcatcggcttataaggattacatacaagttagatttagccgatcgcaacaaaggtttcgttgtttatctaatcttgtggatttaatgacatcagacctccagccgatgtatgctttaaccttcggatcaatacttattctatcatattgttagccgattggtttctattggattatattgttgtattgttacattattatcagccgattgtctatgtatcattatttactcaagtatcagatcccacattggacgtatagccaatagctcaaaaccttatcgctatcggctagtatcggcatcgaccggaactactccagcggcttgtcagctgatcggctatttgatctactatttatatatcttgtcagttgtaggatcaaactgactagcatgcccgcatgccatcatgttttggacctgcactagagctaagcagatctctcaggccattgtgttcatcaacttagttcgtgccaacacagttccggcaccatcggctgagcgcggatttctcgtcagcagccccccaattccgttgtatattatataatgcggcggattttgctcttctcgaacccgcatcaatctaggggtttctgttttgactgtagaggccactactttgaaatcccctttttccggctaagtctttcatacgtgctccatcgcaaaaactctttcgtctccgacgactccactggtgatccagtccctcggcggcgagctcctttccaacgctctcgcgctctaaaaacacgctaccgacgctagtgtcgcgctaccaaagtgcgataccgatgagcccactcccgtccatgcctctctctttctccctaatcgcaaaacccatcgccacgtggcactctcgctcgataaaatagcgataccgccattggtgtcgctaatccaaaaagcgatgtcgccagctcaaatgcttcacttttctttctcgcaagattgtcgggctaacgtcattgtcttgctgattggtactgcgatggcatggcggtatcgcataatccggttgcgaactgggtatcgcgcttcctaaccgcgattttggaaaaaaaattatatattttcaattttttctcgcaccaatccccaaatccgctggcgctcgcatcgcacgttcgctccggtccgcacgcgagtaaggctgtgtttgggaggaaggttcctcccaacatggaaagcaaagcatgcgattatagtgagatcaattaagtatttgcctaaaaaacttgaaaaatggattaatatgattttttaaagcaactttgatatagaaaacttttgcaaaaaatataccgttcagcagtttggtcaggtctatataaaaacgtagtattattttaacacaaaacaaacatattt

SEQ ID NO: 46027 - DNA, 1501 bp, Oryza sativa
tcctgagttacttccaacattgttatgttgttgcaaaactttggtcgattgtactgaatattatgaatattattattgtggtgatacatcatgatagttcacggattagagacgatctcctgtaggccttgggccagtctccaagggttgaattaattttcatcatggtgataattttggcaaaaattaggctgggcctgcccgtaagagggatcagaaaagttgggtgatagtacttcctccatcccaaaatgtttgacgccattgatttttttaaaaatgtttgaccgttcgtcttatttaaaaaattaagtaattattaattcttttcctatcatttgatttattgttaaatatacttttatgtatacatatagttttatatatttcacaaaagtttttgaataagacgaacagtcaaacatgtttaaaaaatcaacggcgttaaacatttagggaaggagggagtatttaatctaccgatccaacatagataaagtagatggcactacttatgattcattcatttgatgaatctactgtagtaattaactgatcaatgagggcactgtacacaggaaagatctactgtgaagaaattgaggattttcgtcaaaaaaaaaaaacaaatccatcagttccctgctagattctcgatacttggaatgccaacttcggttttttcgttcatccacatctaggcgaactcccgcgcaccacaagaatccgtaattttaagacttggtgggttttccttggcaatcggttgacagaataattaatcttaacgattagcccaaggaaatcgtaatattcctaactttctaaatttggtagtatttacttgacggatgctatacttggtagtttttgaccgccaaaaaaattgcagattcttatagtggcgccagcacaaggtatcatgtacattgggtgttgatcgaataaccgggaggagcggacgagagaatgattctgttggtagttttttaaagcggcccacctttttatttagaaatatcaatatatatgggcttttttttcgagagattgatattttcatgccttaaatactcattagagatttccataacagggtttaggggatcaaattttggatgtttgttggccatgctctaagtgaagtagtagtaaaatacaatatatggaggaatatataatcctattggaagagatcacccagtttttagtggtttaatttgattctgaaaccaaatagcccgtatattcctcctggttattaaacacaaaaaatatttgtccagcggtcaaaacatgttttcgcagaggcaaaaccttccgcctgtatccaaatgacgctaaaaatccccaaattttgcaagcggaccaacgattttcgtaggcggcagttcgaatcttcgcaggcgctgtaggtgctacagtagccccgcctgcaaaaatattgtcggtccctagggtttcaaatcacaaatcacaaatcctcacaaatctcatccaa

SEQ ID NO: 46028 - DNA, 807 bp, Oryza sativa
accgggactaaagattatagcactgcatatgattttcacttacatatgtgtttataaaatagaagttaatgcattaacattatttaaagtacaaagattaatgacaattacctcgaaaaattatttttgtctgtgataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 46029 - DNA, 417 bp, Oryza sativa
ataactttcattgacataaattaaaatcatatatcataattcggcataaatgatgaaagaaatataataaaaaaataacgacatgaaaccacaaataagtttggtcggaatgataatttaatattaaaacaattatataactaaatccccttttttcatttagctataaataattcaatacagagaaaaattataagttaaaaataatttttagtggatcaaatagtgctaaaactaaaattgtaaatgaaaaaacaaatgaaattagctagcaattgaaaaagctcactttaactcatagatgaaaatttgatccattaattccgaacgggtgcccgtttcattaacataaattagaattttcctattatattcatattactatggtttcaatattatgtgagtgattcaggagca

SEQ ID NO: 46030 - DNA, 477 bp, Oryza sativa
atgtgaaggtgggtacgtcaagaatgcccaacttgggcacgcgcttgacggaccgattgtgccggtgaagttgaaggcgcccggtcgactggtgtcagcggaccgggcggcgggtgacgacagcgcgcgtgaacggtcggcgggcggcggacggcaacgcactggggcggtgtaacgccccgatttttgttcgggaaattaaaaatcattaaataatgcattttctagaaactaaataaaagttaaagcaatttaatcaagtgaaatactgggagaaataaaattttactttaaaaatcattggccggaaatattttgtaatattctctgtgccctaaaatactctgtgaaattttccattaattttcggagctcgagtaataatttgaatagcacaaagtttatttaaccaatttaataaaaagaaaaacaattaaatctaccctccttcactttgggccacttccggcccaaagc

SEQ ID NO: 46031 - DNA, 222 bp, Oryza sativa
agctcgggctcgtgcagagagagcggaagaaggcgcgatgggctcgggaaagagggggaaacgtaagaggagagcacggggagggtttatataggctcgggagggtgaaatcgtggccaagaggggcgggatcggacggcaaccggccggtgacgtgggactcaacgtgggcggagtggggactcgatttggcgccaaaaattggggaaaagtgggggaaaa

SEQ ID NO: 46032 - DNA, 1501 bp, Oryza sativa
tccctctgtttcacatataagtcattttagtatttttcatatttatattaatgttaataaatctagaaagcatgttattgtaaggtttattcggcagatattgctgctacagcacagtaccagtttacaagagaaaacatgaccatgctgcagcgactctactgtacatgcccatagaggcaattgttttctaacttttctattgtgcacatgttaacgttaaaatttggtaaacccgaagtcgttatcgacctagacagtatcgaccacagagttctaaaattgacctatgaaaaatatcatctgccagcaatcgaattattagtgtattcagttaagaaaattaattaattaaaggaagtttatccagaagaggtcgagtttaagaaggacgaggcatggtaatttatctattaatttggcaacgtctgttagttttctttttatttttaggagagattgtttagagtccgatcaaggctcgtgtcttttactttatctttaggaatgtttgtgttgtgtctaagaaggactccctccgtccctaaatatttgacgctattgatttttctaaacaagtttgaccgttcgtcttattaaaaacttttgtgaaatatgtaaaactatatgtatacataaaagtatatttaatgaatcaaatgataagaaaagaattaataattactttaatttttttaaaaaagacgaacggtcaaacatgtttaaaaaatcaacggcgtcaaatatttagggacggagagagtactagtgtctacctatggctataattacatacactcgtggttattataaattatctctcgatcaataagatttatagaacattgccgccctcttttttgaggttttatcaccgacgaaactggcacctgacgcggggctgcattgcttcgatctcccatgaaggcgtaagccctaagttcggttggccctagcaattgtataagctattttagtgttgttcaaggctacatcacttcaatttcttagattaatctggtttgattggtatatttgtctacgtgatgtttcaattacatatttaattgcactgtgttgtttagagacataccggtttagttaggattgtctcgattaggtccgatcttcagccttagtcgatttgttttaaatagatttgttatatctatcacgttagcatagatgatctatcaacttaccaagattgtttgatcagacgcaatttagaactgtctcgcggttaggtcactactaacaatctaagtcttgctaagtttatatattatttgtgctgcgttttatcggagtattaaccgataacttatttttacatcggacttccaactgatttatgctttaaccatagagcttacatttaatattatatatcaatatcggtcgattggttcataagacatctacttcatcatattatcatcggccgattgaattgtttgttcaagtgcttccattgtctttatcaaagtgtcagaatcta

SEQ ID NO: 46033 - DNA, 1501 bp, Oryza sativa
  unsure (1)..(1501): unsure at all n locations
atacaagaaacanacacatcagaatggggtggtaggaagtcattaggaacacaaaaaccaaattatttttttgaaataaatataacacaaatagaactaacctgataaaattgagtctaacgaacgttgtaattaagtccggtttaaccggacgtataccatgtctgctggtgtgcctctgttctgaccgctgatagatctttggtctaattggaaaaaatggacaaacataactctttacaagatgatcaacaatattgcatcaaggtgagttcataatacctctaaaccgcctctccaccttgatgtattataaacagatattgagacaaattcttttattaaatggcacatcacggaccttgcacgtaattatactcaatatatatttgtccataaatataaagtattttaggttatttaataaaattttaaggtgaagggtgaaattattctgttgtctcaaaaataagttgattggaaattaaagaacagtctagcgatgtactgctccctccgtcctataatataagggattttatgtccaaatttattatattaggatgtgtcacatccatccaaaatcccttatattataggacggagggaatactaactactactctctccgtcccaaaataaacgcagtcatgaatttccgtgcacaactttaatattccatcttatttaaatttttttaaaaaataaaaacataactattcatgttttataatctaataataataatatgctaattatagaaaaattttaaataagacgggctacgtttattttagacgcatggagtacagggaacgcaacaaataatgtcgttgaatgcatggatgagatcagatcgatcacgtgcaggtacatgcatacagtatgtatttcacgtgggtatacgcatgtgtcagaaaactattgcatcgaaccaaacgcttagttatatacgccctcggaatttgatgcagcgaattatccaccctgtacatttgttcacgaatgctggtgcgaattgaatgcatgtgtatcacaattaattcacagacctgcgggtctctcttgtactacatccgtactaaaatatagtaatttttagctatatatctaaatttatagttaaaaatatttacgtttgagacggaggaagtagtcttaaaaaaaattagtgatcggccgttgcacacttgtacagctgactacagtggctgtccgccatgcttgtacccaatatttttatgtttataacaaatttttgtattgttcttttcaggccggtactacaactaccaaaaaggtcaaccgtatggtgctggtgcaaacaatgtggagatttttacccgtgtgccattaaaaaacatgatgcctgcctctgtgccactaaaaagttcgagcctctctctatgccatcggcaaactttatcgcgccctccacaccattcagtcctttttagtcctaacggtgtcaaacagcgcaaccaaatgactttgttgccct

SEQ ID NO: 46034 - DNA, 392 bp, Oryza sativa
tattttattggaaattagacttaatatgacattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 46035 - DNA, 1501 bp, Oryza sativa
ataagcacaattcaataaaatgaatggatgcagtttaccgattcaacactaggaagaagctaatttatggatcaacaaacagttcagctgtgcatgacatctgttgaacaaaatttaagtgtgtttgtttgaccaaccatcattgttgattattaattcttctaaactgcttggtttacgtgctctgttgttagtggttagcttttttttttcttttgttgcaggaagcctcgtacagttcagagcttatgtaaaagcaaagaaaaatctttgactaatcgtgattagtctgtgaatgggattaggactgatggcattaagcattttttccaaactgtgctgttttcttcaacctgaattttgcaagcagagcgagctgactatgtcaccgagcagatattcagcagtgtcttcagctcttagcgattgcatcattcaaatgaatggtgttcttgcgacaaaagatggacatacttcatttttaccttctgtacatgctacccaaccaatcttcgaactaaatctcaaattacttgcctcttgcttctgtttatcaacaatcctctgtatttatgtgcttctgatgtgatagatataactgcattgacaagagaataaggatccactctagtcattggtaccctaaatttgtgaaaaaaaaaaacaatttctgtttgtaccccaaatttggacccgttcatctccactgtatttcttggatttttctgctgacagcgaggataacgaagtttggaagcatatcaagaggagagcaggatcgacctgggtgtaaagatgagattttggggctcaatttttgtgtgcttcagattctttgtatcaatggcagttccgggctgaatggctcatgtatattcgtttagtgcaccagatatgcgtcggccaattttaaggactgcatgtgtttctgaagttttttgaaaattgatttttggagacatttttgttttgtgtgtgtggttgctgaaaatttatctgttgtcgtcaagaagatactgcattaacaaaatgtatatggaggatcagaattattcagaatcaccttttgcattgccataatagctgagaaccgtttttcattaatatgcaatgtttgcattaggtacatgaacatcgtactacaaacttgcacaacaacatcgagtctacattgatatcgtgtatgtcatcttcaggaataaatgacttagcattctctatcaattgctttgtttgtctctgttagatgatatggtttctagagatatgaatagattagttggcacttgtgatatcgttcctatccaatgtatgccgattgtgttcctgattatccgggtttgttggaactgatctggaaccgatcggtgagattgtaagtgccacggcgagggctattctcgcctatattaacaaaggtgcggccccgagaggggttcaacgcttcccatctattttattcacatggtatcagagcaagatccaatctagctctctccct

SEQ ID NO: 46036 - DNA, 231 bp, Oryza sativa
tcctggttatgtttaattttatcactagatcacctcacattgttcatgccatgattattgtcttaatattttagattaaaatatgccgatatatgactatatttccaacaatccaaaaacttgataggtcattttcggtagttagctttgctactgcactgaaaccacatgcttttgatggttctaattataagagatggaaagcaagtgcactactgtggttgacagcga

SEQ ID NO: 46037 - DNA, 1468 bp, Oryza sativa
ccgtgctcccaagtaattgattaatcgattgaggttgggatgtgttgtactagagaattactatgtactaattgtgtccgatccagactcatttgccggggatttgagataccaaatgctgattgtcggtttgtctaacggcaaatgtatgcttttttatacatgttccattttataaaagggttgtgggacaaaatgaattgctgaagaaagtgtcctcttcatccgtagtgtgttagtttgcagcagagcacatagatgtaggggaacaatgtatcgttggccatttttttatggtgttcatgcaggccagacatccaggcttcaatatcatgagaatgttagctgtccatataccatgttttcttttggtgcctaggaaactaaaatatgaaatatatttgttatatcttaaaagttgaaactgctgcaacatatgtaatatatagttactagtatgttgccctccctagtagaagtaaaacagtacaaatcataaattagaatatcaggtggatggcctgatttgcaaacagcagctacttaatgctgcaattgtaggactgaaatcactaaaccactgcaatcacacttaggccctgttagttaggtcggattgtccttagtggcttagtcatggtcagaccacgagccctgtttgcaatctgtcaaaccaaatgtaaaattggtgtcttctaaccccctaacttctattggcctggaacttttcgactaatataaactttatctatttagaaactgttccaagaagaactttcgcacttcgacttatagatctgaacatattgaccctgaaatcataaaaaacatgaaaatgtggtcattttcaaacatcagaaaggaacaatgaaaattttcagaactatttctttctgccctagcaagttttggatggatcaacttgtacaaaaatagacaaaaatgaagaacagtgaggaaaagcaaaaggattttacacctttggatttatgaattttatctttgttgctttaaaatgtttacaaggtgtatccttggcacccttaaccacatgggaaaaccctagatgaaaatggaaaatgtctaaatccctaattcttctctaaaaatcctcaacaattttgctctccccgagtgtttatatacccgcaacatggctgtcacaagccacaaatctttctttatctagggctcgtagctgtagaggaaagactcgcataaccgagtttgtcctcgccaaacttggactatttttaaattattatacttttccataagatgcacatctcccatgaattccatatggaaatctcaccttcgcatgcactgttatctacccgtgtgtcccacatgaactcattgactatctgaatgactgaacctcaacacccccatctgtcttgttcctatctaaggtcatcgaccacgctcaccctcaagtaataactgtacataacgtcataaccaa

SEQ ID NO: 46038 - DNA, 569 bp, Oryza sativa
gatctagcatgtatcagctaaactctgataccactctatcttaagatatcaaagcaaatagaatatttcaaccaaagcctaatattcctaaatgcagcaagatcttacattaaagggcaagatttaacatattaacgaagcatatagagtaaaaatagttaaatcaggtaagatcggctgaaaccccgatgctaccctaatcgtcaaccagaaggcaggctagagattgatattctaagcacgacttaatagatcaaactcaactgatgcagcattaaatatgaaaagaagaacaatatctagacaatcaagccactagatgcttcatagagtggtaaatatcctatataatctaagccaacgtcgctatttaacctaatcggctaccttctactaacagatgttagccgattgtaggttagataacgatattaccgaagattatataagatatatgataactcgacgaattacataaataagattagagtatcataaagatggaagcactaatcccgagaacgcaagctgctataacaagtttacctcttgttgaagatcgaaatcga

SEQ ID NO: 46039 - DNA, 1501 bp, Oryza sativa
tgcttaactctagtgcaggtccaaaactcgccttcgggtatgctagcgtaccagttgatttgatcctgcaatcaacaagaaacaaggacaaagaaaccgtggttaaatccataaacgatagccgatcggctaggtgccgatgacatattatttatctttgagccgatgtcatatatgcatcgatcggcaagtatcaataaataaaacagaactaaatctactcgatcggctatagatattaatgatatatgatccttatatcgatatatacttaaaaccaagtgattgggatagatcggtcgccatgccgagacagtataaatcacttagatcgaaatatatattaataatgagattatatatattcatagtatagccgatcagatagatctagcatgtatcagctaatactctgataccactctatactaagatatcaaagcaaatagaatatatcaaacaaaagcctaatattcctaaatgcagcaagatcttaacataaagggcagatttaacatattaacgaagcatatagagtaaaaatagttaaatcaggtaagatcggctgaaaccccgatgctaccctaatcgtcaaccagaaggcaggctagagattgatattctaagcacgacttaatagatcaaactcaactgatgcagcattaaatatgaaaaaaagaacaatatctagacaatcaagccactagatgcttcatagagtggtaaatatcctatataatctaagccaacgtcactatttaacctaatcggctgccttctaccaacagatgttagccgattgtaggttagataacaatattactgaagattatataagatatatgataactcgacaaattacataaataagattagagtatcataaagatggaagcactaatcccgagaacgcaagctgccataacaagtttacctcttgttgaagatcgaaatcgatgcagctcaacccgaaagtaagaacttgtcgaaacaaaacgaaagtaaaaagagtggcgatgcgccgagattgtattgaacgtgtgttaaattgattacatggggctcggggtctatttatacccgagaattacaaaacatgtccgtatcggacacgactcttatctctacaaactctaagataccataagtctttgcggcagacttttgcccgaatatatctctaaggaaattacataaaatatcctaattaatatatacaattgccttctcaagactctatccatgtgtggcaatcatcacgaagcacattaactcaacccgatgatgtataccgagtcgtattgtcggaatcggctgtatcagcttacccaatctgactcggactcagccgatcctgattgtagctgatttggattccacccgattcttactctgttcccgaatcgatcttcgtctttgattccgcttcgatctaatcttcatcttcgatactgacactggtggagaaaccctttgtagtcccggttcgtaaccccccttt

SEQ ID NO: 46040 - DNA, 823 bp, Oryza sativa
atatatatatatatatgttacttcgcatttatcctaatacatttttttgtatcttgcagaaaagacgtgttgtcggagtcgtccgtcaagcctgagtggaagagctagccctataaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcatgtaaggttgtgtagggttctaatgtacgacatttacacttagcatacatgacttagattgttaaaacataaatgtctcatgacttagcagatgtttcttgtatcaacaga

SEQ ID NO: 46041 - DNA, 1501 bp, Oryza sativa
gcacttggttgagttcagaccgaattcgtggtcctccgctcccttgcccagtttggtggcggggagatcggcgttgagcgattgggggatccgacttcatcaaagcaaattcctgggtgtaatatccttcattgttaactaattcaacaagaaaataagatcatattttgagaaaggttgaagtgtatgaatacgtaccggtggaggaggattgaatgcattgaacggtacgactggcagcaagtgtgagtagctgacaacgatggcgtttgagaagatcttatacatcctttccttcatgaccttgaagtcaagagaatctggatcttcacggtttgggtcatgcttgccgtcaaattcgaaggctgtgcgagatctttctttgattggagctaactgacacttgataaagtgccgggtgatctgttctccttgaaggccctgttctttcagctttatcattctctccatcagttctactgcttgtgcagcttcatctcccattggcagtgagttccaagtatcccgataaactggaggaaggcaggagtactcgggaagaacaggctcggggttttgaacataaaaccaatttgcgtgccagcctttatttgaggtcttgaagggcatggagaagtatttttggcttagtgttcccctgagttggaaaccagcacccccaacgacgcatggtttgctcttatttagctggggcttgaggaagaagatgcggcggaacaaggcgaaatgaggcctaatgcccagaaaagcttcgcaggcatgaataaaattggcaatatgcactatagagtttggattcagatgatgcaagctaatcccgtagaagttcagaattccccggaaaaatcttgaggttggaagagaaaatccgccatagaagaaatgagcaaataccacgatttcgtgtgtatcgggggtcgggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaactggatggtctgatttagttcgagatacggctggaaagggatggggaatcggagcggtggatgcgaggagaaatttcgtgaagtttttgagggtggattggagcggattgatgaaccctagtttgcccggcgcagttttgcactgtagcaggaaatggggaaagtggcgagagtctcggcggggaagacgaagagacgtttttcacttcggtattattggggtatcgggagtactaatgggcctgggcctgtacagtacttcagcccaatactataatcagcgtggcctgttgtgatccctagggacttagtcaatttttgctttggcaatttgtgttcacaatggtgtggcccaatgctgttaaaatcctttttaacgcgattcaataattctttggaattattatga

SEQ ID NO: 46042 - DNA, 1501 bp, Oryza sativa; identical to SEQ ID NO: 23017

SEQ ID NO: 46043 - DNA, 1501 bp, Oryza sativa
ctacacatgtctaattcttattgggctaagatatcacaagacatgtgctcgggtgtctatgtacaaggaagaaaaaacatgcatatcaatccattattatacggtaagtagtacatactagtacttgtggagcaattattatacggtaagtacataccagtgcttgccgagggatgccaatcacatcttaatatggtacctggatatatgggatatataatccaagtcaaaagtgaagttatgtgaacagctttatgatggaaaacgatggaaaacaactttcatgttcggtttagtgagcacttttttggttcagaataagtccttccctttcatgtgaattccccagcggccaattaacaactcgtggggccctatctattcattctctctggccccaagacgaccccctgtcccttggactcaagcacatcgctatgagtggaacgtagaccataacataatttacagatctaagatatgatcgggcaagtaaagaggttttaatatagtgctcgaaagatggttatgaatcgattgactaacccaattttatgtttagattcataactaggacttttttttactgagggagcatatacagtctgttctaagtcaaaatgtatattttatccatcaattagatttaatagatctcatatctcaaacattctctatcgcaaacttttaactagtgtaattatggatagtttaattaactcaagatttcactcaaatggccatcgtcacatctatacctgctatatagttacagcccactaaagctaaagcttaacgtgtaaacatgtcatctcatcgtccattactaataattgcgtactaagctccaacaaacattgcagcatcatctacaattcattaaattatgcaaataaaagtgcaagtatatccaaccatcaccattcacattattttcataatattttcaacatacatatccaacatttttataatacttaacatatatattcatccatgtaatagaagcgtgggatatcatatttcatccagaatctgctacagagtctataaagtttatttctctccttacatagtttagcaaacctgttttatctgttgttaatatctaatatttttttttacacttagctcgattattgaaaaaacatattaaaaattacccccttagtaatttccgaagcaaagcgcggggaatttcctagtatctatatcatccagtaccttattatctctgtctctctcgtctcatacttattcgcttgtttctataggctgtctctctcgtctcatacttattcgcttgtttctataggcccgttagaacgttgaaaattcatatggtcccctcatctcctaattataggaggttgttgggcatactcttatcccttctttatatgcggctcccaagagtattgaaaattcgtcgaacacggtacaatcatacgtaccatatttgtcctgacagtcacttgaattcattttatatgagagctga

SEQ ID NO: 46044 - DNA, 1501 bp, Oryza sativa
tatataatgagaaaaatgatgaggccgtgggtggttgaatcaacagaaacttgcatcttgtgctgcttgtgtgtgtctacctgagaagcctttgtggcaaaaatacggtagagagagagagagagaggaagtgatttcccaccagagagacaaaagtgtttgtgattaacacttgtagctgtgagtgagcaatcccaacacaagggagggggagagaagcgatggaggccatcacagaggtactcctcatcgagctccactggatccgaagcccgcttcccacgctaccacgctgtactggagatggagggtaagaggggacgggggagaggataattaagcgagagttttgccactcccatcacccggcccattattttatattttgttgcgattttcgtaggcggttatgttaaaagcaccacatcttaaaaatagacctgcatgtgaaaaatcatactccctccgttttatattagaagtcgtttgactttttttagtcaaacttttaaaattttgaccaaatttatagcaaaatatggtaacatttcaatataaaacaaatattgcatcaaaatatattcaatgttaaatttaatgaaacttatctaatatagatgttgctaattccttttttctttaaacaagcacaatgcctgtgtgttgcactgggtaatgtaaggtggataaagtttaacttcaatgatttaggatatggtatgaccactatccgtccgaatccgctccattttcacccctacgggagggactcgcacacaaccagaaatgccacccttaaaaacgcctctctatgtttcattgttaaatattattaccactcccacacatcatgcttgtgtatagtatctctttagcatcattgacttaacatatgtaaaacatttattttattaaaaatgctataatatcatttattttattatttgttttattgtgattaattttatcatttaagacttctatttttgcataattgtataagatttttaaatacgataaatggttaaaacgcatataaaaattgacggcgtcaaaagaaccaatagagtagtactaactaaagcgaagtttttcttttcgaaaatgacaagaaaggagtaaaaaaattatatgcaaggattgaccctgtttgagagagcttctagctgctgcagtttcttccagaatcagaagctcccccaaacagttcagcttttggtctagattttgagaagctgtaattgtataaaccagaaaataaactagggccatgtttagttccaaagtttttcttcaaactttcaacttttccatcacatcaaaactttcttacacacacaaacttccaacttttccatcacattgttacaatttcatccaaactttcaattttagtgtgaactaaacacagcctagaagctataagctgggaaacccagcttttccagattctcataagctggctaccgaccagctacttcgcagaatcttaagctcccca

SEQ ID NO: 46045 - DNA, 1501 bp, Oryza sativa
ccctacctcccatcagcattgccatccctaccgccaaccgccggatgcaccatcgctgcccacccaaccaccggatccattgccgccaagctctccaccgtcctccccaccaccggatccgccgctccctgctcctgtatgccgccggatccctctggtgctggccactcccgctcgtccgcccacttgccaccatcgttgtcgtcgtagccatcgccactatcatcgtggccgcggtggaggaagggggaggggggaggggatggccgcttgaggagggggcgagaagatatgaggagaagataagggagtggagtggagtgtggagaagttaggaaatgagatattttaagaggagagaataaagagagggaggggacgggtaaacggcttggtgccaggcgggcctattaagaagcctgcctacgaaaattgttttttcgcatgtggtctttgaaccacgctctcggggcagcgatttttgcaggcgggagcagtttaatttgccagcaacctcaaggggtctcatccgaaaaaatcgtttctatagtagcggtaattaatttagaaatatcttaatgtaaaatgtagtttgtgcgctgctgcctttaattgtccatgagaagacgcgttccaggcacgaacgtgaccggaacacacgacgctcacgctgcaaacatgcagacgtgctcatgcaaaaaatcgaaaatagacgagctacagtacagtacaatacatcacaggacgctggttacaactttaagcaagaacacatgaaatgaaaaggcataggcatgcaggagaggcgcgcgcgttctagctgtacgtagtgtgtcaggctgctagctagtgctgcaggtagacgtggatctcgacgacgccgccggcggcgaggctgtagtcgtagctgctgctggccatgtacccgcgcgcgagccggaaccggccggtgccgccgacgaccaccgactcgcgcacgccgacgccgacgtcgatccggcccttgatcgccaccgagctgccgcggtgctcgccggcctccatcaccaggtgcatgctcaggtccgtcaccaacccgccctccgacacccgcaccccgaacccctgcgccgtgcccacgcgcgcgctgccggcgtccggcccctccgtcagcgcgttgttcagcaccacgatgtccccgaactgccgcggcggcgacgagccgtcgacgatgtcggtggtggactgcagcaaggagcggccggagacgacgcgcatggcggtgggagccgggccggtgtaggcgtcgtgcatgtagaagtggaggtgggtggtggtggtggtggtggcgacggcgctgtcatggcggcgaaggaggacggcggccgcgatgaggaaggagcagccgaggaggagggaaggagacagggaggatgacgccgccatgatcgacgttatcgagcttgctttgtgtgtggttgctactggcaggcagccctcatatatacacacactatgtacg

SEQ ID NO: 46046 - DNA, 1501 bp, Oryza sativa
ggtaattaatttagaaatatcttaatgtaaaatgtagtttgtgcgctgctgcctttaattgtccatgagaagacgcgttccaggcacgaacgtgaccggaacacacgacgctcacgctgcaaacatgcagacgtgctcatgcaaaaaatcgaaaatagacgagctacagtacagtacaatacatcacaggacgctggttacaactttaagcaagaacacatgaaatgaaaaggcataggcatgcaggagaggcgcgcgcgttctagctgtacgtagtgtgtcaggctgctagctagtgctgcaggtagacgtggatctcgacgacgccgccggcggcgaggctgtagtcgtagctgctgctggccatgtacccgcgcgcgagccggaaccggccggtgccgccgacgaccaccgactcgcgcacgccgacgccgacgtcgatccggcccttgatcgccaccgagctgccgcggtgctcgccggcctccatcaccaggtgcatgctcaggtccgtcaccaacccgccctccgacacccgcaccccgaacccctgcgccgtgcccacgcgcgcgctgccggcgtccggcccctccgtcagcgcgttgttcagcaccacgatgtccccgaactgccgcggcggcgacgagccgtcgacgatgtcggtggtggactgcagcaaggagcggccggagacgacgcgcatggcggtgggagccgggccggtgtaggcgtcgtgcatgtagaagtggaggtgggtggtggtggtggtggtggcgacggcgctgtcatggcggcgaaggaggacggcggccgcgatgaggaaggagcagccgaggaggagggaaggagacagggaggatgacgccgccatgatcgacgttatcgagcttgctttgtgtgtggttgctactggcaggcagccctcatatatacacacactatgtacgtactggtttatgatttgttagaatctagttttaaacttaaccaaattgatatttttttctccttgttttaaacgtgggtttatttattaagatactgactagaccacctttcttttgtttcgctttgttccagttgctttcgatccagtactacctccgtttcatttcaggttataaaactttctagcattgcccatatttatatagatgttaatgaatctagacacatatatatgtatgtgtagattcattaacacacacacacacacatatatatatatatatatatatatatatatatatatatatatatatatatatatatatatatatatggataatagtagaatatcttataatattaaacagaggaagtattagctaagtgcaaggaaatatagggtctgtttggggagcttaagattctgcgaagtagctggtcggtagccagcttatgagaatctggaaaagctgggtttcccagcttatagcttctaggctgtgtttagttcacactaaaattgaaagtttggatgaaattgtaacaatgtgat

SEQ ID NO: 46047 - DNA, 321 bp, Oryza sativa
atcaattcagcgcgctgttttgcatcaaagttcactctctctgaagttgggaggggcaaaagatcaattggagtatggggcagaaggccataaacaatctcaaaagggcacttcttagtagtagaatgttgtgaacgattataagaaaactcaacatgaggcaaacattcttcccacattttaatattctttttcaaaacagccctaagcattgtagataatgttctagtcacaacctcggtttgtctatcagtttgggggcgacatgtagtagaaaataaaagtttagttcccaacttagcccacaaggttctccaaaaa

SEQ ID NO: 46048 - DNA, 1501 bp, Oryza sativa
gcttgggccgatctgggccgtccatcccgtggacgggcggtggaccgcccttgtggtcccggtccatggtggaccgagcccccttgagccactgatgcctgggacccgcctgtcggcgccggccccctctcttgctaacgtcagcggcagtccttttcctttgtgaaaatatttaataattgcgcaataatttggtaataattatagatattaatttaatggctcaaaaccttctaaaattcatatctaattcattcgaactccgaattgagccattcaacttgcaaaattcatctaaaattgagctctacatgtttgtttactttttatataccgttttcttggtttttattagagtttttccttgttttgcgtgccagcgtgtagttctcgtcgtttcggaagtccgcggtcacgaggaaaagagttcggaagatcaaagtgaagaagcaaggcaagtcacacattcccctttagcatgttgatcccaatttacaaatgttttactatttgcaaataaatatgcgtgttttgctaattacatgggatcagggtttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattacaatattagaccttttagtatcagaatgagctgcgtgctcgagacatctggccatgcttcatggtcataattatccaactaaaatgcgactgaagggtgggctgtgggtgcatggttttgctagtcgcacccatggcaattaaggaccggttcacgggaaaccctggaagaatttctcgtacttaccacaagccagcgtgggcaacggctgggcttgtagtgtagctttcctctagccgacgcatccaggcaagggtgggtgtgatggagcggggcgggccctgcgacggcctctgtcgcttccggattcacctaggcacgagaggggattgcccgctgccttgcgaggagtgggggtgaaacctgaggtgtggtgtgcttggctagagagggttatgcgaaggatcctgtcacgacctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaatgaatcgactcaatgcactgtagttcaggtgggttggttgggcctgttcatcgtggtgtagcgttgatcagtggagatttaatattaccttaattactcaacagttttagtattttgctcaataaaatgttttacaactgccttatgcaaatatgcacaaaaccgtcttgttgtcccttgcacgtctgcatcgttggtgtggtttgctg

SEQ ID NO: 46049 - DNA, 1501 bp, Oryza sativa
aacttcgacgacatgatcaaccgatttgcaaattaaacccaacttgtaaccgtaccgttgttaagtgctctagttgcagagaaataattgaccgtgcccacgtttacgtggcctcgtcgccgtgattaatttgctcatttgtactttgaaattttcagcttggaatgcagtactacgtctttcacattattgaattatgtttccagagaaaaattttggctgtcacccaccctggttggtttcaagaacccatgcatgcatcctcacatcaaacaaacgatttaatttgccaaataaaaaataggatttgctaaaaagattttgtataactatgtataactttcacataattttggaatgttagatttgttccgagattcgtccaagcaaggaaggaaaaaaattcatagcatagacatacaaatgaggggattcaatcccacggcctcccttgaagtgtctctaaaagctatatgtacaaattatattgtttgtagttatgtaattacactaaattataataaatttatatttaagaaaaaaatattgatagatatatagatagtccacaaacaaataacacctaattaaaaaaaaattaccgatgtacaagtgtgacaattactctatctgcttttaaatgtatggtgctatatatatgattttttgaacatgatatttgatatttgtgttatttaaaaaatattagtgtaaatatataaaatataagttatgattaaaaacgtttaatatgataaaataaggcaacaaagtaaatgacatttacgtatttttttaataagatggatgatctttaaaaaaaatagcgaagttagtataattaaattaagctggattacaaagatctttgaactaagattgcataacaagatgataattaattaactggtttccgcatcaattatatcccaaccaactctcgctagcgctgattttgtgatgtgatgtctctcttgtctccatttggcatgttctcatccggccatccctaatgtttcgggtgacaattacagcgttaatttgaaacctaccccccatggaaatatcacacatagtcatatcgactctaataatagtagacaacttaaaacttcatttcttaatttcgaaaaccatgtgattaacataacataatcctctggattaataaatcttccaacttgtaagatagctatagagtcatatattgacttccatgaaacagccacggcgagaccctccgaaacgttcctttccgacgcggcggcgaccgtctccctccacgcgtcaggcggccgcgctgccggccgctgccgccccggtctcctctcccgccataatttaaaccccaaggagacgaaatcccggtcctacccctgctcgagtaggcatgactactcggagctcgagggggcagttcagtctttgcgcgtcacctcgcctccacgaccctcgagacaaaaccttcccatgggtttgtgtgtgaagtgctcgtcagaca

SEQ ID NO: 46050 - DNA, 190 bp, Oryza sativa
gtgtataaaaaacttttggggtgacgggcaaatttgaagtggaaagaaaaaattgctaactagatccggccttgagtggaaagcagaatactgggtctatcccggctgggctcgggagcctggaccggtgctaccttaactggaccgtattctttagcagacctgagccggagaaatgggcttaagaagg

SEQ ID NO: 46051 - DNA, 848 bp, Oryza sativa
gacatcgccaccactcactcactcactcacgcactaccaccaccaccaccaccacaacaacaacaacaacaaaaagaacgagtcgaagactaccacgccacgagcaagatgagagcaagaacaaagcggagccaagaaaagagcaggcaagagctttttctccctcgcggcggtggtgatggtggtggtggggaattggagcggattgcgacctgaggggggcgagaactactactaccaccaccacccacaccgtccccagtggagtctactggcgacgcgacgtgggggagaagaagaagagagagagaggagggaataaaagcgcggggaatcgagcgggtcgaagggaggacgagccggggaggggaagaagaacacggcgagaatttctattatttttttgaaatttcttttattttaaaagcaagcatttctaaaaacttatttttaaaatgtggatcttttaatcatgtggttgaatggctaaataatactccctccggttttatagttcttgatgttttagataagattgtagtcaaatttttataactttcaatatcaatgactttaaaattatttaatttaaaagaatcaaaattatatatatatatatatatatatatattcgtctttcaaagttatataataaaaataagaatgcatttatttgttgtatatattatacagtaatagaaaacacaaagtcaaaatatatttcgaaaaccgtgtctttaatttggttgtactgcgttctgctacattaatttggttggcgtggcagaaacggatattgaaaagtattggaaaggtttatttttaaaattattaaaacgttcaaaaga

SEQ ID NO: 46052 - DNA, 1501 bp, Oryza sativa
  unsure (1)..(1501): unsure at all n locations
accaatacgctaactactaaaaaaattcatccagtatgtgaagcttctaaatttttccacaaacacactccaaaatcctattctataactaagtcccaagaaaacctaaaataccaagaaaaatactaagaaagagaatagattaatgcatctagaaatgaatcataacagattgctagaagtgattcgctattgattgttcagagggcaacgagtatgaaatatagctaaccaacctggtcctctgtgttttcagatgtcatggcatggtcacagcaagcagaacaaccagctatggtggaggattgatcagagtcgtttatatgatcctcaagcacaacactggaatgaaaaggtgccacatgtatagaaatacaaatctgaaatattaagtaaccatggggaaaaaatggctcactcattggggaagcatgatatattgcagattccttcaaccaaaaaagccgaaaccaccaaatacaaaacaaattttgagacattacccaaatgcattggctctgaagtgaaatgataggcatgttactgcagatttattcgcggcaaaagagtttcaacttttcaatcacccctcacaaacccactccaaaaccctattctataactaagccccaagaaaacctaaaatacccaagtaagtactaagaaagagaatagattaatgcatctggaaatgaatcataacagatngctagaagtgattctctatcgatngttccagagggcaccgagtatgaaatatgctaaccaacctggtcctctgtgttttcggatgtcgtggcatggtcacagcaagcagagcaaccagcttaggtggaggattgatcagagtcatttatatgatcctcaggcacaacactggaatgaaaagcccagtcaaaaaaacactagaatgaaaaggtgccacatgtatagaaatacatatctgaaatagtaagttatcatggggaaaaaatggctcactcattgggtaattgcagatttttgatgggatgtctccatctctaaagcagcttctagtattagtgcaagactgcttcactatggaagacatataatcctttgaataagcattgtagtccctttctttacttggcactgcatgagacaccttgatgtgagtttatggaaattgttcacaatttttttataaaaaaagaaatctctaaatgctatacaaatgggagaacctatggcaatgagcatagtgttgatattaggttccaatgttgtgattgcaatgtcccatttttcgaactttcttctagagttcacctagaaaaaaagatctgatcagtacttcaatcccagctgatgagttcttttagatggaatggatgcaggttctgtagaacatcataaacatggcaagattagggtctctcaaaatttcatcaccaacagtggcattagagcacctggtaaattggtataatagttaggttgctccattgcattaataaaaaaatgaaaatcactgtca

SEQ ID NO: 46053 - DNA, 1501 bp, Oryza sativa
  unsure (1)..(1501): unsure at all n locations
cttctctgcgtcctctatccatttctgtgagtggaaagcccatttgaagatgttttctggtagtttttggcccactcttggtatggataggaattattcttcactcaagtctatttttggtccaactttggtggtttattacctgcatacaaatatacaccaacactcgtggaatatgtcagaatttaaccctatcactatgttggatgttttatttccttgatttatgcaggtattggtggcataaagtctgtcattaacaacagccaacagcctcatagttaaaatcctccattctcgcattagcaagttgcttttggtgcaaagttaactggcgggtatattgtcttgtgctaacccctgctcgagttcgctttgtattcttgcctttgtgcagtcatgaggagacggctctcccacttgctcaagggatccggctcccgatccaaccagtcgagcgatcgggcatctgccgacgtgtcaatggagaacactgacgctgtaccacagctcctgaccgacaacgacctcgatatcgttgacagacgagagaaacaagcctaccagatgctgaaggaccgatcattcgctcacaaccgagcgtacgatccaaagctactccggaaaacaagtatggatgtagattttagtgtcatttggagaaccatgggttggcacgcctttgcaacggtagacgagcttggctcttgtctactaactatacagtttctgtgcacacttaggctcttgtctactaactatacagtttctctgcacacttagagaagcagagggtggtgttactttttgacttttccgtaaagagtttaatcttttatgtagtggattgagcacacttctcggtttccccgaatcctgtagagtcgatttttggaaggcaacttccggttttgagaaaaacatattctgtgaagatatttctggtgcaccgatttataagaaacccagaaccaatgacatccataatctaactcttaggcttatgtacaaatggattgccatgtctctgataatgaattgattattctatatgccatggttcattagaaactattaagtgtggcggaaggggcggacgctgggcgtgtccacgtcggattttgctacagtagctacagtgcgaggttggatttttgcgaaaaagccctccggttcttcgtaatcaggtataggcccctcgcgtcctgtgtttgaagagaaaaaatcgcggacaggggcttcgttgtgatatgtggaagacgaggggctttttcgaaaaaatactcccactagcgcagacccctcaaaccctagccgcttgctctccctctctcgcgccgctaccaagcactggcgcttcgccttcccctcacgccgttcccgtcgcctcgcgccggcgacttcacccccgtcgncgactgcccatcgagctggcaccttcgactcccgcgtccccatcgccggccgagctgccgccgtccgtctcccctccgccctctct

SEQ ID NO: 46054 - DNA, 708 bp, Oryza sativa
tgaaatgctacctcacagtgttacatgattatgatgttctttcttctttcttttccttttggcatgataaaatgaaaacaggatagaagttggtttaattatgaaaaggccatggattttctacagcattatctgtggtgacttatttgctactcttcatgcactcaatgctaaccaaatgcatgaatagaatgagaaaatagtcccaggtatcgggaaactgtatcagacacatgcccattcattctaacaacatttcagtttgattctcaaaattcttcatgccatcaaagtaaatactatctgcactgtctcaaatcaactacaaagctgtcaataaaaaaacgacaaagaaagggaagaaatggtgaagatagagcttactacttattttaagcacatgtcttgattctcttgagggctcaatcacggacccctttggtaatttgtattcatccttgaaaagtgaaatgaaactgtggagaccaaggtgtcaaagacagaagaaacttgtgtagttatcattttaactcgacaaaggtatgctaagattggaacttacgcattaacaaaaaaaagtggaacaacattatttactaaatagagtgacaaacctgaaactataatatgatttatttttctcagctgatgattagttctgaatcagtattgctcttcttcacaaatgacctctctctctctctcagc

SEQ ID NO: 46055 - DNA, 862 bp, Oryza sativa
tggtcctggacaggggtttaatacacattcagcttaaaaattctggttcgcgaatttctgggcgtgacaagttggtatcagagccgaccttgcccgtagcacaagccaactggaaacctaagagccctctgaacccctttttttttcatatgcatatgcccttttgcgcttggatttgtttcaggaaaatttggggttttgcctctttggcttgtgggaaaaatcttggtcgttcattcggatcggttttttttagctcagtgtagggttttagaaaaaaaaatctatttggggtttattcgacggtcagtcgggaatttgtcaggtgatatgcactaagtcgtgtctaggttgatgggggcaatttcatgcgtatcattatagctatgcatttattttatgcattaatttattgattagccagtgcatcagtatcctcatttgagttcatgaaaaatgttctatgcataaaaatcatcatgctcgagtatttatttgagtcatttgttgctttgtttaatttggatttgagcatgaattggttcctatcccttgtctactttagatgtcagtcctattcctcgatcgcaagcgccgctccgagcttcagagtcgccgcccttagctttattgccttcttagtctgtttgcttgctagttttctgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctatccccttcaga

SEQ ID NO: 46056 - DNA, 603 bp, Oryza sativa
acttgtttatattttggaatcgatgcactagatggtcattttagatatattgtatacatagttagagtagcaagtatgctgtgtgtactttatctagaaaacgtaaataattcttctatatcaagacttcaacggagaacacacagctgtcgtaatatctagcgaagcaaccattgaaaaccttactaggaaagtaattaactactacccccatctctaaataagtacatttttagcatgtgaagcacaaattaatagggaatataaataaataactatgcctccaaataaaataggaaaatgctatacatactaattttttcttactaaattcttactaatagtactgatgtatcatgctataagtacatctagatcttttataactttcatctacctaaatcaaatgattgagatgattgttagtaaaaacttagtacgtgtaacagagctcaattaaataagagatggttgaaagtgctgaaagtgtagagatggttgggggtaagatgtgtagaaattttaaataagaaacgatttatgaaacatgtactagcaccttagaagtacacttattttgagaaaaaaaaactagagccatag

SEQ ID NO: 46057 - DNA, 1501 bp, Oryza sativa
cagtgtatcctgagcagcccaatcatgctgtaataaccgagcatcttgagcacattgctgccaccctggtagtcgtagccgtcggtggcagtgaactgctcgagcccttccttctccctctccagaatctgcgcgatcatggacttctccaccagcgcttgcaggtaattgagaaccccgtacacattccacgcctgcagcaattcagcaaaccacattagattgtacaccacggataagaacaaatcagaaaatcatattagattgtaccccacagctaagaacaattcagcaaaccggattgccgattatattatgcgccgcagataagaaagaaactgaattacatattagattaggctgcagctaagaaagaatagtagtaataatgcataatcaagaagcattggtggtgagctgggtgtgtcaccttgtcgaactgcttgagctggtggagctcgtcgtcggacttgttcttgagcttggcgcggtactggcagaagctctggaactggtagacgaactcgtcgaccatgtcccagagccactggttggggagctgcatgttgacgacgccgtggaggacgacgctgaagaggtcgcagtagttcgcccacgactcggcgcgctggccggcggtgagcggcgcggacgacgacgacgacgaggaggcccgcgcgtaggcgtggcggtaccagagctcccggtagaggaggaggaagacgtggtcgccgtcgcagtagggcgagacggcctccgccgccggccacggcgcgtcgcggaagaggcggtcggagagccgctggaacccgccctcgtacatctggtggatctcgtacacgttcttgtccctgacgtgcctgtacatgtgcgccacgaacgtcttcaccgagtccggcacgtagctcgggtcgtacaccgccccacctccgccgccgccaccctccgccgccgccgccgccattgctagggtttcgcgcttccggcggcgcgtgcggagggaggaagacgaagacgcctccccgctccaggttttcgtttttaatgggcctcagtgtttcggcccacgtagagtatgggccaaaatgggcctggtagtggaggcccacgttgagggaaaagtgacagttatgatgtgggggacagctcagatccatccgacaagccgccacctaccaaacgaactcgttaactttcctaaaaaaaataaaaaaaatgatttatttattcatttttattttttttgggagagctaatttggcggggagaaatttccaagaaaagaaaataggaggaaatcgttagacaaggcgggtgggggggcatcgcatctggaggtggaggccaatccgctcgctcgctcgctcgccggcgacccgaatccggccaggagggggggcggctggccggagctagggtgggtgggtggttggccgcaccaccttcctccgcgccgccggagcgtgggcagcggcggcggccggtgggaggaggggaagca

SEQ ID NO: 46058 - DNA, 1501 bp, Oryza sativa
tctgataatggtataagtttacctggctattagaaattcttcaagtttatgcctgttatactcaaatcctacacctagattttcattttcagctataaaatgttgaagctaaaccatagcttccaaaaggcaacaggatccatgggctgttcaaactgttatatttaattttaattcattcctgtttaatgtgtcacatattcataatccgcatttatgcatggtgaaggtgaagatttctccaggcttttcaccagaaaagtcgggtagataagcagtagttgaaatttcgagtccaccgtttgcgaaaagccaggtcgataattatgcttttgtggagtgtaatagctagatttcagcatggtatggtgctaaacttcaagtcttcaactttggaggtttggactgtgccatagctgaaagcatgtagccagccagtcatggtcccagtaaaatgtggtgccatggcctgaatgtagggctgaaaactttccggattccggacctattttcaaaaacggaatctgttagtcggaattttttcgaaatttttcagaaacagaaacgaattcggaaatattttctcagaaacggaatcgaaaatgataaagggcagtttccgtcggaactcggaatcggtcggaaactttctggaaattttcttggaattcggattttttttcagaatttctagaaattttgtaacttaaatactctaggtttatttttttaagcacttaatagtgaataccatggtgttttcctgttattttttttttaaaaaatattttttatgcaaatataaaattacataagaatatttttttcctgcattcagatttatcaactgcgttactctctaaaacatagataatttattacatagattgtgttttgtgatgtattgttaatacttaacaattggacttatatgattgtgtttcatgatgaatcgttgaccgttgagacttgagaattgaatttatcagtttgagggtttttttatccgataaattttcgttaccgtatttgtgccggttcgttttcgctccattttcggtttcgataatattcgattccgttttcgtatccggagttaccgatttcgattccgaaaaaaaaatatgaaaacgaaaacgataaagatggtttccgtaccgttttcacccctacctgaatgtggatgtgagcaaggttctttgacgttaattttggggttcgtatgctggaacagatctgtgcagagcatcttcaagacagacaacattgtaacgcagccagctgcagcgaccttatgcttcctttggaatttgaaggatgtttggatgatttttataagaattgaactaatcccccgtgctccaaagatgccttagcgtttttttccccttatcgggtcacgttaaaaaaacagaagtaatgtcgcaaaatattttcttaccatttacccaatttcacgagcaattggatcacaaggactatatcgaacagctagaagaga

SEQ ID NO: 46059 - DNA, 1501 bp, Oryza sativa
tcaaaaattgccgaagcgggacacaaaggcggccgacgtggaaacggacggcccagatcgcgcggatcccacgcgggccatctccccgccgtccatttcacacccccgcgccccctcgcgtccccgtcctttttgcagaaaccaccctggaaaaatcgccaaatagccatccactcctcttctcatcttcccctctcttccgaaattccgccgcgcgccgccgatgcgcgtcgcggccgccgccggcgaagcccccctcctcctatgcgcgccgccgccgccttcttccatcgacctccccgcaggcgcctccctccgttctcccacctccgcaaatcgcgccgtcatcgctcgggccgggcggcgtccgcagcagcagccgccgcggtggttgagttgagggcgtctggtaaggatttcgggccacccagatccaggcaggcagcggcagcagcagaagccgcggaagggacgcgctcccggcggacgaggcggcggcacggcagaggcgtctcgcgtccaggctcgcccgtcagcaaggcgattggtgatctggtatatatctctccatctctctgcttgattaattgttgctttgggatgttgcttcgttggtgattgggttgaagtgttgtgctgatttgagtttgaatatggaggaggtgctatgctatacgatataaaccgacttacgagcccagataattcgtatcactaagatctgtgttatatattttttgtctggtaaattccacagcgaaagtcagacgcttttagcaccaaataaacctgaaacccagacagaggaggtccatatttttagattatggataaaccaggagataattcacattttgcagaaaatacaatcctcaaatctaaaaggagaaaaaacattttactaccctaaaactattttatatattgcagaaagcttaaggtttactccccctaaatgtgaaattagctacttcagtagttcggacttcggagggtagaatgagctaataagtagatttgcagaatagtttacggaagcaaagaggagtttttccccatttgcaagttatccacttgactgcatatcaatcaaccatctacatatacatcagggtgaatgatgcattttttagttttcataaagatgtacaacgagggggtgtagacacattatcaccccaactctttttttagataaaatattatacaatccatctctataataaaacgaaaatgacatgaattctaccccaactcctttgaaatgagaattcatgttcttatgagggtagtcaatgtcctgtcctctatgcatccctgaatgcttctattgttacatcttgtgacaatatcttcattcgtccaattcttttgcagcttatgattgcttctcccttggagcaactccctgaaggcctcactgaggcttgacagtataatgatttttatatcccttggaggtttctactgcaaagtgaggattgattgtcttcactcatga

SEQ ID NO: 46060 - DNA, 217 bp, Oryza sativa
gtaactacaaagaaataaaatttcgcccatatgattatgtgttttcaaactaaatagttcgagatgtattgataatcaaagttttaaaactttcacggaataatgttgactgtcagagagagtattaattgtggagctcctagttaattgaacagtaaaaaatgtttttaagactgggaatattgttagataataataatctgaaacgtcataacaa

SEQ ID NO: 46061 - DNA, 1367 bp, Oryza sativa
tagttaaaatatctccgtagtatgaggctacacatctgaacatttctctctcatgatgccgactttaagtgatagcttcaatttttcatatcgactcctcacatttctattctagtcctcactttttttttgtttttttacaaattaatataatacttagactctcctcacttgttcactcccttacttattccctttaaccaccgcttgtccccttcttcggccattcctgccacctctcacatctttggtgacgaccttcattgtcactgcctctccctcttagatgacgatgatgaattggtagtggtatagattagacaagggcttggtggtagcgtagatcgggtgatgagaacagactcagtggttgatctaattaaagcgttgacaacgactgatcggaaacaacaatgtgggctaaatgctcctcggtggcgtgggttgagcaatccttaagcagcgaaaatcgagatagtgtggaccaatgagctctgtgatgagatggataggtgccaactcagactgtgcaagctctatgttgatccaacaacacaatcaatattatagtcttggtttgtaccctcttggtatgttcctcctagtttacatccctactccctataacccctctatggactcctaattggctgccccttctatggtcgccgcaatctctccccacaccacccgatgttattgggatttgccttcgatgagctccgtgcaacatggattgaaggtgtcgacaagctcctaccttttcccaaccgcttgtaaccacatgtatgtaggagggtgggcacaacctcgcccaatgtggctcatgagccatggcatcaagcacaagtggccttgcattgacgaggcaattgtgctctctattggacacgagaagcctcctgagagcacgggtttggttgagccgttgtcgtggctccaaaatgaagagcctcgcacaaacccacaatgtgaatggcctagtgttgggaagcaatgtcacaatgagaaaaaggtgcaaatcatacatgcctcctttgaattgatttagagaaatttgatgatttgtcaagtacgcaagattgccattttgatgatattatcactcctgtgacaatgacatatggaaaaataactcacatgtcgaggaaaagtacagtagttacgaaaaagataacactatctacgaaaaaaagcaactcagtgaagcgtgtatagccgcaaattaaaaatctccaatttgaattgaagttgtactgtgacgggaaaactgttgcacatcaaggaaaaggttaaattactattttcacaagaagtgagctgattcgtgttaaatattttttttgaggtgaaaagtaggaattttg

SEQ ID NO: 46062 - DNA, 304 bp, Oryza sativa
ccaggagctaagcaaattattaccagttatagcatcaataattactgtgagaggtgtgagactaatcacgaaaaacattgttcaacctgcccatgatcgcgggcacggctattcgaatagttttactctggccagaggtgtatcaccactgtacccacaagacacagctccacgacatgtcaccatgcgcctcaataccaccacggtaccttggaaaggaactgtgacagtacccctcgcacaacacaactcaccacagtgcaccattcctggatcataatcaccccctctacaaccagaggca

SEQ ID NO: 46063 - DNA, 779 bp, Oryza sativa
tctcaccaaaatcctttatttttagagacgggggatcgagggagtataagccaatagaaggaaatatgatagtccatagactcgctgagttggggtccttgtgcttggcagattctgaacagtgctcgtctctataccatcatgtattacatacttggttgtggaggacacctcggctaatggattgttgaggatatctcggctaatggggaaaatatgcgatggaaacaacatatgcagtggaaacctgaaaactaccgtcggatcgaaaaatggacgtctgagattcttccacgttatcccgactaaaaattttactcgcagatatactcatgtagtaatttttttatcatgcgtctattttttatctaacaatcgttttcaggtttccactgtatattttcccaagctaatgagtaatgaaagttagggtttgattaaaaaaataaacaaataaatctcattaaccgaaaattgcaacatactccctccgtcttaaaatataaacatttttggttataaatctggagaactatgtgtctatatttatatatagataaaaattgatatattttgggacaaatgtagtatgtaaataccgcgatgggtctatgtgcgtgctacgtgtgcaacttgtctctctagaactgaaaactgctaaatcgaaacaagctggggctactgggctttacacctcaggaatgaatcgaactgtcgtggccccataggcccatagcacccatgggccggggccttcacttcattttctctaccatagt

SEQ ID NO: 46064 - DNA, 1501 bp, Oryza sativa
attagaagagaagtgcatcatgaagataagctcatttttgggtctcttctctcagttacccaatagtttgtttcgccatccaaattcacgggatctccaatcacaatggacaggtttccaccattgtgcaactctaagtgggtcttaagcctatctccctcgatgcacagtctatcacattacgtggtagcccctttgtaaactgatctggcaaatttttagccatctggacatagtccaatgctatcactccggagtttttctgctttctgacagacttcagtcttcttttaacatgcctggatgacttcatgttgtcctttgaactgttcactttaataatcactgtttgattatcacagttcatcaggattgctggtactagtttttcaaccaccggcaagtccatcaggagctcacgaagccatttggcctcaactgtggcagtatctaaagatgcgagttctgcttccattgttgacctcgttaagatggtctgcttgcaagacttccaggaaacggcgccccttccaagtgtgaacacatacccacttgtggcctttatctaatcagcatcagatatccagtttgaattactatagccctccagtacttttgggtacccagcgtagtgaactccaaagctcattgtcccttttagatagcacattactctttcaagagcatgccaatgatcatctcccggatttgaaacaaaccggctcaacttgctcacagcaaatgagatgcaggcctcgttgcactagctaagtacatcaatgaaccaataatctgggagtatctcaattgatcccttgctattcttcggtttttccttaatagcacactaggatcaaaaggagtaggagctgccttgcagtcactataaccaaagcgactcaggaccttgtccacatagtgagattgcacaagtgtaatcccaccctcatctcctctcagtagtttaatgtgaagaataacatcagccactcccaaatccttcatttcaaagcttttggatagaaagtccttgacctcctcaatcacattaaggctggacccaaagatcaatatgtcatcgacatataaacacaagatcactccctctcccccaccatagcgatagtacacacatttgtcagcttcgttcacaacaaagccaacatatgtaagtgtattgtcaaacttctcatgccattgcttaggcgcttgtttgagaccatacaaggacttcaacagcttgcacaccattccctcctgaccttctagtacatacccatctggttgatccatatagatctcctcctccaactctccattgaggaaagctgtcttaacattcatctgatggacaagtagaccatgagaggctgccagagcaagtagtactcgaatcgtggtcaagcgagcaaccggtgaataagtgtcgaaaaagtcctcgccttctttttgggtacaactgtcacgcccagaaattcacgaaccagaatttctaagctga

SEQ ID NO: 46065 - DNA, 1501 bp, Oryza sativa; identical to SEQ ID NO: 29965

SEQ ID NO: 46066 - DNA, 1501 bp, Oryza sativa
tttagtgaaatttaaaagtaatttagatatactataaaagtaatttatgttttttcatcaaaatataatcatgtgagatcttgttataaagatttaattgttacgaacacaacggtgtaatcggatcgtagatcggataagtagtttaagataaatttttatttgaagcataggtggatagggtctcagctggtttagacaatacagctaccactagctgtgtagtcacatccttatatatatagagagagagatctccattaccacacaaataaatctcatttgttgtggatgttacaacacaatgaatctctcatttgttgtggaggttacaacacaatgaatctctcatttgttgtggaggctacaacacaatgaatttcatttgttaatggtgactttattctcatctgttacaaaaccgaaaagcagcaggcaggctcggctcggtcggccgcctcgcctcgctacgcctacggccgaggccgactcggcgcgcgcgcatgtgtgtggcagtccaaccatcacctcaaccggtcaacagggaatctccaatatcaccatatttaagttgaggttctttcacctaatttttcaaggtagtattattctctctaacattacttgtgggttcttgagattttaattgaattaaattgggcttagcccatttattccaacaggtggtataccaaaatgaactatcattttagacaaagagaccaacaggcacatgaatcatgcatgtagattacctcgtagtgtggaatcctatgtactcctcactcctaccagccatgagcaacggattcggccaagactccccttgatactctcacattagctggttccataaaagcatgagatattcccctgtagttgttcgtctacaagcagtcgaagacaatatggaaaatgtaaagttttaatggaaaaagagccatagtttaagaatgttcgaagaatccaaattccatccaaccaaatctaaaactgcatggataagcctccaacttctagaattttagcatctaaaatggctagttcaaccatacttaacaacgataaggtaagctacacagaaactatgtaaataaagtagtaacaaaagcaaaattggaaatttcagaatcaagacctcctaataccatggtgaatcatgatgatttgtgttttcaccaaagacagggattaaatcgtcttcgaagttcaaaccccactgttgccttgggcttggcctgtgatgccggtttcatcaacatatgtttggatccttgaacagcaaagcgagaaaaaagaatggtcaattccgtcaatagcacaatagcagccaagcacccaaatgcttgattggggcataagttttttttgtgtatgtatcctgagttagcagcagctcgatcttctacagacaatccaacaaatcaaataaaaatagaatcaattacctggaggatgacagggatgatggaagtcgacagcatgcctgctgaggttgccg

SEQ ID NO: 46067 - DNA, 272 bp, Oryza sativa
ttaaactgacacgtggtggacaagaatgaccgatttgtgatcggtctgacaatggtcatgtcagcagacagccatgttcccacgtcgcgtctgcttccggcggaagtggaggtaggtatgggccgtcccatcagaaggtcattcggacggcagccatacaaatctccgtccattaatgaagagaagtcaagtaagaaagagagggagagatggtgcatgtggtatccccttgagatataaaaggaggaccttgcccacttagaaaaaggggg

SEQ ID NO: 46068 - DNA, 1501 bp, Oryza sativa
tctagtaatgccgtttaagaaatatcaacactaatctttgcttggacggcaaaaatcacagttgcccaagttcgaataggatccgagactaaagaatatctttagccacgacaaaaatcacagttatcccggttcgaacactaactgggatttaagatcatttttagccacggttcaataattgtcaggccgtgtcaggcccccaacaaggactaaagatcatcactttagtcccagttgctgttaccaacccagactaaaataggaggatctttcatcctggctggtaacaccaatccggactaaacattgatcattagtcccggttcataaaccaacccagactaaagatatttttagctccacttggtgttaccaacccggagtaaagatgcctccagggttagtttaaaaataaagcatctctatccaagtcagatgtgtatactagagatgaaaacggtcggaaacggtatcattattttattatttttcgaaaacgaacggaaacggtcgaaaaatttccatatttatgaattcatctatttagaccctgtttgattcagcttaggattattataatctagattattaggagtaagctgaaacaaacaagtagattattatgctagattattataatctataagccggattactataatccattaatctcctctagagaagcttttttcagattattgagtggctaaagacctactacccttagatgcctctaataatccagagaaataaacaactcgtagcttattttatgtcattattataattcagcttagagtaatctaatttaataatctagattacaataatctttaagctgaaacaaacaaggccttagtgtcaacttcaatgccatgctgacagaaattaaaaaaaactaaattttgaaaacggtaaccatcggtaaaaatagtattattatattagttttgtggaaacggtatcaataccgtcgggaaattttcataccgttttcgtaacacgcgtgagggttgaggtgagagatcttgagtttgaatcccacatccgacgcgtttttttgacgtggtatgcatctttagtcccgcttatttcaactaggactacgaagggttggcaaccgggagtaaagctcccttccccaggagtgaatgcttgtttggttctatggctgatttttggggaaatttgtgcccaacccctactcgtcacgtgtgaaggaatcaggccgcatgtatggtgtggggccactctcttttggattgagacgacggttatgcaactttttaccaaccatggatggaggtttaaaaatagacttgaataattgtgtattccttatcttggtctggtcacttttataatgtttaggtgtgtttaattctatttgaactacactcttgttcgagtgttagattgtaataattggctgcagctctgtttagcaaaggccgggatgttatctattccattatctaaaaaataagtgaaggaatca

SEQ ID NO: 46069 - DNA, 1370 bp, Oryza sativa
atatatatatatatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatctgagttgttttgttgataggtataggtatgaatcgagttattataactaggtatatactcacaatttgaaaattttgaaaaatttgagtgattttgtgtatttgatatcatggtgcccgggcaccatggtgccccatatgagtgtcatatatatatatatatatatatatatatatatatatatatatatatatagatccattaacattaatatgaatatgggaaatgccagaatgacttacattgttaaacggagggagtatttcagaggaggcttaagttgacaaatttaggatttgtttggttcaatatattatcagtacatgatacttcctccattcaataatataagtcacaactactttttaaagttgtttcataatataaggcgtgcatgcatgcatgtcattaactagcacatattttccactcaaatattattatttaaagcttccaccatcaagatctctaattttattgggtgtatgcattctatttattagggtaattcaaactataagtgataataattatttcttattctttgggttaagggtggttgtgccttatactccctccatctacttttgatagtcatatttcatcttgacacacagaccaatgataagtgattctacttatcatccatttaaacatgctactagtcattcctcgtaaacaagcgattcattaatatttacatttctcgatgtccatgcaacaaatcttgtgtggaagaatggagaatcatgcattaaatctgagaaagtcattaagatgataggttgttggattgaaatatgcctatcaaaaatagatttttcagatttgaaaatatgactatcaaaagtagatggagggagtattttggaatggagggagtattagtaaatagaatatgatcttgttggattgagtaatatgcaatcataactccccaatgtacttttgaagaacagtgagagattgattaaaaaaaagaacattgagagaagatttgcctcattttccacgcgcatgcttcccgaactactaaacggttttataaaac

SEQ ID NO: 46070 - DNA, 1501 bp, Oryza sativa
ttaatatttcgatgtgtaatgcactagtaaacttgttgatagttgtaggtgaattaaatatttttttggagtagtagctttgggataatttaagttatgcattggttataatatgtcggtttggactacgtttaggaatgaagatttaatttttgttgcaaagttacatttgattttttggtgtagatggattgacttgttcgtgtttactacggtggtagagtggtggaaccttatgttggtacacatgttgagtttgaggatatgttattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagagtctcagtttagatctctagaggtgtttgcatcaaagttagttcgtaccgtagaaaatttggatctaaacaaatctccttcttatcattgcgttgagaagaattttgtgacatattattctcgtcgtggagggggtgcaagtaagactgagttggtacgagaagacttggagggggaaggagagaagaagagacctttgcttggaaatgatttatgggaggcaggaccatcaaagagacattgtggtagtcatgatgtggatgcagcgagggagatgaaaagggagttagtacaagaggggcttgatctaagtgaacatttgtcggcgagtgttcattggtcatcgtacggagtcaaccctgaatacccgacagaagtagcaggccaatatgtgaatccagatgattactttgatgtcgaattgagtagtggtcacgattctgtctcagtagaagtcaatagagatgatgttgacgaggaggcaagtgttgagcaatatgatgttgaatttgctgaagactctgatgatgaccgtccattccctccacttactaataatgacaagttagcattagaggaatgtcgtgcgtttgagaaggtgtttgtgaggaagccggacatttctgagtttagggacctaacacatgcccatggggcactactagatggccgcatcaacctagatcagttgtcagaaccattttaagtggatggtcttaaaaagggtttaaaagttccatacatggtcgcattgaagctatgggttcaggattacgtcatcgtgcaccatcgtccataccgagttgtcaattctgccgcaaataggaggtacactgttaaatgtgaaaacccacggtgcaaatggaaggtccatgcaactaaaaagtctagtggaacgtggaggatatcacgggtaggtaaggaacatagttgtgctactaccgaaggttcagggagccaccggcagctgacatcaaagttcatagtaaatagtttatgcaatgccataaaactgcaacgtacactctctgcttctg

SEQ ID NO: 46071 - DNA, 1501 bp, Oryza sativa
atcactaattttgattaatgttgttagctgccaagcacaaaaattgggctaaactaatcttagtaggattaatgtaagctaacctaatttttacagcagctgacaaactgcatcccgagtcaaatgggctagttgtcatttgtttgaagaaaacagtcaagttgcagtggcgagcaaacattcatcatttctatttttcaaccttctcacaataatatctactaccttgctatattgtgggatggagggagtacgaaccatcctaggttgctatattatctgcagtttctttttttttctctctctactagtatgtgtgtcactaggaacacctcgtaagttatgaaactcacaggttactgaaaattgtttatgaaagcaatattattccatatggtagctcgtattttctcctcggttacggttggttccactagcaatttgccagtgaatccatgaataccaccacgctcttgcgatctaactgcagcgtatcatcttgtcacctcaccaaataagccaattgaacggcaaagcaagcaccaatccccagcaattctatctagccatttccaaaacttcctcctcacaatcaaagacctcatggcgaaccaggatgcgagcggagccagatccaccgccaccgcaaatcctgatctcctcctcccatctagcactagcattcattcacccaccaccccccaatcgcattctaattttcagaatagaaggatccaattcccgcgccgctgtgccccatcatcccaacgagaaaccacaccaccaccaccaccaccaccgctcgccgcggatcaagatcaggcagcccgccaccgccacgggatcaagaggagcacacgtacccggggtcgcggttgcagatgtcgcagatctccatgttcttggcccagtcgggcccgatgagcatgtcgctggtcgcccggtccaccatggagcccgccatgcttcccctcctcccaccggccgccgccgctgcccacgctccggcggcgcggaggaaggtggtgcggccaaccacccacccaccctagctccggccagccgccccccctcctggccggattcgggtcgccggcgagcgagcgagcgagcggattggcctccacctccagatgcgatgcccccccacccgccttgtctaacgatttcctcctattttcttttcttggaaatttctccccgccaaattagctctcccaaaaaaaataaaaatgaataaataaatcattttttttattttttttaggaaagttaacgagttcgtttggtaggtggcggcttgtcggatggatctgagctgtcccccacatcataactgtcacttttccctcaacgtgggcctccactaccaggcccattttggcccatactctacgtgggccgaaacactgaggcccattaaaaacgaaaacctggagcggggaggcgtcttcgtcttcctccctccgcacgcgccgccggaagcgcgaaaccctagcaa

SEQ ID NO: 46072 - DNA, 1501 bp, Oryza sativa
tacataaaataggattttcagtcaccatttaataattcgtacaggaaaaggactctttgtcaacagaaacacaagatgacattcatgtggtatacctcttcaggggtccaatttcctttggtggaacgccgtgtcggaccggtggtcctcctaaatttgcatggacaaagaaacaaaacaaaatttagtacaatatacattacgatagtcaaaagagcttttagccttttacccattgagaggtcgtcgcctttttggttcattgctgatttctccttcttgaggagccgacggaggtccagaaggctctccatccttatctggagcctttccgttatcgcttgtcatcatgagtgaagacaatcaatcctcactttgcagtagaaacctccaagggatataaaaatcattatactgtcaagcctcagtgaggccttcagggagttgctccaagggagaagcaatcataagctgcaaaagaattggacgaatgaagatattgtcacaagatgtaacaatagaagcattcagggatgcatagaggacaggacattgactaccctcataagaacatgaattctcatttcaaaggagttggggtagaattcatgtcattttcgttttattatagagatggattgtataatattttatctaaaaaaagagttggggtgataatgtgtctacaccccctcgttgtacatctttatgaaaactaaaaaatgcatcattcaccctgatgtatatgtagatggttgattgatatgcagtcaagtggataacttgcaaatggggaaaaactcctctttgcttccgtaaactattctgcaaatctacttattagctcattctaccctccgaagtccgaactactgaagtagctaatttcacatttagggggagtaaaccttaagctttctgcaatatataaaatagttttagggtagtaaaatgttttttctccttttagatttgaggattgtattttctgcaaaatgtgaattatctcctggtttatccataatctaaaaatatggacctcctctgtctgggtttcaggtttatttggtgctaaaagcgtctgactttcgctgtggaatttaccagacaaaaaatatataacacagatcttagtgatacgaattatctgggctcgtaagtcggtttatatcgtatagcatagcacctcctccatattcaaactcaaatcagcacaacacttcaacccaatcaccaacgaagcaacatcccaaagcaacaattaatcaagcagagagatggagagatatataccagatcaccaatcgccttgctgacgggcgagcctggacgcgagacgcctctgccgtgccgccgcctcgtccgccgggagcgcgtcccttccgcggcttctgctgctgccgctgcctgcctggatctgggtggcccgaaatccttaccagacgccctcaactcaaccaccgcggcggctgctgctgcggacgccgcccggcccgagcga

SEQ ID NO: 46073 - DNA, 1501 bp, Oryza sativa
tatgtacgcgcgtgcatgtcatgtaatacaataaaattccaattgacaagtacaatgacaagattggttactacactaccatgtgattttttgttagctttgcgtcgtttttataccgcgcccgcctgcacgttgaagtgaaaagagctgctccctccgtttcaaaaaaaaatatttgacaccgttgattttttagcgcatgtctgaacgttcgttttattaaaaaaattgcgtacttgaaagtatgtttaagaatgaatcaaattatatgaaaaaaaataattatttaaattttttaaataagacgaatgatcaaacacatacttgaaaaaaacaacgatgtccgacattttaaaacggggagagtattagctttggctcgatcagatccaacgctgcgtcaggagagcgaccacacggtgtcccgtcccgatccaacgcccacgtccggggcctcgcgggatcggacgcctccctgcaaaccgcgccacgcggccgctccggagcctcacccaaccggcgacgcgacgcgacgctccctcggcgtccggtccagttcaccccggcaaccgccaaagcggccgcgcttcccccgccacccgtttcgctcctcaccgcggataaagcgctcccccccacttcgaaacccaaaaaaagctccaccgggggcaaaaaaaaaaaaaaaaaaaagcggacgccgcctgcgcctcgtgttcctccacgtcgctccgccgctccgcccgccttgcttgcgagccacagcgacggctggccacgcgcggcgtgtgcgtgcgtagagcgcgggggggacggaggcacacgctggccaccagctgcagctgcagcgcagctcgctctccttggccaatgaacgctcgttgctgccagtagctcgttgattctcaggtgaacgcgccctctcgctcgctcgtgttctaccgggattcgtcctgaattagcttctcttgtctctctcgtaggcagtttcttgtcgaccgacgctctgcaactgcttgtttttctgcttgtataaaataattctgctgatataatatgtgaaaataatggaatttctacatttgaattggtctaggcttcaggataaggccggttttgtatttcagatcctgagttgattttgtttctgttttgtttttttttctttaattctggtagtttgtccatcaactgctttggtcattggatttgttaatacaacacgtgttccatgaaatctgaagatgatgttgattatcatgaccactaaaattctgtaaatgatgttttcattgttaggaatccaggatgcccctatgaaatgcgtccttcactgtggaaatggatcagagaaatatcacattttgctcttaacagcttcccaggaatatgcaattcttttggttttaaaaacagacaagagtaggaacatcaatttcatctatacactccgaatgtgtgcatgtgtttcttgcccactgactgcattagtgcagtacatatg

SEQ ID NO: 46074 - DNA, 233 bp, Oryza sativa
ccgacaaagctggtgacaatgaactgctctctgcagataaatgttcacaacccttccacgatgttcggcattcatgtctcttcgacatcgattcagatcttgttctcgcaaatcgcgatcgccaacggtcaggtagcagctagcaccttcagcaccagaatttctgtactgcaatttcctcttccatattgaactacaaccacattcttaagctcaattcatcctgctgctct

SEQ ID NO: 46075 - DNA, 1501 bp, Oryza sativa
agaatacttgttgctttaagtttttgtttgtaaagtttgatcattcgtcttattcaaaatattatggaattattatttatttttttgacttgctttattatcaatattactttaagtatgacttatcattttttatatttgcactaattttttaaataagacgaatggtgaaacatcgaaagaaaaaagtcaaagtgacaactattatgggacgtagtatttccgatttccaatccaaaaccctagctgggttgcaagcggcggcggcggcgcacgcgacaagcggcggtgcgggccagcgcgcggcggccccgcgggtgcatgcgtagggaggcgcggtggccggcggccccgcggccagcgcgcggcggagaggagcggcggctccgtcggccagtgagccagcgagccagcaagcagcgagcagggaagcttggcggcaggatggcgcagcgtatgggaaggcggcgaatctggcgcagcgccacgggaaggcggcggcgaaggctgcggcgaggcagctcctgtacaacgcacgggcaagcgagcagcgagcagcatggtgcggcaagccggcaatagcgacgcacggcgagcagctcgtccacaaagacaaacaatgccatgtcgtttgctgcttgattttccttttatttttttccccatctcatcacttgcgacgaatttgtgatgaatctttgtgctaaagttctgcaaccgtgcgaattgtgtggaaatgctatcaaaattctaaaagaattggacaaatgttcaagggtatacatgtctttttacgagtgaattgacactgttaactgatgataacagaataggggtaaactgaagcttcgtttgagaaaagtaagggcaaaaatacaccctaaaaaaggagtaaaatcataattagaatacaaagtaggggtaagtacacaattacccgaaaaattttgtttctgaatctcctgagcaaagtacggatcactcggaaaggcgtcgtgcaagagcgacgtgttcagcttcggaatcatgctccttgaagtcttcactggaaagcgacctacggatcgatcgtttgttcgttggagaagtgaccattaggcagtgggtcaatcaagcattttcggcgaagcttgttcatgttctggacgacaagctacagctagatgagtcctctatcgaagacctgaatcaccttcttttgccaatatttgaggttggtttgctctgctcaagtgactcgcctgaccagaggatgtcaatggccgatgtggtggtgacaccgaagaagattagaaaggattatgaaaaaaattggcattatattagaggatgtcaaattgtcaatggccgatgttgtggtgacactgaagaagattagaaaggattatgaaaaaagaaattgacattagattagctgccgtgcagagttgtaggcaatcattggttggcgttgatggaccgcgttggtttgatacagccaatgaaggctgtttaccagcag

SEQ ID NO: 46076 - DNA, 523 bp, Oryza sativa
tttaaccgggactaaagataacgatctttagtcccggattcgtagtcccggttggaaaaccgggactacaagggggttacgaaccgggactaaaaagcatttctccaccagtggaatctcccttgggatgaaaaagctacccctgtcatatagaagggttttttttcccggcgagccgtgccatgattcctcgcaattctttttaatagattaaatcggtctctacatctaaacggaaaatagatactaaacaccggaacctgataaaggtactaaacacttgttccaacatatagttcagagcattggtgctccagtacatgctcaatggcagcttagacaagctcctacactctcaaggcacaagttatttggggttgttagagcaaatatagtagatataatcagcgggcggtagtactattcatctaagataaatcctagatggaagagtaagaaaataggagagagagtaaccagcacttaatctatcacccggctacagcgatagtaaaaagcagca

SEQ ID NO: 46077 - DNA, 382 bp, Oryza sativa
gagcttggaggtggaggataacctagcaaaggtgggattatagggcgtaggggttgtctaatcgattgatggtgtgtaggtgaatcgaaatagtatctcaaaaacttatgcaagttatcaactcctgtatgttgggaatggccggatttgtgctttgttctctggccggtgagcttccctgtaaaggactgggaatattttgggtggagaacggccgtgataacgatggtttggtgacataaatggtgcaattttgggctgatgttctcctgcttggagccctaggatctactttgcggaaccgtggtgtcgtcggggtggtttgagaacaatcgagtcgtctgctggtagggagacatgattttttttctgttgctaaaaa

SEQ ID NO: 46078 - DNA, 1501 bp, Oryza sativa
ttggagctgatggagaacgtgcgcagcatcggcaggtgaaagctcccgttgctcgtcgtcgggatccaccctgtcaggttgttgtgcgagagcaccaaccctcgcagcctcgacatgttgtagacggccggcggcaccgcgccggcgaggcggttgccgcgcaggttgaggtactcgagcatcggcagcgacgacggcgacgacgccacgccgtgcggtacgccgcccgtcaggctgttgttcccgaggttgacgaacgtcagcgagggcgtgccgttgaacagaagcggcggcaggtctccggtcagctggttcatgtgcagagcgatcctcgagaggcggcgcatgccgtgcagcaggtcgggcgggatctccccggagaggttgttgttgcccaggtgaaggagctcgagcatcgtgaggttggctatggcgggtgggatggcagccgatagcaggttgtcgccgaggaggagactccgtagccggcgtagcctgccgaggtcggcggggacggggccgacgaggctggtgttggtgaggtcgagggtgtagaggaatgagaggttaccgaggtgggcggtgagctcccctccgagcggcgcgtccggcagcgacaggccggtgacgcgctccggccggcggcggcggctgcaggagacgccgacccagttgcagaaggagacgttggtcgtccagctgccggcgaggacgccgagaggatcggcgagctgggccttgaaagccagcagcgccgcgaggtcggctgcggcgccgccgccgctgctgctgttgatggatggagatggagaagaagaggcacctgctgcaagggctgtcactgtcagcgagatgatcaacaactccgccgtgtgcaggactgctggtaaacagccttcattggctgtatcaaaccaacgcggtccatcaacgccaaccaatgattgcctacaactctgcacggcagctaatctaatgtcaatttcttttttcataatcctttctaatcttcttcagtgtcaccacaacatcggccattgacaatttgacatcctctaatataatgccaatttttttcataatcctttctaatcttcttcggtgtcaccaccacatcggccattgacatcctctggtcaggcgagtcacttgagcagagcaaaccaacctcaaatattggcaaaagaaggtgattcaggtcttcgatagaggactcatctagctgtagcttgtcgtccagaacatgaacaagcttcgccgaaaatgcttgattgacccactgcctaatggtcacttctccaacgaacaaacgatcgatccgtaggtcgctttccagtgaagacttcaaggagcatgattccgaagctgaacacgtcgctcttgcacgacgcctttccgagtgatccgtactttgctcaggagattcagaaacaaaatttttcgggtaattgtgtacttacccctactttgtattctaattatgattttactccttttttag

SEQ ID NO: 46079 - DNA, 832 bp, Oryza sativa
ccgcctgtcgccacctaacccacgatctgaccggtctgtgaccggtcacagcacgaataaacgagcgcgctgcactgcgttacatgcggcgtgacgcgctcgtccaaaccgtaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccgtatcaccctcgggcccgacccccccgagggggttaggccacgtgggcgatcgtgtctgcctcaagtctctaagtcatgatactcctggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctagactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcactattattccccttgtcttcgccgcttgcgccctaactccttgtttcctgtgccctaccttcgccacacgcgctcgctctcaaacatctcttcttccggcgtca

SEQ ID NO: 46080 - DNA, 1501 bp, Oryza sativa
cccccacgcagatcttcctgggtcggaggcgctgacgaaggagtggcggccgaatggcgagcaacagccgccgctcgccgcgccctccgccttgacgatacggagccggtggtagcagcgccagaggtcttggtggcggaggaccgcccaccagcacctaggcgctgccgtgccgtcatgaccaagttggccacgtcgtccagccaacgttgggctggagactccgggtcaaggacaatgggcgggtgacgtaggagtgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggtttggctccccatcgtcgccgctaacgctcggagagaggttgtgcgcctttgcttgttcggccattgggctgaacaggaaaagcttggcgcacacgaaagagtgcgagagcttagaagaacacacgcagaaccccctacttggcgcgccagatgacggagcgtggggctcctcaccgggagaccgcgcaggcccccctttgccagttcggccgggggccctgtgtgaggttctaagctcttggtctgtggaaagttcgcgagaatggaaacacacaagacacgggcgatgtatacaggttcgggccgctgagaagcgtaataccctactcctgtgttttggtggatctgtgtatgaagaagctacaaagtccgagccagcccccctctcgttctaggatcgttctcctcttttttccccctttttctaagtgggcaaggtcctccttttatatctcaaggggataccacatgcaccatctctccctctctttcttacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccgatcacaaatcggtcattcttgtccaccacgtgtcagtttaacaatctgcatgttcacccttcttcatacaatatcttgcctgtaatggttaggataaagcctggcatatatctgaccggaaccaacgtgccatctccaggagctaacacgccggttccggctagggacgagtgcttggaggctctcgtcctgacgggatggggcgaggcgtgcgtcagaccgcctatcgccacctaacccacgatctgaccggtctgtgaccggtcacagaccggataaacgagcgcgttgcactgcgttccatgcggcgtgacgcgctcgtccaaaccgcaataaatgtggttaggtgagccccgctatgctcacctaccccatatacgcggcgcaaaacccacaagg

SEQ ID NO: 46081 - DNA, 1501 bp, Oryza sativa
tggtcaaacgtagcaagcaaaaagtcaaaaggatcactaatttgggatgaaggtggtatataaagttttttttaataaaatcaaatgatgccattaattttggaagcaggaacatacatgtgtttggtagggagtacgtgtttgtccatgggttggtgcatttaagaatgtttaagtcaatgcacaaaatatgtgcttctctattttttttatatacgacgccgttattttttttacacacattcgactatttatcttatttaaaaaattttatgtaaatgcataagatataaatcatacttaaaatatgccccaaaaaaatttttagtgacaacaacttacagcagaataaataataattatgtaaattttttaataaaataaatgttaaatatgtgttaacaatcaaagtcatcatctatttaaaaaactgaggtagaattaggaccagcagagttcaaatgtggtatgtgctgactacgtggagtgaaaatacgtaaggtgaatctttagcatatggttaattgagtattaattattttgaactagaaaagatgatttgtataattttttaacgcaacttttatataatttgttttataaaaccgtttagtagttcgggaagcatgcgcgtggaaaatgaggcaaatcttctctcaatgttcttttttttaatcaatctctcactgttcttcaaaagtacattggggagttatgattgcatattactcaatccaacaagatcatattctatttactaatactccctccattccaaaatactccctccatctacttttgatagtcatattttcaaatctgaaaaatctatttttgataggcatatttcaatccaacaacctatcatcttaatgactttctcagatttaatgcatgattctccattcttccacacaagatttgttgcatggacatcgagaaatgtaaatattaatgaatcgcttgtttacgaggaatgactagtagcatgtttaaatggatgataagtagaatcacttatcattggtctgtgtgtcaagatgaaatatgactatcaaaagtagatggagggagtataaggcacaaccacccttaacccaaagaataagaaataattattatcacttatagtttgaattaccctaataaatagaatgcatacacccaataaaattagagatcttgatggtggaagctttaaataataatatttgagtggaaaatatgtgctagttaatgacatgcatgcatgcacgccttatattatgaaacaactttaaaaagtagttgtgacttatattattgaatggaggaagtatcatgtactgataatatattgaaccaaacaaatcctaaatttgtcaacttaagcctcctctgaaatactccctccgtttaacaatgtaagtcattctggcatttcccatattcatattaatgttaatggatctatatatatatatatatatatatatatatatatatatatatatatatatga

SEQ ID NO: 46082 - DNA, 342 bp, Oryza sativa
acatgcaaccaataagtattagaatgacttcttggtttccgattaacaattttatttagcacaaagtgactacaaataggacttagatttttggaaaaaccaaagaatgatatatgagatttttgggagagagtacatgtaactggtcaccgtcaacattggatctttgtacgatggtcacctcgtgtaggttcttccctcaccattttacgttgatttttttaattacgaaacatctataaaattgagttatttcatctcctaggcttcttaggttcgtcatcacccagaaggccatcaactaagttccctattgggattgccacatttcgtcagggacca

SEQ ID NO: 46083 - DNA, 1501 bp, Oryza sativa
atcttcactggtccacgtagtagttcataacagaattaagaaaatcgatatttttttagtacaccacagtttttttcccctcatatctctgcctcatactaatccacaagttaaataaaacctggttatgctatgcctgaaggcttcccccccatagtcaagactcaaaaccacaaaccttatttactggtggattgtagaaggccaaagattatgtagaactaacatctaaacatttcttaatctgtttaacctgaactataaagaagacatcatgcaaagttgcatattcattgcatataaagccagaaatgggtggacatatttagaaaaaaggcaataacatacctactgttctgcggccttttcaccaaccacagaagaagatgggctccattttctatcaaaaggcccatagcttctctccacaatagtttgccgctcggttagtttcttatctattagctccagtaactcttgcaatcctgtccctgtcactgcagaagttttcacatgacaagtggacattggttgtgttgaactgcagctatctgtactaatagtttctggaccacaaagctctccaaaacaatcttttgatgatgatgatactgagttcattgctctcatctcactaggctcaagtgaggatgatatttcaccattgttgccttccaaattttcctctgataaatattcggagtctgttccatcatccaaggactcaaatgatgattcttctgcaggcacatcgttttcagaaaataattcttcctccttatcctcctcaccttcggtcaggaaaatctcatcttcaatatcatcagttacatcattatcattgttgtccacaatatcaatctgaagaaacaccataaaaaagtcaagttacatgaaaacccatgctaccaacaattcaccatgcaagtgtgacagtcacagccaaattaaatttcactactaaccttattccaaacttcgatcatactgttgattttatcctgtgaaacaccaatctgttgcaatacttgcagaacagtagaacgatgttcctcgatattaggagcactagaatctaatacatgctgcaccaatgcaaataaagagacatacaatcaactctatttctcttttttttattaagtaatttatcttaaaacaatttctgaaaagaaaatgtacatggctgaagaactatttgttattaaactagcaatggaaagattttagaagctgtcggagatatgggccgggggtatgcaaagtgaggggaagttaccttcccatccagccacgtggctctacagtctggccctaccccgcacctcgcgagtcgcagaagcggccggggcgcctcggggcgccacgtcatgcccctcgggctctcgcgttgccttgccccgaggccctcccccggctgccatgtggcgggggagcgagaggggaggaaacccaggctgaacagccatcaatgcgcggcgccccaactgtccctcactgc

SEQ ID NO: 46084 - DNA, 1501 bp, Oryza sativa
ggtagcccaccaccagtgtcatgcgtgccaactctgccacgaagtcaatcatgccttctccacggtggttgggtgggtgaccggccatctagagaatacaaaggagtaggatcaatgcatgctcaaatccaaatgtaaataaagcaataaaagactcaaataagggaatcgaataagagcgaaattttatgcatagatcattttgcatgagagcgaataaataagacagactcacataacgataaaataatgagaaattagatacatactaataataacaaataaagcataaataccttgcaacccaaattcctgagctaggacctaatgcatttcacccatcaaatcccaactgactaacgaatgaatcccaatagctttactaaaaccctagactgactcgttttgaaaaatctcactttaaacgagcgaccaagatttttcccctgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcccgaataggattccaagcagaatgtgcattaaaacccccgtccaggaccggccggggtacacaaacgactatgttgacattcagatccacgtcttacaaacatcataaaagtcttacagaaatgcagcggaaaacaaaagaaaactggagctaagccttgacttgaactgcagcgggaacaccactccacaggcatcctcgacggcacggacgaagcctactcctcggagaacccgccatcggacacatactcgagctctgggatcggggggaaatagagcaaggctgagtactacccactgtactcagcaagtcataccggaataggggtatgatgcagggagttatcaaagaagagctaaagtggttcatttgcataaagcgagcatttataaacagagattgaaagattaaaccgttgtaacaattaattaatattaaacatccactgtccaacgctaacccacgttgcgacaggcccaaccatccacctaaactatccaaattaaaagattacactaaggtgagactaatcacggtgaatctggttgaccgcccataaccgcgggcacggctattcgaatagttttactctgatcagaggtgtacaactgtacccacaagacacagccgcacaacacgtttccgtgcgccgacatgccaccacgacatatcggaaagaggccgtgataggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccttgccacgaccggaaataacccaacgggagttccttacgtgcgtgcattaatccttgtcccagg

SEQ ID NO: 46085 - DNA, 448 bp, Oryza sativa
acacatcatctggatcatattgaatcccagtttataaaattatgtggattaaaataatggcattatcgcttaatttaaattcccgcgttatcactgttttatttagccatgcctatttacctttgttatgaccatattattattgttattgttattattattaccttgttcaccctagacaaacaaaacctcaactagtgggcactctactcatagtaccactaggataattttaggtagatgcttcgcaatttaattaggtaacattaggtggttttacaactatagactttgggaaatattcatatcacctggatactttggaatggttggctattgtggaattggtttcacaccgctccttcctttcaaaacccctaaaatggttttgggctgggctaggggtgcatggttttgatggtagcacctcggccgtataaggaccggt

SEQ ID NO: 46086 - DNA, 1501 bp, Oryza sativa
tcaagatgtcattgcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaatccttaaaacctgcttatcaactaaaatgtggaatggttggcctgggttggcttgggacgagctgggacccagggtcgggttgccagttcggtctgaatcatcataggccttgggttaaggcaggttcgtgtgggttcacggccttgattaataacattgtatagttctaggatcgcgtttgcaaaatagctttgtgcaactaaattttctttaaatgctgattactgcaaccctaaccctttatagtataattcccttgtactcccttgcatttattctgcatttgtgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaactcccgttgggttatttccggtcgtggcaaggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctatcacggcctctttccgatatgtcgtggtggcatgtcggcgcacggaaacgtgttgtgcggctgtgtcttgtgggtacagttgtacacctctgatcagagtaaaactattcgaatagccgtgcccgcggttatgggcggtcaaccagattcaccgtgattagtctcaccttagtgtaatcttttaatttggatagtttaggtggatggttgggcctgtcgcaacgtgggttagcgttggacagtggatgtttaatattaattaattgttacaacggtttaatctttcaatctctgtttataaatgctcgctttatgcaaatgaaccactttagctcttctttgataactccctgcatcatacccctattccggtatgacttgctgagtacagtgggtagtactcagccttgctctatttccccccgatcccagagctcgagtatgtgt

SEQ ID NO: 46087 - DNA, 1501 bp, Oryza sativa; identical to SEQ ID NO: 24788

SEQ ID NO: 46088 - DNA, 156 bp, Oryza sativa
ttataacccaagctaacaaaggagcatggtatcaaaatagtatggccgtaacaataggtaaccatctctatagtaatattgcaaaacaaatgcggtatttgaaagaaaacaatagagcatttgcaatataggatcaatatgatcaagtgacaagca

SEQ ID NO: 46089 - DNA, 1390 bp, Oryza sativa
tcgtcgtcctctcgtcgttcccggtcgtcgtggcgttcgtccctccgtcgagccgttctcgtccgccgcccgcgtttcgtcaagtgtgcagcagccccgtcatcgtcttcgtcctcggctccgcgtcgtcaagcctcgtgccggccgtgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacgggatccgcttccgtcgacccgtggaccgtctctgtgtacccggtctaccgcggtcctttaggttgacatgtggggtccgcatgtcagcagcgcagccttcctgtcttttccaggctagcgcttccacattttttatagttgcaaagcttaattataataatccgcaaatcgccatatatacagcattaaacttcggatgatcatatcttggtcatacgaactccgaatcgatccgttcaagtctcttaatgtttgttataacctaaagaaccctgtgctttgttttttatgtattgttattgcttctttataggcttgtagctttgcttgtgtgcttcgcgtagctttcgtcgttccggaggttcccaaagcgtggttcgtggtcgtcgccgaaggttcggaaggccgttctctctgagcaaggcaagtcacatcatccttgagcatattgaatcccagtttataaaattattttagtttaaattaatgcattatcgctttatttaaaattcccgcgttgtcactgttttatttagccatgcctatttacctttgttatgaccttattattattgctattgatattattaccttgttcaccctaggataaacaaaaccccaactagtgggtattctattcatggttccactagtatgaatttaggtagatgcttcgctgattaattaggcaatattaggtggttttataactctagactttgggaatactcatatcatctggacactatggaattgttggtttatggtggaatttgacatacacctctcttcctctttcaaaacccctaaaaacctgttttcggtggggtttgggtgcatgccagttgtgggaagtagcaccccggccactataaggattaa

SEQ ID NO: 46090 - DNA, 1501 bp, Oryza sativa
aaacatttggatcatttgatttatttagaacaatcgagcgccagatttgaagttttctccctaataaatctatggaagaaagcaaccacgctagttaattagctggacgaaaagtgaccacgctatttaatcgccatcgatccgtctgccattcggcgtgaccaatttgcgcgactgcgtcggttccacgtccccgatccacgagcggtcacgtgtgatggcatcgcaccaccatctcttccatttgtctcacgtcttcgagggtgacgactccctcgtccctcgcgctccctagcccgcgaggtatgcatatttgcacaaacaaatttaaaacatgtactctctccgttcgaaaatactcccttctttccaaaatataaagtataaccactcctaactcaaagaccaagaaaataattattatcatcttgtagtttggatcatcctaataaatactccctccatactcataaaggaagtcgtttaagataatgtttaagtcaaaccttgggaatataaatcatgaataactctcaagttgttgagttttgaaaatgtaaaaattatatgtatagatttgttttgaaaaatactttcataaaagtttacatatattactttttaataaatatttttatagaaataagaagtcaaagttgtgttttagagaccgtgtcgctgtcctaaacgacttcctttacaagtatggagggagtgagaatagaattagagaacatgagagtggaggatttaaaaaagtaataatttaatgaagaagtgatcatagttaatggcctacatgcatgtatgccttatattatagaacatctaaaaaaagtggttgtgcattatattatggaatggagggagtacttatcattctatatattttagcataggttaaaatttaaggaaaaaataatagttccattcatttataaatgatgtatagttaggattggagtggtacttgaaggcccgggtggagataggagtagagcaggtagagctgtagccgatcctaaatattcattgaaatttcattttaaaccttcaaaaaattagaagataaaggcaaaattttattaattcaattaaggtccagaaaaattatggctctaccactagcactacttgaagggtataatagagaaaattttctggatgggagtatgggacctatagtactttagagatatggcggtagtatatatagtacgtgtacaacatcgtgagagatgagttatatttaaaaacgaaaaattcctcaacattatcacttgtcccttgctcccattcaccaccagaaaatatacttttcgtgaggggccgtcaccgtcagcccgtccagtttctggttgttgatttgctacccttccttccgtcctcaacattatcaatagtcccatgctgctgccgcgcgcaactacaaccaagtaaccaaacgctttccgttgcacgcacgcgcgcaaaacaatggccgtctcactcctccccgccg

SEQ ID NO: 46091 - DNA, 377 bp, Oryza sativa
atatttttatatgagaacgagttaattaaaaatcacaaagtgaaaaaaaaatggtgccactttttttgagttagccgctgatcatcggccttgaactttgtatgcactagggggctagatcgaattagatctcacctcaacatgcctcaaaatcgacaattttgctatttgtcgattcctaatttttatcttatttccagtggctataattactctctcgtgttttaaatatagctacctttaaataggtacaaagattaagaaaatagataaaaataaaatggtggatggttataaattagatactatgtcaatggccaaattaaacccctagtaaaaaaaacattggtagtatattttctattttaccaaataga

SEQ ID NO: 46092 - DNA, 444 bp, Oryza sativa
ttactaaccggaactaaagatcatagggccctgacacggcctgacatgtaatcaaccgggactaaaaatgaactttagtcccggttgaagttaccaaccgggactaaagatgatttttagtcccggttggtaacaacaaccgggattaaagatctttctcttattaaccgggactaaaaattatttttattcctggtttttaatggaaccgggactattatggatttgggttgaccaaccaaagatggtttctctaccagtgttcggtttcacaaccttcatatgactgtgcttattacgcaatccaatcgtgacgtatgaagctaggtatactgcccatcgatcgattctaccgagatggcaacatatattcgtatatatcgatgattaatttcacaaggccatgattctttcgaatttcggacaccgcaatacacttatata

SEQ ID NO: 46093 - DNA, 1501 bp, Oryza sativa
ccttgtagtcaatggtgctgttgaggaatttctccggtgagaactcgtccggttgctgcccccatgctgccgcgtctcggccgatggcccacgcgttgatcaccacccgcgtgtgcgctggtatggtgtaacccaggatctgggtgtccgccggtggctctcgtgggatgaggagcgggagtggtgggtgtagccggagcgtctccttgaaaacagccttgaggtagggcagcttgtccacgtggtccttggtgacatgactagtgttgcccacgactgcccagatctcgttctgcgctttgcgcatggcgcgtgggtggttgatcagctcggccatggtccatgccatcatcgtggtcgtagtgtctgagccccctacaaacatgtcctgctcgtgtccgtgaagcaagaagcatatcagctacggaaatttcacagtaccttaacctcaaggtatctaaattttgcactaaattttttgatacctaattaattagtacctggaggtactaaattttatactaataaatacgatacctcccgacactgttttaatatggtaaaattgccctatcagctatattaatattcagtattcacttttgtcataaatatgtgatatttagaataaaattttgttaatcttttaaaactttgatcattaataattttttattgcctagtttgaaacaagaaacatattttgcatacaattaccttaaaaatcactacaattacacctatttaatattataaaattgttccaagataacatgatgatcagagttttaaaacctttggactaaggagtgctagtattccaactagactatagctcgattcataccatgataatagccttgatttcgacggtgccgagctgaatgccagcgtccttgtccgtctcgttcacgtcgagcaacacgtccacgaaatcccggtgatcgccgccgccgtcgtcgtccatacgccggccgccttcacggcggcgacggtgatcgtcgatcaccctctcgaggatgccgtccagcgcctcaaacgtgcgctgcaccttcccgtctatccccctcaaggcgtccacccaccagaaccatggcaagagctcccccatcggctccgtcccgagcaacctcgcgaagtcgtcgaacaccttcctcagctcgcgccccctgtcgccgccgccgccgccgccgcgcgcgctctcgtcgccgaacgcgatgcgcgtcaagacggtgttggagtaagcgatgaggaggtcggacaggtcgacgacgacgtcggcggcggcggcgcggacgcggccgacgagcgcggcggcctcctcctccctgacgcggcggaacgagaggacgcggcgcgcgctgaggaggtggaccacgcagatgcggcgcgcctggcgccagtactcgccgtagggcgcgaacgcgacgtcgcggccgccgtagagcagcagctcggccatggccatcctgggccggctcgcgaactccatgtcccgcga

SEQ ID NO: 46094 - DNA, 564 bp, Oryza sativa
ccaatagtaattttattactatgaattagccgctaaatatgttagaaataattgttttgagttttataaaatccattcataatcataatcattgccaccttatttaattacttattataggagatgccttgattgattgtttaattatctgcccaaacccctccatatctgtactgatagtaatttaattactatgaatcagccgctgcaaaatttccgtatgcatgtacatatgttgcttttttaatctaaagtccttttatattttatatatattacaaataatagtactgagttttataaaaatctatccataatcataatatttgccaccctatttaattattatttatattcaacaaaggccaatgtcgaatccatgagaattattttaatttgtagtaaatatttaaattgctattttttttgtcaataatattctttcgatcctggatggatagcaacgaacgtttcctaaaggcacgtttttttttcttggactaaccagtcaatcggattgattccccatcttccatatcctttctgtttttatcgctccgcagg

SEQ ID NO: 46095 - DNA, 175 bp, Oryza sativa
acattccagttacagtgtactcacaaacaagtaccagtgtaattacactacgattgtactataattacatctatcaaatttttagagaaaaatttgtcgacaaatgtataggtagtcccatataattatatgcgaacacaaggcccatatacacacgtgcacctttacccaaaaa

SEQ ID NO: 46096 - DNA, 1501 bp, Oryza sativa
tgaaatatactgtttagcagtttgaaaagcgttgctaatggaaatcgaggtaaaatttgtatcttgcagcctcccagtagaaacatcaattttaaaaaaactcaattctttttcctgataaggggagcatttagaagtactaacgcagagatgaactacaaagtgcaaaccatgccgttcaatgacactttgctataattttgtagatatcttcctgatacaattgatgttggaggtgctggaaggcaacagcgctcgtcaggctgtgaatgctagaagatatggcaccagcgatatcgccagttgattctaccggatcggtgtagatcatcatcctcacctcttccactgtgtgatatctttagtttgaaagcctctatctatgtccaatgctacatattgtttttttagtgctccaacataattggagaagattcatttgtaactgtttttactcctacctttgtatctgctagatgctagagttgggatacctttttagtctttctacccttctgtttgattgctgcagtgcacatatcttttctgtttgattgcttcagtgcatatctggagagaccaaaacatgttctgtgaaagcttgtaaattgacagaacaacctatcaatctggttctgttctctgcccattttgatggtagagcgtgccagatctgtatctatatggcttgctacttgctaatacaatccttccattatgtcttgcttgatgtacagttcatgtccgtgctctgtactacattttgatccatcgaattcattgctcgtttggactttggaggttctgttttttggccacaaaaaatagaaaatacggttgtgaaattgcccttttttctctggaaagatcgtgcatttgtcctgagctttcaaccatatccaggaccaacgagagctacaatttttcttttgattacatggcaaacgtgagcacacacgtaacatctcactcacacatgtgaatgcgtcccctaacacatgctcaaaccaacggtatattattgatttcattaaagtcctgttgaaaacctacgcgtcccctaacacatgctctaaaaacagaaaccaacgacatactactgaaattattaaagtcttgttgaaagttcacctgtatgtgcgtaatagtcgtgggcaccaatatttaagctcacctacatgtgcgtaatatttacagccaccaggatttaaactacagtaggtgaagtcatacacccataattccgtcagcacatcaccgatgcttccccaacgagagctacattttcgtctttattgtctgaatttagttttttttttgaaataaatctcgtttcaaagaaaaaaaaaatacaaacattgtacatcacaaacaatttccctttcagtgtagatttgttcccattccccacgaacggatcgaggtgagttagagtacactcgttcagaaatggagctctcgtcgtcgcttgctgccgtgttgcactcacctctcttcctcc

SEQ ID NO: 46097 - DNA, 902 bp, Oryza sativa
tgttccgctgcagcaccaaaaaccactaatgcgttcctcctcttccttgttgtcttggtatccttgttgttgttgttgctgctgctattatgttactgcctccgcattgctctttttgatttgttgttgatttgcttctgctctgtgctgacctcatgatgtatgtgatgccgtgtactgctgccatggctagagaatagaaggatacaaagagaacaaggaagaggaggaacgcattagaggtttttggtgctcaagaactgctcgatgaaatgtttcttgaggtactactaaagtttgaatacatattgaattatctttttagtacttttacatgcggaaaccttcttccttgtttttgttattatattttaatggaaagtaatttatatttaacaaatatttcaatggctcatccatgtcaatcaactaaatcaataagaacatgcttagtttattcccattagggggttgtataaaaaatacaaaacaaaatagatgtttggtgattgtatttacttgatctggcttttggtgtgctcctaagcaagtctgtcaactttttttgcctgtggacatattgtaggggctcatccaagtatttgtctcttctatcgattggcatgtagtgatttagtgccttcctctggattgtgcacacaagaactgttggccaggttagtcaaggttgtttagtgttgttaagattatcatgaatgcatactcatccttattataaacacccctctccccattatctctctctccgcatgagggatgagctgctatatagttacaattgctttttatcacaatctcacatgtttgtttatggttttttttattacaccatgtttcatttattagcttgatcactatttctccttcttatatactttagt

SEQ ID NO: 46098 - DNA, 1501 bp, Oryza sativa
ttgaagtattatgtttttccaatcctatgaaaattgagaaaaaaatatatataaaaagatgagtaaattacacccgcggtacatgaacttgtgtggtgggtgcaaatagatacaacaacttacaaattgctcactttgatacaataacttggctagttggtgtgaaccgggccaaaatgatcacacaagtaaaattgctctaaattagtgcacactaatgacataacaacatatacatataactgtgatttggagatcttatttcgaatccaaataaaaatgtgcaaaagtttatttttcatgtccatggtacaatatttgtttcattttttggaaaaatttgatcatctatataactcgtctaatgtttatttatctgttcaagaccaagacaatttttatatgtactattaactactaaaagaaaattttaattttcatgttcatgttctgacactttcatcgaaagtgtattttacaatcaggtatttttaattattttgctttttcgttggtctagatcttaaaagtatcatgcgactaataatatgtgtcagtaaaaaattttgatgtgtaacaataattacacactagtacgtatcatattacatcaattttacttgtgtggattagtttggcccatctttgtatgaactagccaagttattgtaccggaataagcaatttacaagttattgtacctaattgcacccaccatacaagtttgtgtatcgtgaacgcaatttactctaaaaagatggactctttgattgcatcacaggaaacattcaacaatcaacgaagaaaagtttcacaagagatctaacctcttatttattttcatatggaattgaccataggaatggaatcctatggaatcaaaggactctagaaaaaaatccttcaaaatttctttgctaatcctccatttcaaagggtccctaaattaccatttggacaagattttttaacaaagtttcactttgaagtctttgcgctattctaaattctatattttatataataaagctaaaagtatttacatattttactttgaaccactctctaatgagcggattacctttgtaagtaacgtgtgggccaaaagattatcaggcccacatggtagtaagaaaggcaatccctaacgactaagagtaagtataatagtgggctataagaaggctgaatgctgaggtggatgggagaaaagaggagagagatgagaagcaggctgtaagtttgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggca

SEQ ID NO: 46099 - DNA, 1501 bp, Oryza sativa; identical to SEQ ID NO: 24808

SEQ ID NO: 46100 - DNA, 385 bp, Oryza sativa
aaaaaaaaaatgactatcaatatacattaactagctgtactttttttttacaacttgtaaaagttgaattttaaatactgatatattatatattaatatatcttttaaattttttaataactattttgagtgatatgtaaacaacaagggaacgtcttctcgaaagtttaaaatatatccactctccaaccagtccggggaacatagtttggtgatgctcgtttttactaaagatgaagtagctaggacacgaaaacaagaaatccattaattagtatatgattaattggcttttaattattatacacttaaaaaatagatttatctgatattttaaagcaacttaaattatgtataaaaagttttcgcacgaaatacacctagc

SEQ ID NO: 46101 - DNA, 1501 bp, Oryza sativa
attgatcagcatgcatagaacagtattctatggttttttttttacagactagctctgtgggatagttctcaagccttaatggcctttgaattattctgaatgatcccttaatgaaacataaaatgaacaaatgattattattataatagtgctgggaagattaataagcagaaagatacttcaatggtagaaccagaggattagtgcactaaaggcctgatgcaaacaagtccatagtgatttgttttcccttcttttctgagaacaaaaaatgatatcagtactaactactctgtacttggtttgacttttgaaaagtcaagtgttttggaatgattagtgtgagcttttttatgtggatatcatattagttaccatatttgttgcaaaggacaataagtcttaaaaggttgaagatgcaagtggcagattaagttcaggatgatgctatgaatgccatctggttctctcacaagtcacaactatcagcttaatttctgtaactttgtttgtattcttttgttgagatatgtttactgggtttaactgatttgcacgttcttttatagtttatgtcataattcttaacacacaaagcttctttatgatgatttggcatgtgatggttccaagtgtccaacagttttttgtccaagtcagtgattgaatgcagggaataaacatcacttgtactgttgtagctaattactatcccctgaatgtagttgatattgtttccttctaagtttacaatctgaactgcaaaatctgatagtattgtataggaatgctttatggactgggttaaaatcttgcaggccatgtttagggcccaaattcgaaatagtttctttagcctgtgactatttatgtctcgagcctgtttgtggctttttttttcatagcctaggcttctggggctttgtagtctgctgatatcgtgggacatctaattgtaactttgttgtatttggcttttgtattaccaattttctttgcattgattctgaaattacgtgcttcctcgttttctatcttacaaatgtccatgttccttttcgatgtatcggagtaagataaagacagttttggttaattgacaactcatggaaaagtatctgcagactgcaatgttaagttatcttctaaaaaccaaatggtatacttgcttaaattgttagtgattcttaatgcttccaaagttccattgtaggatcaaggcagatttggtgaagcactgagagataaagtgctgtattataaaattgtctggaggatatccaaagctcatattgtgaccttacgatctaagcattgggtggactatacatgtacagtgattttttaaccgttttgacagccctttccatcttggtattttatatattttttagcaaacggtaattcaatgaactatagcgtcaaacttttgagcatttcaatgtagttttgatatctttgacaataatttgtggactatttctatgtgattagtggatgc

SEQ ID NO: 46102 - DNA, 1501 bp, Oryza sativa
actcctgtgttttggtggatctgtgtatgaacgagctacaaagtgtccgctgacttctcccccgttctcagctttcaatccgggaaaaaaatcccccctctaaatgggcaaggtcctccttttatatctcaaggggataccacatgcacctttctctttccaaactggactgttctttttctctttaatgggcggagatcggtacggtttccatccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggataaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgaccccccctcgggggaaatcaggaggagggcggacacctcaccctcgggcccgacgtccccgaaggtgccaggccacgcgggcgattgcgtctacctcaagcctctggtcatgatactcccggtcccatatcaccgacagtagcccccggcgttatgccagagcaatttcccttcccaagggaagcggtcaggtgtgacgccacccctaaagcctggtgacgggtgggaccggtctccgtagttgggcaaaatacccaacggtctcaatccatgcacattggtattggtaactttggttgtccataatgggcggtctattcaagactgccacaccacttgagcagcgcgcgaatctgggcgagcagattcgtctcgcccggagatacggcaacgccgcttcggtcggcgagcgtaattaacgcgcgcacgatacaatccgtttcgatcgcctcaaccgcatatccacttcatgcgtcgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgcca

SEQ ID NO: 46103 - DNA, 1501 bp, Oryza sativa
cgtcgccagccactgccatcgttgccgaggtcgtcatcaccagccgtcatatgtgccatccggtcggtctccactaccttcgtccttgttggattaggcctacgcggtgtggattcagggaggcacgcggcctccgcccccaccggattcggccagcgagacgtggattcggggagggtgcgacctctgctgcttccgcgcgatttttgtcaccttcgcgtggggctgcagttgccatctaccgtcatcgtcaccatctgctgcggcagctgccgccactgtagtatgcgccgccaccaccgttgaagggcgaagatcagaagaggaaggggtggataaaatcagaagatgaagagggggaggaagaggaggaagaagggatagtagagactgacatataggtcctaatgtcagaggctcaaaatactaagggtatatggagaggctgtttgagtaagtaacaagtttgactgtccaaattagttggagagctggctatatagatatttaaagagcctaatttggccgttccgttgggatgctcaccaccactgtgatggctctctaggagggagatttactctcgctatgattgcacacgtggatttgcatgttgacggaactaaggctcgatggtctcacgactcatgagaactattagtctaccaaaccactgcaatacaataggtacataacatcaccaaattttaatcacatgaagtcatgaactataccaatcaatatgtatatttcttaggttttagaaatgtttttcatctgtcaaataaatctgatagactcctaagtctgggcatgtctaacaatgatgacaactaatcagagcgtatacaatgattattcatggtggctgcctagaacaaatttaatgtaaaacgatgttcaatttacatgaatatcctgatcatgaaagagtcaacataaccataaggtaagaaagaaaaatctctgacaacaatccataagcatcaaaagtataaaagaacacctcgttgccatgaaagattgtggatttacccacatcacttagagcagatacaatagcagactattagctaactataaacatattttaatgagataaaagatgagagagaagagcagcgagctacagatctgtagctagctgtagcacggacttcaagacgcaatgtgtgtatgagaggtgggaccatatattaatagtatagaaagcaactattgtatgaattggctattagatcggctatagatgaattggagttagtagtgggctatactgttaaacttactcttaggatgagtttgacaaactgagttggaaatcattcgtcacgcacgtaaaacggagtgacttattcgtacatgattaattaactattagctttgtttgaaaaataaattaatatgattttttaaagcaattttcctaaagtttctttttgtaaaaaatacattgttttgcggtttagaaagcatgcgcgtggaaaacgagtagggtgaa

SEQ ID NO: 46104 - DNA, 331 bp, Oryza sativa
aattcctgcagcccccgcttgggagtattgggccaaatgactcaggtttaatgggctaacgggcttttttggcccgctcgagaaggcagaccagattgccagcgcttgcaactgccgaacggaacctcagttggcagttgcatctgcatacgatacaaatacaatacatcaacaacacaaggagctactacgtactggaatcagaaaaaactactgtttttacactgctcgatcaaaatttgtttgcgttggtgacttggagtactactacttgactactccctctatcccataatataagggattttaggtctaatagctcaaccttgga

SEQ ID NO: 46105 - DNA, 1501 bp, Oryza sativa
gccgggtctacctgggctcgtcgccgtcgccgctgtgcgcggcgccgttcatcccgtcgaacaagtggctggggctcacgctggagagggagagggtggcgtcgctgcccaagggcgtccgcggcgtgtaccgccccaagagcacgctcatgttcggccccggcaccggcggcaagtgcccggccgccgccgccgccgacgccgccggcgtgccgatgatgtgatgagacgatcgatattgacatggagaattcgagatgtgcgttcacgcatatcgccaatttagttagtggtttggttggatgatgcatggtttaattaagttcgtgcacgttatttggaattaataatgggtagaaattagctagctcgtcttttggtcgatggagcatttgttgtaaccttgtagtagctcgtcgcttaggtttgcagtggttttagttcgctcgtcagtgtaatgtcatgagaaaaaaaattatctgagtacgtctatcctttcggtcgatttatgatgagtttgtgcatctgatcatgctgttgtttcagaggcgtttttcaaatctttttcatcttttgcatgccaggagaaaagcaacgagcgggggacgctgcctcgataggcccaccgactgcggcccatgttgggtggtagatgtgagtaagtactattgggccaaatggtcctggactggtggcactaggcgggaaacgggctagaattggcctaagatcagagggtgtttttcatttcaaataattactgaatgatgtttgttttgttaaaattaaatcttaggctccgaaaattctgagaaactccagagagtattgtatgacatggggaaagtaaagtattgccacaatttactaaaggctattttacttctcatattaacttcacttgtttaattactcccactttaatataaattctacaaacattttattaattcctaaaataattatggcgtgacagtgaacacgatgagacctccgcttctagctgcaaaatctcgctactcatataaaacaccacttaattgtttatttcctaggtactactacaaaatcgcatttatagctaatcattctttcagtgatatacctaacctttcaaaggtgctaatagagatacgatgtacgtgtgtgtttataggggtgtgtacgcccattatgagtatgtgcatttatattgtgtgttttctttaaaaaaaaaagccacgacatagttaccatgattctcacttttgtggagaaagttttatatacatgttgaagtatttcgaagcaaataaataattttatttattaagatacagtcccttcaatacagctatggagtttaaccatggggcttccgcgcaatgtttatttttttttagaaaaaagccttccttgaaatgaccaatgtacgtatttgatatttgatactgaacattgtaactttaatgttttttcaatcatctgacgtttgtttagcgcatgcatttgtcgaagatta

SEQ ID NO: 46106 - DNA, 1501 bp, Oryza sativa
ccatcggcgcacatactcctgatgatttcatgatttctcccagattctcaatcaagaaatctaggtcaccgtcaattgcaagctcaatatatatcaccagcgaaaagcatcttctcaattacctcctcctcatcaaagtttcagttgaaaaacaggtttgatgtctcctgacatgcacttgatagttccgtgtttaatttctaacacgctcataatttttttcttaaaaatgtttagaatgacgtctctccctccaaatctttttttcttttttcttttaggtttgatgtgtcctgatgtagttgcatcatgcatgtagagcctttccctcctgcaagactacatgagctttcagcccagcgaaaagagaacctcatgggcttttgcattacaattggagtcccaatagaggagcaatagcactgtaaattggcccccgtctcgtgttgggttgcctaatgaaagagagataccgagatgggccttttcgccttccgcttgcaggcccaaatgcccactcaatgagtcaacctgagtcaaattttgtctcgactgaaaactggtgcagtcgaggcaaacttactgaaaaaaaattagacatatagtttattccctagttcatgcatacatttgaatttgatagcattatctgttcgtgaacacttgtatatcctcacgtttcctctgctacaagcatccatttcgtgacaagtagttgatcgagtgactagatcatcttctgagtgggaaaaaaagagtactgactagtaacgatcgatgaacgaattcagaaccagaaatcaaggattcaggagggaggcttgcctgccttagaagcaactccgcacaaatacccagctcaaaaaactactctatagttcgttcatgtagaagagtacaaacacaggtcgtcgccgttcagcgcgaacatcagtactggccacgctctccaatgacaaatcagattaaacttttaacgccccgaaaagctatgtacagcttcttcttcagctatctgcctagctcgatctaaaactttcaggggtaaaaaaaaaacacgaaaaatccaactgagcacggtaaagaagtgtcaagttggtgtaaggattgaatccgataaaaggctcagactctgtcaaagtaaacgcagtagtcacttggtcaggtgtagtagtatcttctgccgatatttgcagtaagcaaaaactctgagaatggatatgatgctgagatcaaaggtgacaacaaattgcaggagatgaagccaggtaaagaacagttggcagttcacgaattcgatcctgcgttggctatctacaggcgtcaaagacgtccacgctttcatgcttgcagcagcgtactggagtagtgtgatgcatttgtttagaaccctaacggactctactgtcataagccaacaacagcattaactgcgatgcatccaaatggaatctcaattagcagctatcagttgtttgatcgcaaatgaagcaaaccaacc

SEQ ID NO: 46107 - DNA, 252 bp, Oryza sativa
atggaatagaaaagataaaggaattagtgagatcaagggggagaatattagatggatctccctccccttgagcccaacggatcaagggggccttgacccgcgccgtgatcgggggcgcccagcccaatggctggtgggcccccgtcacactgtgccatataaagaggggtggaggacgggacggtacaacgacacaaggaacgaggtttgtcgccgccgccactccaccccataaaccctaaccgatcgagg

SEQ ID NO: 46108 - DNA, 1501 bp, Oryza sativa
  unsure (1)..(1501): unsure at all n locations
gattggttttgttagtttgaatgcttgtcttggtaaatttatttctttaagttagattttaattctcaggagtttaatcatcccactaaaagtgatagtattctattttatttagttaagcaatgaaggttctagtccctcctcccttcaacctagcctccaaacgtctcacggctagtacttactagcgagggaccctacgggaggctagtttgatacgaactgtaactttagggctgatcgatgaatagtttgattactaacagacttctcaaatattcatgtttatacgatgaatggattaaagtaatttctccttgagtggatcgaaaactttaaaatgaatcatgcagtctagtttgattactaaaagactgtctcaaatattcatgttttcttctaagagatttgttccggtccatcaaaaagtatctcgagggaccggtatctcacggtaccaaatcgtttccgatcgttggatctacctgggcatgatgggcattatgagataccggtacctcgaggtactttttgttggacnngnaacaaatatcttcttctaatcgtttcattcttgctagaaaccaatcaaaatatgatacccaaatcttattgtctagtttgtcttgcacatttcgcacctattggatgcactcattaaaacaatggcaactagattgcgtccaattatgaggaacatatatattccattaactggtgtgcatgaccaaataaatgaatcattggcgacttgagtacatcactcctgaactggcccgtactttggcattcattatacctatactttcaacatcatactcttcaatgattctgttaggagaaaacacagctcatttaggctctgttcgtttcctggagttcccaactcccccatctcattttccgcgcgcacgcttttcaaactactaaacggtgtgttttttgcaaaaagtttatatacgaaagttgcttaaaaaaattatattgatccatttttgaaaaaaaaattagcaaataattaattaatcacgtgctaatggactgcttcgttttccgtaccggagggatgggttcccaactcaaccaaaagaacagagccttagtaatcgggagcatgtaataatttctatagtatatacttttatcaactgcaaagtcccttatcatgcaattcaaagtttttttatatatgccaaaggttatctgaactaatatgctcttcgtgcttgtgtaggattcagtctgagaagttcagagatctagcagatgattgatcgagctgacgacgtccatgctgaagtccttatctgaattctgaaagtgtgtgctttgggtctgcaagaattaatactaacactgttgcttgctgaagctcatagaaatacagctttgatcgaattggttacagaaaactagcacacggtacttctcaattggttatcatactggttgttaaaacttatctcgactagctagtttgtttgtttacgatacggttttc

SEQ ID NO: 46109 - DNA, 1501 bp, Oryza sativa
gcaagatgttgtgtgaagaagggcgagcatgtagattgctaagctgacacgtggtggacaagaatgaccgacgtgactggtctaataccggtcatgtcgtcagcagacagccacgattccacgtcgcgcctgcttccggcggaagtggaggtaggtatgggccgtcccattagaaggtcattcggacggcaaccatacaagtctccgtctgtttatgaaaaggtggggtaagtccccacaaaaaagagagaaatggtgcatgtggtatccccttaagatataaaaggaggaccttgcccactgagaggggggactggatttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcagactcatacacagatggcatatcaaagaaccagaaaaaacatattcaatttttataatagtaaagatttagtaaaacatttttgatttaatcggtgaaacagcgcctcctggtaattcaggcccatgtgctcttgtcatttcggcctatgcgtgtaacttgttttatattttccttcctgattgtagtagcacgtaagcagcactaggtgccgcgtcgaatgaaaaccatccacaaatatattcccaagatgattggagtcaaattgaacttgtactgatgtggaggaggaaggtgttgttgcttgtattacggatttacggtatagggagccaacagcaaatcggactatggaacatgttgaggaatacaatatagaccttcaatttactagaacgtacgggctgaaatcaatcttgggtttctactggtctaggcctgtcttgcttatgctgttcatggtcggactgtcttgggcccgagataaactgggcgtccactctaggcctactaacgtgggccatatccaggtcttgggcctccactcgaggctgacacacatgggccgtattctgtccttgggcttatattgacagttaagtcttgagaggtgaagcttacactgcacacagcacacagcacaaccatccgctcggcgctccatcgatcagcggcggcgggcgacgccgcgacgagccctaccaggcggcggcggcggcagcggagaccggagagcgagtcttccggcgactgaggtgaggcgagtgtgtcttctcggttgttctctttgttccgtgatggcttttttggacgtctcacctttctctgctcttgcgcagcaagggcgctcgccacctgttcgacggaatggctacgaggcgcgacggcggcaggagacgcgagggactcacggccgaggaga

SEQ ID NO: 46110 - DNA, 879 bp, Oryza sativa
aacggttaaatatatgctaaaaagtcaacggtgtcaaacatttcgaaacggagggagtatgtcgggtcctaatcgtgtgggatatgtatgatagaaggccgttgaaaaatgatcgataaaaaattaagaactaatttataggtaaaacttttgtatttactcatgatttaaaatccaatagtagtagcttttaaattttaaattttggttgtgcaggctgataaaatatcaagaaaacgacgagggacgtttttttgcacatgatgggtgtagacaaaaaattgtgaagcggagataataactacagaaaattcgagattttagcattattattgatttattgtgtggctcaaatgggagattagaccggagaaacaatgcatgccatggtcaagattgagcagagtccatggtctatatgcatttgttttttgaactgtggtctatgcatatatacatccaaagactactaaacttgtgttacacggttttgaacttggacaagtatatacaagcatgctaatagccagctagtgcttctagtgtccaagacacagagtttcgtcaccgtggagtttaattaggtctaaatttaggtcttcatggaacattccgttaaaggtgccttctttagaccaccttggttaaactaattttacaaattattacaatggctaaactgattaatctaatgttatatattttatctctttgagaaaactaaaattggaccgcattgcaagctaactagacgttttttttttgcaagctttctctattaattcaaaatatgtaggtcagtggcggatcgagaaaatcgatttattgatgtcataatatgtctattggtgttatagtatgctaattatatttagatca

SEQ ID NO: 46111 - DNA, 1501 bp, Oryza sativa
gccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaatggtatcagagccaggttagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggagggggggaggggcaaagaggcaccgccgaggagccactcgacggccgcgcgcgcacccgcgggtgcacgcgcgcgccggcgagggggcccgcggcggcgccgccatctccgtttttcggccgccgctctctctcacacggtgggggctagagacggtggagggagcggagaagagaaaaggaagagggtgcaagggccgatggcagcggcgacgctgctccgctcggccgctccacccggcggcgcgctagagaaaaagtgggcgcgcggcagcgcgaggtcgccggccatggcgcggcggtgcaagggtcgccggcgtagatgacgccactcggcgcggccgcacccgcccgcaagagagaagaggctagggtttcggccggccggcggctggggtcgggtttttgtccctccgatcttagcgcccggccgtccgatcgaaaccctagcgatcggacggccgacggcggccgggccgaaagcggcccaagtggggagcgcgcggcggcggctttcccggcccaggcccaggttgcggccttgggggaggggagggggcgctcgcccgcgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaactttgaattgtttttgcatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctact

SEQ ID NO: 46112 - DNA, 1501 bp, Oryza sativa
ttagtctcagtcctattacgtttggtgatgcaaagacgctttagtgactgggaaaaaatattgtagggggtggaaatcgtacagcaattcatctgaaggtcctccagtacaggacagtttgagaaatcaagagcatggttgtccagctttacagaccgaagctgtaaggtggtcaagtgtttagagatgagaggcatgctcaattccagcggggctaaatgttcagattgaacgaggaccctgagcacccgagccttgcacatgagcgcatgcctgatccatagttcagcatacttgacctcgtagatacaaggtctgggcatcatggtaggccagtatgtgtaggtctggaactcgagctcatcaagaggcaccgggtcgcgcaagagaagaagattgttgacaaacttgttgaacctctccacacccacccatctgtgtctgatgcgcagcacgggggcggacctccaaaggttgcgccagcggcgggagagcagacacgtccacacggcctcgtgcgctggtaggaaggagagaacattgtggaggatctcgtccgggagggtgctaagccagtcttcgccgctgttctcctcggccgtgagtccctcgcgtctcctgccgccgtcgcgcctcgtagccattccgtcgaacaggtggcgagcgcccttgctgcgcaagagcagagaaaggtgagacgtccaaaaaagccatcacggaacaaagagaacaaccgagaagacacactcgcctcacctcagtcgccggaagactcgctctccggtctccgctgccgccgccgccgcctggtagggctcgtcgcggcgtcgcccgccgccgctgatcgatggagcgccgagcggatggttgtgctgtgtgctgtgtgcagtgtaagcttcacctctcaagacttaactgtcaatataagcccaaggacagaatacggcccatgtgtgtcagcctcgagtggaggcccaagacctggatatggcccacgttagtaggcctagagtggacgcccagtttatctcgggcccaagacagtccgaccatgaacagcataagcaagacaggcctagaccagtagaaacccaagattgatttcagcccgtacgttctagtaaattgaaggtctatattgtattcctcaacatgttccatagtccgatttgctgttggctccctataccgtaaatccgtaatacaagcaacaacaccttcctcctccacatcagtacaagttcaatttgactccaatcatcttgggaatatatttgtggatggttttcattcgacgcggcacctagtgctgcttacgtgctactacaatcaggaaggaaaatataaaacaagttacacgcataggccgaaatgacaagagcacatgggcctgaattaccaggaggcgctgtttcaccgattaaatcaaaaatgttttactaaatctttactattataaaaattgaatatgttttttctggttctttgatatgccatctgt

SEQ ID NO: 46113 - DNA, 1501 bp, Oryza sativa
  unsure (1)..(1501): unsure at all n locations
aaaattggaaaaaaaaagtgtcgattgtcaatacaactccggctgggatatatgatatgatttggggttgggggaggaggaggagaaaggggtgaaacggggggcttcccccagacgctctgtaggcggcgaggcgctggtattgataaccggaacggtacacacggaaaatagagcaatcctttagtacattattaattaattattagctccctctatttcataatgtaaatcattctagtattggctacattcatatgaaacacacgttatgaatgacttaacatattaatatgcatccacattcatattaacttctatatgcatgttgtcggtgacatgggatcaggagtatcatgactagaggtttgaggcagacacaatcgcatacgtggcctggtacccccgagggacgtcgggcccgagggtgatgcattcgccctcctcttagtccccccgagggggttgggccgcaccccccttggccccgccggcccaggggccccgaccccttgtgggtttttgctccgggtatggggtaggtcagnacagccggccccacctaaccacatttattgcggtttggctaagcgtgtcacgccgcatgtaacgcagtgcagtgcactcgtttatccggtctgtgaccagtcacagaccggtcagatcgtgggttaggtggcgacaggcgatctgatgcacgcctcgccccatcccgtcaggacgagggcttctaggcgctcgtccccagctggagctagcgtgttacctcccagagatggcacgttagtcctggtcagatatatgccaggcttcatcctaaaccattataggcaagatgttgtgtgaagaagggcgagcatgtagattgctaagctgacacgtggtggacaagaatgaccgacgtgactagtctgatactggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggggtaagtccccacaaaaaaagagagaaatggtgcatgtggtatccccttaagatataaaaggaggaccttgcccactgagaggggggattggacttttccagattagaaacccaaaacaagggagaggctggctgatactttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaa

SEQ ID NO: 46114 - DNA, 697 bp, Oryza sativa
gtcacatatgcatgcgcccgcgcgcctcggtttagcagttccatgctattttggccggcccccttttttccggtcgaggcacgtactgtactgtactacgcgctcgctctctctctctctctttcccgtccttcctcacatggtcgacccgtcgccctctcactgtgctggtcctgcacgccgttttcgctgctccccggcgaaattttgttttgcgcgtcgtgtacactccatatgcgtgtacggtgtaatggcacgtgaaaaatttctctggagcaccggatatatatatatatccagatgcactggtcgacgggctcgattattattacacagggaataataaaaaaaaacgaggatggatgcatgcatatgaatgcatcgcacgtcgtggcacacgggttttttttgtatcggtccgtgggggctcactcactcacacgctcgatttcttttgcctttgcttgttgtttcttcttcctcctcctcctcactttgagtgtcaaaaaaaaaatactagtacatgagtgagcttaaagtcgaagcaatcacaagggaggcgtgcatcagtacatgcatgctagcaaccgagatacaggcttaccgacacttggtcctccaggatgcaaacaacaaagttcatagctcgatagattgacttttctctctctctctttctttcctttttgcttttaga

SEQ ID NO: 46115 - DNA, 1501 bp, Oryza sativa
gcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactcaggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacgacgcatgaagtggatatgcggttgaggcgatcgaaacggattgtatcgtgcgcgcgttaattacgctcgccgaccgaagcggcgttgccgtatctccgggcgagacgaatctgctcgcccagattcgcgcgctgctcaagtggtgtggcagtcttgaatagaccgcccattatggacaaccaaagttaccaataccaatgtgcatggattgagaccgttgggtattttgcccaactacggagaccggtcccacccgtcaccaggctttaggggtggcgtcacacctgaccgcttcccttgggaagggaaattgctctggcataacgccgggggctactgtcggtgatatgggaccgggagtatcatgaccagaggcttgaggtagacgcaatcgcccgcgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggctttatcctaaccattacaggcaagg

SEQ ID NO: 46116 - DNA, 1501 bp, Oryza sativa
atctaatcctttgaaattcctatggaatggataatcctatagagattttggaggaaatttagcaagagcttcaatctcttgctaactttccttttgagtctatctctctcatccaattcctgtgtttttcatgtggttcaatcaaacagttattcctgtgttttgcaatcctctgtttcatacttatatttctattaaaatcctacgtttttcctattcctatgttttctcaattctgcgcagggccggtcctgagtttccaaaggcccggtgcgaaaataaacataggggcccttaatatattatcccttaatatattatctaaataattattaatagatctatatatatgatatgctgctgataaatacctaaattacatggagaaataatatttatatgaaaaacctcatatgtataaccttaaatttgtttttgggtacgtatgtatttctagatgcaagtattgatgatctaccaatatcaatttctaaatttcactacaaaacaataaacctaaatgtaaaatcttactaattaattgagcgtgggtggccggatgtgcgggtcactcaagcgcaacctctgtactatacacatctaattaacaagcagaattagaaagctattaatccaacatagccaaattacagatgacaaacagatagcatggaaatttaatttgcaacaaacgagagtaccacaagaacgtggtggtgttgctactgctcacctcctctttcacatgtagtgcagtagaaagcaacctcttcaatattcagtgttgaagatcgatttaaagttttgcacttccgccggcggcagcgtcgtcgcggcaggcgacagccgactgccgatggaaggcgcgtggatgcggcggcgattggaatgtagtggatgggattcctggatggggaacgaacgggataaacggcaggcaggtgctaatgtcaacaacacgcgcggcggcaatctcgcttgtgtatggtggaattgggaacgacgtgctgcggcgctgtgagcctgtgacctatatgatacgatgcctcttcgtgtgtgctgcctttctacgtactgggccaagggaggggggaggtcaggtcggggcccctacgacctgggggcccagatcggctgcactgctcgaccccccgggccagccctgattctgcgattaaaaggggcccttaactgatttatctctatcggcaagacagcttgtacgccgtacgcgggccacaaaaccgtgaccgaaactccaacggctgcagaattttttttatttataattttttttattaaaagttttacaaaaataattttccattttgaaaattaacggaaatagtcgcctaccgcccaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcc

SEQ ID NO: 46117 - DNA, 1501 bp, Oryza sativa
acacacccacccaccggtgtcaggccaggtcggcggcctctggctatcacctggcgctcggtttgatttgttggtgacacggcacggtaacgggcatggggcatgggctgatggctttgccggcgcgcacaatctgttgcaacattgcaagttgcgagtagctcgagaggagagtaactcgcaagttttctccgtgatgagctttcaacgggcggggagagcaacgcgattggcctcgtgcaaaaccaacggcttgtcccgccccaattattcccttcccatgattggacagcacaggcatatactgttgggaaaaggctgcagaactatagcaagatccatccttcacacgttcaataatatcaaaacactttacaatgctagtagtactaccttagggctagtttagttcccaaaaattttccccttcacctatcacatcgaatctttggacacatgcatggagcattaaatgtggacaaaaagaaaaaccaattgcacagtttagctataaatcgcgagacgaatcttttgagcctaattagaccatgattagccataagtgctacagtaacccacatgtgctaatgacggcttaagtagactcaaaagattcgtctcgcggtttccaggcgagttctgaaattagttttttcattcgtgtccaaaaaccccttccgacatccggtcaaacgtctgatgtgacacccaaaaaatttcttttccccaactaaacacagccttaataaggtgacaaatccaagatttttctctcttatattaatactacactgctaaccaccacaaaaaatgcattgtacaggaaaatattaacaagaaaagctgagatcaaggtttctcagttgccactcaagtaggggtcgaattgcgggtgccctgagcaagcttccagcaatccagctacaagtaccagcgtgcaaagacgtctgatctgagtctacctgcacttgtctttgcactccttgtttagatcacgcagatcttctagagaagaataggctaggacaaccataaaaaaaaaactagagaagtagccctctgtcgcaaaaaaaaaatcatacctatgaatctggacagatgacacatgcgtgcccagatttttagctagagtttatttttttagggacagagtagtactacttcctccattctaagaaaatgaatatataactgaatatgatttagtactacagtacaatgaatttgacatatccagattcgttgtattagaatatatcatgttaatcttaaagggagtacctatacatctttcgaaagatttttatgatcgtatcacacagatttttaatatttggattaaaatccgatagatataataaaaagcaaaaagcaattaagaaacaccataatgaacactaaattaccatatcctcaagaaaaagaccaaatccaatacaaaatttaaaatttacatgcgaagattcaaaaattacagtgtaacttacaaaagttacagcat

SEQ ID NO: 46118 - DNA, 1501 bp, Oryza sativa
gacccacatgttgcctcagaggccatggtactttatgttcacttctaatgaaagtgctgctgggtatgcatatgacccgattctccgcaaatggtatgatttagagcttccatgcatagataagagcagttgctttgtctcttcttcttgcggattagtttgtttcatggacaatgacagcaggaatgccatttctgtatctaatcctatcacaaaagattgtaagagaattttggagccccctggtgcaaagtttccagactacagcacaattgccataaaggtagatcgttcctctcataattacaccattacattggcaaaatgcaagcaagttccagaggattacgtccgatgggatttctctttatacaagtatgactcacagagtagttcatgggtgactgcggttgaggaggtgttcattggttggagagggggtgatgacagcgtgatatgtgatggagtattgtactgtttaattcactccacaggcattcttggtaatattgaaccgcgtcatagcattatcatgtatgaccttattgctgggccttctaaggcgtcactaatgcaatcgtcgatcccagcaccttgctctctcacctgtggacgtctgcttaacttgagggagaagctggttctggttggtgggattgcaaaacagaacagacctgacatcatcaaaggaattggaatatgggaacttcacaaaaaacaatggcaagaggtaggtcgaatgcctcataaattatttcaaggatttggtgagtttgatgatgtatttgctagcagtggcacagacgaccttgtctacatccaaagctatggtgcaactgctttgcttgctttcgatacgaagcagaagcagtggaagtggtccgcaaaatgccctgtgagcaaaagatttcctctccagcttttcactggcttttgctttgaacctcggcttgatattaccacttaattgtaatgccttccaatggaatcaggttggcagtcctggtctttgtgaatatatgcatgcttcattagattgttgcgtcacatgcaatgtgctctcctttgcttatcatcccacattcgtcctgatggatgcaatttcctttgcctcttttcattggattaattaatctttagaatgttgatctctctctctctctctataataatgcctgtttacaaatgtacctctattttctttaaaaacaatgcatagatctatgctatttatcacatttatctgaattctcaagttcagccatgtactgcctcgacaaaacctgcatacaatgtctttgcttgatgcaggccttagaacctgtccatataaactgaatgagctattgtccttacagcatgtctagacagataaattttgcagcgccataagttacatgtcttttcatcgcgcaacttcctgtatgtgatatctaaatttttgtcctttgcggtctcaagggacaagttcaactgtatgcgttttgtttcttgtgatact

SEQ ID NO: 46119 - DNA, 151 bp, Oryza sativa
caggttgcagggagggcataatcagcctacttgcatgctagggggaaagttatttttccaatccatgaacactgacattattcagcggtcagtagtttcatatcttctctatgggggaaaaaaaagaaggatgagccgaagaggcacatgc

SEQ ID NO: 46120 - DNA, 1501 bp, Oryza sativa
cacatcaaaactttcccacacacacaaacttccaacttttccatcacattgttccaatttcaaccaaacttccaattttagtgtgaactaaacacatccttattattgtagtttggatcatcataaataaacttttctatgtatatatatcaacaacctcaaacaaatcggctccagcacaccgccgaactcctccatctatgtgcagtctatatatttgctagagtggaggctagacatagttagaaaaaatatttgggtgatccatatttaaaaaatagcaaaaattacctagtacaaagtagaaaaaagaaaagttgatttaagggtgtgtaaagtaacattttgacaataaaagatggctcaaattacaatttactcttaagtaaacctccttactcatatttggtgtttcagacatattaacacaatcatttaaatgtaactttgacatataattaatattatcaaaaatatctaacaaagttatgcttttatgatttatgttacttcaattttggcaaaattttacacttttgaagtttacttatccaatgtaaataataagtgtcttatgttattacactatataatcagaagctcatcttcaaggaagtaaaaccataccatctaaatgtttacaaagatcatcaagattatttgcatacgaaattctgatgatcaccacgtaaaagggcttccatggattaaaaaaaaaaggcagaaatgatgtagaaatgaccgtttgagggaagcacataaggaacacatgaataagaagatatatcgataaatgattttttacgagactagatctcatgttaaaattcatccgaaattccttctctctccgttttatattataagtcgtttgattttttttagagtaaagcttcttttaagtttaaataaatttatagaaaaatataataatattttcaatataaaacaaacatattattaaaatatattcaatagtatatttaatgaactagtttggtgttataaatattgctaattttttcctataaacttgatcaaacctaaaaactttgactaaaaaagttaaacgacttacggagtataatattaaagagagggagtatgtcctaagccaattcaaaggaactttgtagaattttggatagcgatgactttcgccccttttcccttttctcatcgaagtccgtattgtgttagtttcatcgtcttatctttgcaagcaatcgattggattggaagttattttcgaacgtcctaagctcctagctgtgcactatccctctatatgatctcttattaacttgtctactcagttaagtaatccatgtatgagcaacaaggacagttctaattaagaacagaagccatattcgtcattttctccgaaggagaaaacacggcctcaatacattgttgcctacactgctaagtaatccctccatgagaacaacctgttgactgaagttccatcgctggcttaccggttactactacgcaa

SEQ ID NO: 46121 - DNA, 1332 bp, Oryza sativa
gcagctgttctcatccagacaatgagatcctcttgctcactcaactgaaacatgaaggagaattcagaaaaaaaaagaatgatgaaaatgaccagtctagtgtgataaagctgtaactaaatttacttccagcagccgattataggccataatgcttattaacgataaaaatataatttatagggcaaaacttttccttatgtgtgtttagcgacttaaaaaatcaatatagaaaataaactacgataaaaaatttttaataaactttaaaattaagtttgaaaatttaaattttagctatgaccgataagatgaagagcgaacaatggagagccacctatttaactgcagagaaagcttgctcaactgaatatggaggacaattcagttcaagaaaaaagaaagcacgagaaacgcctaggggttttccggctagctcaataaggtggtgggctaggcgacctgagttcgaagcctcactccttctaattattcgatattatgttattccctaatattcgcgttagcacgaaaagagcagtctagtgtgataaagatgattgatttgactgcacttactggtaatttctcatttagctgaccaccacctatgagcccacccttctggaaattttcggggaaaacatcactgccaaacttaatggtcctgtcactgctccaagctatgttcttcttgttcacttggacagtcttcttgttgacagaaaatgtgaaggtgtcattgaacaggctccatgctatgaggccacacggaacaataggggctccgccttcactgatggcttcaggatcacaagtttttatcacacttgagaactccttggaccgcagctgtttatcgctccggctcttgacatatctaagaattaagattgttgtacgttagtgttcatttcggtaccacaatggccagttaattaagttgaaatcactcatccaggtctagcgtatatataccgccgatggttttggtagaagttttccagctggtagtaaacttgtatggggcctttcataggttttggcacctgaaaaatgagtaaagaaaaatcattatttactggatactataaatctggtaagagctaagggcaaccatgttgtgtagttgtgtcatctaaggctcaattctagtgaacatagacctgtttagatgggactaaaactttaagtccctatcacatcggatgtttggacactaattataaatattaaacgtagactattaataaaactcatccataatcttggactaattcgcgagatgaatctattaagcctaattaatccatgattagcctatgtgatgct

SEQ ID NO: 46122 - DNA, 820 bp, Oryza sativa
ggttaggtgagccccactgtgctcacctaacccatacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtacaaaggcactgaggaagggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 46123 - DNA, 1501 bp, Oryza sativa
gctcgtcctggcgagttaccaggctagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagagaaataagaatatgcatatgttgtagcccccggccaaccctgcacgcccgaaggggggtgcggggttggcccgagcccgaaacctgactcccgacccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccggggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagt

SEQ ID NO: 46124 - DNA, 288 bp, Oryza sativa
tactggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaaagagagaaatggtgcatgtggtatccccttaagatataaaaggaggaccttgcccactgagaggggggactggacttttccagattagaaacccaaaacaagggagaggctggctgatactttgtagc

SEQ ID NO: 46125 - DNA, 1501 bp, Oryza sativa; identical to SEQ ID NO: 31261

SEQ ID NO: 46126 - DNA, 1501 bp, Oryza sativa
gttcacgccggtggcatcatcagaagcatatctttattcacttcattttatttctaataagtagtggccgtgcatgatgctgcactacttggatatatatatatttctttagactccatgtagtaaggactatgtaattatgtatttgatcatctgagctccattatgtggagctacatgccctctgcctataaatcttgggtagaaattaaattctttgacacaaatattaatgtgctttttttatagagtagccaataaaaatgccaaatacctatagctgttgttcttttgtcagacgtagtgcagtgacatggctttcaacttttcagtttgtgaagcacctttctgttactgcacttttccagtcctttggacattacaattgtacgaggacaaacctgaaaaagaaaaggaaaaggagatatgagaataatgcttattctcaatataaaaagcaagtcatatatagctggtacaaaggcatatgattcatgtgaagtcgttggggaagagaacaaaagatgaatcatccctgtgttcgtctgaattgtatatgtggtttgcacataaatatgtcgtcatttcttgtaccgaaaacaattggacaaggcgacctgactaaaagtttttttgaaaacatgaattgaagctagaagaggacaatagaatgatttcacatgtcttgaaagtgtttaagtgatacttcgtattttctctagtctctactgttgtaaaagtgcaatcgtcttttttccatcccctccttctactgcgcgcgcaatgtgtacatccgattttttttcacatcatatgcctaacctcttagctcatccctaatcgaatggacctgcacgttgtaaggtttgaagaactacgtacaagtcaggattggtttgaagaagttgttttctccaagtaagaagtacacacaaggttcttccatagaagcaacgtccgtgcaaagattgacttaccatgtgcaagatcaactctgtgcaacaattctttctgaaagcaattgtaccaaatcctttttcttccatttcacacgcatcatgcttcatgccatgtactccctccgtcccaaaatataaaaacctagaactggatgggacgtgctgtccaaattcgtagtattagaaaatgtccgatccagttctaaattcttatattttgggaaggagtactactcttacattgttcaaatttgagggggtgtttagatccaggggtgtaaagttttggcgtgtcacattgagtattatatagggtgtgagacgaatttattaagcctaataaatccgttattagcaaatgtttactgtagcaccacattgtcaaataatgtagtaattaggataaaaagattcatctcgcaaattagtcgcaatctgtgcaattagttattattttagcatatatttaatatttcatgtatgttgtcagggttacgggttaggtataccctttacctttcgatatacgtcacatatcgata

SEQ ID NO: 46127 - DNA, 408 bp, Oryza sativa
tgataagtagatgttgttcttatagcaacgaaaaatattatgtgccagattttttttcctgcatcaatgtgttgattttggtatagcagaaagcttatttattgtttgcgttatttttcattacccaaattactctattgatgtattttggtttccttacaggatcataatattgctgattttgtatgatttgattcttgttgggtgagcccaagatgtctggaaatgacgataagtctcaggctgcagctgagagaataaaagcacaggccttatctgctgccaagggattgagcagaactcaagccgagcgagctgctgcagccgctgcccgcaatgtcaatgcttatgggcagaaagaagagggaccttcgcgctggcaggagaggaaggaggccaagagacaga

SEQ ID NO: 46128 - DNA, 1501 bp, Oryza sativa
aaaacaacttcttcaaaccaatcctgacttgtacgtagttcttcaaaccttacaacgtgcaggtccattcgattagggatgagctaagaggttaggcatatgatgtgaaaaaaaatcggatgtacacattgcgcgcgcagtagaaggaggggatggaaaaaagacgattgcacttttacaacagtagagactagagaaaatacgaagtatcacttaaacactttcaagacatgtgaaatcattctattgtcctcttctagcttcaattcatgttttcaaaaaaacttttagtcaggtcgccttgtccaattgttttcggtacaagaaatgacgacatatttatgtgcaaaccacatatacaattcagacgaacacagggatgattcatcttttgttctcttccccaacgacttcacatgaatcatatgcctttgtaccagctatatatgacttgctttttatattgagaataagcattattctcatatctccttttccttttctttttcaggtttgtcctcgtacaattgtaatgtccaaaggactggaaaagtgcagtaacagaaaggtgcttcacaaactgaaaagttgaaagccatgtcactgcactacgtctgacaaaagaacaacagctataggtatttggcatttttattggctactctataaaaaaagcacattaatatttgtgtcaaagaatttaatttctacccaagatttataggcagagggcatgtagctccacataatggagctcagatgatcaaatacataattacatagtccttactacatggagtctaaagaaatatatatatatccaagtagtgcagcatcatgcacggccactacttattagaaataaaatgaagtgaataaagatatgcttctgatgatgccaccggcgtgaaccgagcaatctttcatgcagattttcgcctccacctactcccacgcacgcacgcaatgagcaatagttggttgctgacttgatccgagctttgacaaattcagtttggaactttggatgaatctgcaattctgacgacaaaagggaagggaaggacaaaaaggttttactttaatcttctttcactcaatgtctaaagtgattttcagagacatacaatgggctttatatctttcttttactcaacatctaaaatgatattcagagacaacacaatgggcgaagacctgtatttatctctgctctgaaagactgaaacagtctctgctccagctacgaagactgtatacttgctggtcatacagatccaggatgtgtattatttgcaaattcatcagaaagcatgactcaaccatcacacacactcacacgtaccatctgtcatctctttcgatgatatcattcaacagggtgacaaactgaaaacaaagaattgcaagaaagattggaatgaacacaacaggatgacccaggtatgatgatgattacagaaaactttcaggaagataagcgagccaaacatagaaattg

SEQ ID NO: 46129 - DNA, 1501 bp, Oryza sativa
tgtgacagtttagtttcataatcatgctaaacaatacctgaatacttcaattgtgtttatcaatttatttcaccatctttgcagaagaaattctttagttataatccacctttaattcttgctccttgtgcattacagtctaagtgagattcagagtgctcgaggaattgtggatgtgttggatgagatgttaaatgctttggaccacaggcaccctgaggtgacttttttaagcatcaaaatttagtgcagtgttgtataatccttgtatctcttctgtagtttcttttacttttaagagctttaatatgattgtcatgtcttctagacctttgtttttcccatgaaaaaaattatgcataaatcatgtgttttatttcatatgatcatactacagcatatttcacatgtagtgagctgagctgtatctgtgaattgtgcacagaagaggatgtaactattacatgtcccatcattgatcagatctatgtgtaatggatgacaaagtagtttcttgctaggctttgaagtctagtatattatccaatatccatttatatctttgttcatccatgttacctcatcagcttacaggaatgtgcgaactattttacttggtccatttgttcagagggaatcatgtttagcagcataggagactgagggcataagaataattaaagagggatttctaagcttttgtattttctagaacttgctctggtatctggctaaaaataatgtgccctaatattttaatttattatgaccaaacttgcactagtgtgatgtctctatgcgtctctgtatttaactattgaatccaccattccacccacctatgctctttttctctaaatttctgtctaattgcgcttcatgttgtagggtgtgagggaggaggtcattgttgaccttgttgggcagtgccgatcttatcaaggtcgagtcatggaccttgttagcaatactgggtatgttctattcttttactctgaaattttggttccatgtccttttcacattgtcatgtgacatattgtcttgtatcctctgcagtgatgagagccttctatttcaagctctcggtttaaatgatgaactgcagcgtgttcttcagcgtcatgatgacatcgcaaagggagtgcctcccggttcaggcccagctcctgctgctgctaatgtaaaccgaggaacagcccctcctaggcctactggggtttcattttccccacttcttaatgtgcaccatgaagacgatgagccagaagacgagttctctgttctttcccgcaggcaagctatattagttttccctattagtaccctttactaattatttttcatacatgctattgctattttaagctttggatggttgtggcaacatcagctgactgcttttaagaaaatgttttggtgatgcggatcatgttatgataccaagattcccggtctggttaggtttgtcatctgatgtacaaatatatgttctgtaggt

SEQ ID NO: 46130 - DNA, 1501 bp, Oryza sativa
ctgcaaatttcaaacctccttgatgaagttgaacgaatcataaattaagtattctactggcttctcctaatcgagaggctttatatagtatattaaattgtataaaaatcgtagcatggcgcgtcatcatcctggccataggggcttcttgacctatcagaaattcagaattaactgtttcagcatccgaatgtcggcctggtagtggttagccgctggtttagagtctgaaaacgaaaagaatcaatggcggaaacggtcggtcttcagatgggggagctttggacgaacggctaagagccaaagggaggctaaatctgactcgagaacgcattgcagccggccaggatctcaacatctggtgaaagctgcgtcgcggaaagtttatgtttctttctgaaccatttctttctcccatcttctcgcgtcgtttcttcatgcagccaatcaggttagcttgtcaaaattggcatattcgtcgcttcaccggctaagaaaaactactacctataagagtatatcacgattgaaaaaaaaaactgccctttcttttaactgaagaatgtctatgaacatgcaaatattcagagttatcatggccgaccatgatagttttgcaaaaggggacggcaaaaaactactagcacacagaatgtttgcagagaggcctttctgtgttgtaggttaggtctttaaataattccgtaaactacaaggatgatgacataaactgctctgcggagaatatgcttaggagataaacacactcagttatactcgatcaagatcccctgctcgctgctttctgaaagcataactccaaactgaaatagagctctacgtagcaactttgtcagtggagaatgtagcccatcatttcaagtactggacagcaaatatgatactgaacagcagcatgattcttcgggtttctttctttgattagcgagacccaaaccacgtccattatccacaaaaccaagtgctccatcggtttgactactactatttccaatttttaatagatgataccattgattttgaaaatatgtttgatcattcatctaaaaataattacataaatattatttattttattgtgacttacttatcattaagtgtaatttaaaagtaataacttacattctttttatatttatacaaaatattttataagacgaatgataaaatgtatatatacaaaatatcttcgtgaatctcaagatatataggttaggatgtatatatgtgtgttataggtgagtgtaacgcatgtttatatgatctcctcctccgttccaaaaaaaaaaacttaatcctagatttgaacctgaacacccaagtttggttttttttttatggagagagtaagcgcttaaaaaaaaaaggaagtatacatcccacggacaccgcagtggctccaatgctccatcaacgccgtccatccgcaacagtcggctcatcccagccaccggagagctgaacggcggagaagacgacc

SEQ ID NO: 46131 - DNA, 898 bp, Oryza sativa
aagcttcacccccccccccccacctgaaaaacttttacatttcccatcacttggttcgtgtcttcttatttcttttttatctagattactatgtgaattattgccatgaattgcccactacttaattattgaaatatcttcctttccttggtataagccggtctggctgattgcgttgggtaaacaaactctattttattctaatatattaacatgcgatccttttgcgcgttcgtgaaaattattaaaatgaattagatattttgagaaatatattttgaaaaactagaacaaatagtctaagcaatgaagtagaataaagttatcttttaaaatgccgttttagagataggagcaaataatccgatccgacacagctgaaaagaacatgacctcgtagagggaaaaaaatgacgtgtcaagatatagctatgctagctcaaatgtcactcaagttgagccgcttttcaggcacaccaacgtggcaatgtagcacggtgccggcctgccggggcacaccgcgtgcgtgcaaaagctcgtgtatgtccgcaggggcagatcagaaataaaaagttaggggactcaacatacccagtacaccgatataaacatataatctcagtattaaactatgctaaaatattattatgatacctttagcacctatatcttatcaactatgataaaaaaattaagaggagggtttagggggtatctatgggttttgtgagactaatccccttgtacccacattggatccgcctgcggagcgcgtgccggtgcgtgtgcctgtgtgggctaaacgggaggagcgccgcgcgaaacgcggtgccacttgacacttgccggtagcattcgctcgctgagcaacgtacaaacgcgcgcacacagcacacga

SEQ ID NO: 46132 - DNA, 346 bp, Oryza sativa
gcgcgcgcgccaacgagaggataatgagatagagcgccgacgcacagaaaacggagcggtatattagcgcttgattaattaagtattagctatttttaaaaaaaaaattggatcaatatgattttttaagcaacttttgtatagaaactttttgcaaaaccgtttagaggtttgaaaagcatgcacgcggaatacgagagagaggggttggtaacatagagcaacaaacgtagactgagttcgtttcccagctttccaactacaaaattatgcgtttgttctcaaaaagtttctgcgggcggccgtcatcaccgctgctagctcgtccagcatcccaagcccagca

SEQ ID NO: 46133 - DNA, 702 bp, Oryza sativa
attcctgcagccccacatcaacaaggtgaaatatatcaaatctctttatgaagaaccaaatagcatcttttatagctctattcataccaaaaaatgtcagtacctatgcaggtaaactcatcaacgaacacctgatccttgggtgcactgtcatcgaagaaagggttggtcgcggttgctgtatacccatggatttcatcatacactgcacgctgcaccggatcactcagcacctgctcttcaacacctcatgttagcgttttgaacaaaaaagaattcaatgcaaaacacatcttccaagacaattgccatatgcaatcacaaggacccaaggtttcattgaagggttttaccgtgtaaacctcgttgatgaacatgcagaagtttgttacttcggggttgtccccactgaggtcgggatggcacgctttcatgcaactgtagtatgctttcttgatttcctcaggggttgcatctggcatctggagatgcaaaaatcaggggtcattattagcagcaaatccgtcgtctcaaaggaaaaccactatcagagtatcactcatcactcatcagaagttcagaacaattgtctgagtccactctgaaaaaaagaagcatctttcctccctcaccaaaagtaggatttttttttttacagagaagaaattgatctctaatgattccagtctaaaatgcacagtt

SEQ ID NO: 46134 - DNA, 439 bp, Oryza sativa
  unsure (1)..(439): unsure at all n locations
gggaagtagccccatgacctaaaaagattggagatatatgcactacaatgatctctccatttcagactttgttcctgtaagtgggcacaatctagagagcaggcattgtcctacagtatatcctatcagcctccgtgtgcctttgcaggaggagcagagaaaggccnnnnnnnnnnnnnnnnnnnnnnnncctttcaccatgcaggagcgagtataaatatcactgcacaatgatcagtgaactgtgcgctctacacatgaaactaaatgtggcacacggatagaaataggttgagaccatgagatgtgcagctgcattgctgggcaagttgtcctttggcagatgttgcagttcatcatcgatgcctgggggttaccagactactgccaaaggaaatttgccccggaattcatctgcacaaacacacacaagaaaaga

SEQ ID NO: 46135 - DNA, 1501 bp, Oryza sativa
ctgtgcttcagtcagggttactgtgtggacggtgcaaggtgaagtaagactgaagataatatactacttcctccgtttcacaatataagtcattctaactttttccacattcatattaatgttaatgaatctagataaatatatatatctagattcattaatatcaatatgaatgtgggaaatgctagaatgacttatattgtgaaacggagggagtacattcagagtaaagaaaataaataagtcagcgtcaaaaaagataatattgcccggcagcttgaggccctctttgtttaggcttagacttattggcctagacttttaagtcagcttattggcttatatgatttataagccagtggatttaatgtactaaatttagtggttaagtaatacatctacctcacataagccaaaaaaaacttatccaacctagcttttggcttaatagtgttagagtggcttatggcttcaaaaaatccaaacgaaaaagatacttgtttgtttaggtttagactattcgacttataagttagcttataaatctaaacaaagagggcttgagcatacttttgtaccatgtaacgatacacactggttacctgaagatcgggtgaggcacacgcttcatcagcaatctagatcctctgccgtactgctcgctgacatatgggcccgagggtctgtgggggcccatatgtcagtttgcagtactggtgagggtgtcatcagaggtttcagattttgactcgcggcgaactgaagctactgcgccaggagcacaggaaggagttccagtggtgcgagtgtactacgatgcactcatcttctcctcggtctcctcgttttcgttctgttccgagagctgcagttggacgagagaacacaatgattcgcctcgatttccgcgcccattgggggtaggagccctctctttcaaaaacgtttcccggtgtattgtgatatgctgttttcaatttttggctggattgctggtgttgtgcaccgaaaataaaccctcagaattcgcgtgaattcatccgcacaaactacagtgctatctggctgatgaagaatgcaggaagatcagatcgaacggagtattttctgggcctagcaatttcactcgtaggcccgtttgattcaaagaaaattcatagtaattttaaaggattttattcctataggaatttttcctatatagccatttgaatcaaaagaatgaatcctatgtaatcccataaaattcctatggaatgcctcttcccatgtaagttttggaggaaatttagcatgaggttttacctcatgttaagaatcctctgagtctttatctctcctcaaatttcagtgttttttctgcggctcaatcaaacggttatttctatgtttttgctgtgttttataatcctctgttttacacttgtattcctgtcagaatctttttgctattccttcgtttttttcattcctatgattataaggggccgtagagtctact

SEQ ID NO: 46136 - DNA, 1501 bp, Oryza sativa; identical to SEQ ID NO: 31277

SEQ ID NO: 46137 - DNA, 162 bp, Oryza sativa
cgccgccgccggcggcaagaagaacaagacgaaggggaagaagaagaagaagcaggaggcgcagctgcaggaggaggagtggtggagcaagggcggcgagttcagcgaggccggcaccagcagcaggacgagcagcaccaacagcactagcagcggcggcca

SEQ ID NO: 46138 - DNA, 1501 bp, Oryza sativa
ttctttcttgtactaaagggttttctaaggtgtttaggactcctagtatgagtttggttcctgcctgcctcgggtataaatagagggggagcatgaggcttcccggtatcgcttttgaaagcaattgagttgagttttgagttagggttttgagtttagtcgaaatttctgtaaggagtgctgtttgtgcacttcgtaaatacagagagaatcaataaagtcgtcatctacttttagaattcttcaatttatgtttcaccgggtttcggcggtctaaccggcgacacatcggcggtcagaccggcggcaaggcggcggtcaaaccggcgggtgaccttcggtcagaccggggacgacaacaggcgcagcagggattccagggcggtccaaccggaagatcaacaccagtcagaccggcggctacgcttcggtcagaccggcagatcaatctcggtcagaccgacttccgtcgatttcgagggtaacttttatttccactaaaagttttcggtttttgggtataccaaccattcacccccctggatcctacaacaccgattaaacgccattgcaacaatcaagctagcaaacatttcaacactcatgtcatgtacccttggtttattttaatcactcgcattaattaccaatcacttacaccgccatctattaacataataacaaaattttaatatatcacgaattatgcgtcatccgactcagacgtgatcacacatggtagcgaacacatcaccatttcaccactgcacacatcttacatattaatacgagaggtgtgaacagtagccattgtctcgggtttatgaagattttaggctgagtttgtcactcacaactcccaacctatactccttcgtttttcacgcgcacgttttccaaacatactaaacaatagtcttttaaaaaagaattacataggaaagttgttttaacaaaacatattaatctatttttaaagtttattttaactaatacttaattagtaataccataatagatcccttcgttttacgtgcgggaggtgaagatactaccattagtccatcgggttcacattatctaccataatgacactacttttataaacactgtcgtgcgggataatataaagttaagatcacgtaacgataatgatattatgatagatgattccgaacccaatggctccacgaatccacggtatggacctgacggagatgtacagcagctttgctgtgatgtacagttcggcgccacgccgtatatacacaaagtacagtgtagtttgtttataatttaattattattatttaaagctttgtatgtaatgtactccctccaaatttaaatcccgcttttaaatctctcaccaacgaccttgcttgcttgcacccacccgccatcgctttccctcctctcctcttctctcctcttcttctccccctccgcctcctcgcctcctcctccacatcgccattattacaccttcctctccctctcc

SEQ ID NO: 46139 - DNA, 1501 bp, Oryza sativa
ctttttcaaacatgagcttgactgtcctgggaggcttacgcccgaatttgccaaccaattcttcgtggcgaatccctttggtgaatgcggcgatgatgacgtcgtcggtgatgtcggagatcttgttacgctgttcagaaaatcgccggatgtaatctcgaagggattctccggacttctgaatgacgttgtagaggtcgtattgtgtgccgggacgctcgaaggtgccttgaaagttggcgatgaagtggtcacgtaactcggcccaagatccgattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccatcatacttctctattccagtcggcttgaagccggctggccaatccactcgacgcaggtcgtcggtgaaggctgctactccgtcaaggtcgtcgtcgtggcggtccggcgagtgatgatagcctcgagctgctcggcgctgtatgattgtgtcgcgaagatcgacggggcggcgacgaggtggtgagcgaggccgttccactcggcgctccctatggggatcgggaggtgagtgaacagaccgctcgtcgtggcccctgctcctgcgattggatcctgcgccggtgatgctgaggcttggatgacggtagtcatgagatcggaagtgggggactcggctgccagtcggcgtatggacgctttcggagttaactgggaccgaagccgcaatcatagtcttcgtctggttcaagatgttgacgacgtgatcggattgattgagctcgttttccctgagtagggtgtcgaggagggtgatcgcggcaaccgcattctgttgaggggtgcgaaaaaccggcgtcccttcaacatcttgctggccgatgagatcacgcgcccggcgccctgcttccaaagctcgctgccgtcgatcctcagcctccttcgcggtccgctcacgctcctgctgctcatgccgtaaccgttcttgttcttgtgcttgatgctcctcttccagtcggcggcgctcagtctcgcgacgcgcttcggtctcccgggcttggcgttgctcctccgtctcgttattggccatgaagacgccaaagtagagaggggtgtagttgtcatctaggcttccgtcgaagtcgtcgagatccgggtcgtggtagcgagagctaaactcgtcgtactccacgatgtcggtggggcgcgagtcgacggtgggagagctgtagtcgccatctagctgatccgtctaaaccgtgccgagtggttggaggatgacgccaacttccctgaagctaggcgaaatcggtattgaagccgacttccgcctaggcctacgggaaagagacgctgtcgtgatggagacggccgtcaaatcgtcggggagcttcatcaggatcggtgggtaagcccc

SEQ ID NO: 46140 - DNA, 1501 bp, Oryza sativa
tcttacactaacaaggatgaatcagactagcagagagagagtgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttgggaaaaatcaacatatgcccctagaggcacccggaccccccttatatatggggaggagtccgtgttacaaaagataatctatatccctaacggaatatgcagatacagataaaatacagtcgtaaccgactaagtcccagggtatttccttgatgcacaagttgagaaacaaacccgagatacacataaaatattctatctatattcggtatcctatattcagcccaaatatcatcgccgtgtagatatgggatatccataatctccacagtagcccccgagacctttgcagtcaaccatcatagcctgctcaaagataataatccgagtgcttcaaacttttcatgccaaggcctgccgagtagtgaagacgaagactgtaaagggcgaaaagataaagaatatggtgcatcgaatagatgcacctaattaggtatagcccccaactatgtgattagtcaacaaactaaacatatagttgagaacaaaataatagcataattatgcatcatatgacaaaagcatacgcggcgcctaaagaggcattccagccgactgcttttcagccataataaaagaaatccgagtggttaacactctaaaaagttcacgaatgaacacacttgacaggcatccgaatataagactctaaagattacccaccaaatattataaaaatcatggtaatgaataagtctaatagcctaggctatgactatttaccataatgaaaacaggcatataacataccgaggaaatgactatgataaaaacaagtcattccaagttaacccagacagcttttgtagcctaaaaaagcgtacaaaaacagcataacgcctttctgtcgggcaccttttaatttgcatcgcaataattccaaagaattatatgaccgcgtaaaaaggattttatcagcattgggcaacactattgtgtacataaattgccaaagcaaagaatgcctaagtccctaaggaacacaatgggccacgctgttaaaagtattgggctgaggtactgttcaggcctaggcccattcgcacctccgatacccttaacaagaaaacccgagatccaaacgacgcttcgtcttccccgccggaactctcgccattttccccactccttgctacagtacagagctgggccggcaaactagggttcaccattccactcaaatccaccttcaaaaagtgatcaaaatccttcccgtgatccaccgcctcaattcctcacctctcccaagccatccctcgaatcaaatcagcgcattcggggaaaatcga

SEQ ID NO: 46141 - DNA, 1053 bp, Oryza sativa
ttagttgttacagttcttaaaaatgatatttttgtctagaacatgtaacagttttcctgttgcaaaaaacagatagaaaacttgcaaataccaagttgtgttttcattaaaaaaacaagttcggtgattgggagtagagaagaaaaccaaagcttaaaatgtgaatgtaattgcagagaatgaaattgtagtgtaagcattgaaactgcaagcaaaacactaattaactcgagtgttacctgtgttctaattccattactaattgtatccccttcactgaccaaaactcatagtcaaccttgagcaggatgagctgctacagacccatggaagatgtgctgcaatatgaaggaccatcataagcaaggtagagctacttgttttttcttcaatttagtgagtcctacttataagtgtttaggaaatactgcctcccacaccatgtaaataaatttaaggaaaaaaggaggcaggacaagatgaagcgtttataatgcaaactattgaaaatcacaattcgtggatatgtgccatcaaatttgcttggaaactctctctctctctgtggagattatggatatcccatatctacacggcgatgatatttgggctgaatataggataccgaatatagatagaatattttatgtgtatctcgggtttgtttctcaacttgtgcatcaaggaaataccctgggacttagtcggttacgactgtattttatctgtatctgcatattccgttagggatatagattatcttttgtaacacggactcctccccatatataaggggggtccgggtgcctctaggggcatatgttgattttcccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 46142 - DNA, 1501 bp, Oryza sativa
aatgaaaaaatgtatagctatttcagtgaattgattgcagtgtagcaaattaaattattttatgacctgaaaaaacggacattaagtcaactgaatttcaagggtcagggcaaaccttaaacaacaaaagagtgtcatatagtgaaccaccagaatagttgaaaatataaaatttaaattatcaagaatcatcaaacatacagataatatatgctaatgacaattggcattatgggtaagctgcttaaaatttgaagacaagctaaaaatttctatcgtgtatgttattttggataagtctttgactgctttcaagttcagaatgcacttgaagtttgaattttatcaaatgaagcagagtacacaaggatatttaatatatattctatcatgccaataatatcaggaagaataacagtggaaatatttgacattaaggtacaaaagagtcacctaaacagaattccagttgtgacaattttaaggtttcccattatctgataggtagatggatcaacataggtcaaggtggcaaactgcacattgttgtggatgagatatatgactgaaggaacaaggtatagtcgtatactcctccactcttttgtcatccttggtggagatgaagactggcattccttccaaagaaagaagcttgagaaagacagctgtatcaagaacaggttaacatcagcatgcagaataaataaatagatgaatgttatctcttgagtgccttcagtaactaggatatacagatatcactgtaaacaatagcataaacttcatgtaccttgaagagttctgcgagaaatggaatggttgcgtagtcgtacttatatttgccattgctctgcgagagggtagtcaagataccctgcacatatgcaagagaattaaaaactctagagcttagaaaataaaccatgcaattgaaggaaaaaaacaagtaatggacaatttctagaataacttaagttaatttaactatgaccatgaagtctgctcgttaacctccaatgattgggttttctacatcaagttgtcagttttgttctgtgggtcattctggtttggcgcttggaatcaaacatttcagtaccatgctattctggtgtacccttctggagtacactactatctcataactgctgggcaagctccagagaagtcactcaccatcttaacctccctaatgccgcactatttctagcccgagattcttcgtcaggtcatagcccttggttgcgcgctgaagattggtcatgttcttgatttcttttgcatttaatatcttgatttcttcttctctttcttctcataaggatattttactcctattatttttccatttctggaattaactgtaagtagaattctgtttggaacaccaggaaatgtgcaaaatgaccataatggtctggatagttgtctagtatgaaaaatgaagggccatcttcatgccatactaaccgaacggaatgacacattcccgcaatgg

SEQ ID NO: 46143 - DNA, 325 bp, Oryza sativa
cctgcagcccatataccattccaaaccacgaacttaaccaaatattaaccggtaatagcatttttaattatgatgagaggggtgaaactaatcacaaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccctttgcacaacacaatccactacagcgcacctttcctggatcataatcacccccttataaacaaggca

SEQ ID NO: 46144 - DNA, 317 bp, Oryza sativa
aatggcccaccctctggttaaaattggaaattttaacctttcaaaatgggaaagttaccttccacctattttgataggaaatttttaaggtctagaatttgggtacgttacaatattatattgaattcagagtaataaatagaataaaagaaataggagaagattaccgacaactccgaaattcttccgactacttcttctctactctcttcctattctagtatacaatatagtacaatagagcctcttataattcagctcaatcttggaagtctgtgtgagagtgaatgaagcgaggtccttttatagggcagtta

SEQ ID NO: 46145 - DNA, 647 bp, Oryza sativa
cacccgcagaaggacgccgtcgccgggaggatgcgcgagccgttgctgtcaccaagaccccggaaaacatcaacctaacccgcggtgagtaccctagagcctggaagaccacatgcatgcatccctttgagtacatccagtctatagcacgacatgcaccaccacccgaaaacttcctctgctcggactcgccgctggcgctactccgatgtctgctgtctgagaaatgtataggaatggaatcgcaatatcatgcccttcattttctattttggtcgcaaccccaacggagtcaccgtttgtcgccgacaccggcgagcagagatgccgcccatggctgctctgctgcttatcgaatggaaaaggagacagggacctcgcttggagaatttaaacaactataaggttcattatgtaatgttttcactcaatgacatatgggcctaggactgcgggtttatttactgaaactctaggggtctttttgcatattggcctgggactgacaatgcacacctaggaacaaaatctgaaattataaaagaacagtaactaaaacttgtaaaatccatataaaattaaatatagctcattttaagatgattcaaatttctgtgaactcaccaaattgggaactttgatgttat

SEQ ID NO: 46146 - DNA, 1501 bp, Oryza sativa
ctgtcggcagtctgcattgccttacttaagtaggattttattaatagggtatccacaattcttcactgcactgaacaaaacgatgattgtgcctatagtcttgttcaagtcagtgcaaactgtgaactcagattgctagggtggctcatactgagataaatttgttaaggttacattgcacagcactagcagccttgtacacgaattttaattacggttcctagcaacgaaatgtagcatgggaaaacatattaagcagatatatcatatttcttaatgcacataggttcagcagaattaaccactttatcgggcgtcccattgcagcatcaattcaacagtgcggtgaacaagcaaagtaaggtcagaccacatcacctcgcggaaggtgaaccgctcgttgaagagcaatgcgagcacgaaggcagcggcgacgagcaccacatggcggaaggtgtcctgatccttgtcgtacgtgcgccgcacctgtgggtggcgccgcatgcaccacacgatcgccgccgagctggtgatgaaaaccaccttcatcaccgagttgtagagcgagatgtagtccgtgaacaggtccatgtacctcgccacgaacaccagcatgtacagctcctgcgtcttcctcgacacccctgcgccaacacacagatccgtgagcggagaatcccccccacccccaaccaagcggccgaaaccctacccccactgtacggctcgggctcacctgagcaggatttcgtggcgtagatcttgagcaggaggacgaggaccgagaagaggtgggtcatgtccccgaggaaccgaaaggcgttcatggctgaagcggcggcggcgggccggcggcgaaggcgacggcggcggcgcagtggctagggtttgggttttagagctccagatgcggcggaaaaatggcggagaggatgcgtgcagggcaccacgacgggaagggacgggaagggggagccggtgctgtgaaccgacgtggaccggctgggatgtagggcccacatgtcagcctccgttggtccactgaaccgggaccacgaagagcgggaagcggagggaggcgcgatccccgtgcgtggaccggcgtggggcccactcggcagcgacatctgtgccccgtcgcgacgtggaacaggtctaggcgggggaggatacgtgggcccgcggcggcaggtgacgtggcgggacacctcacctgcgtaggtgacgtcacctgagcagcagttgccttcttttttttttttctctttttccactggctttgccgctcgtatgccgctgaatttgctgctgctgctgatgctttgccgtctcctactcctactcgtccactttattaacccttattaaatccaccgtcctcttcctcgtctcccactactacaccccgcctctcccgccgcgagatccggctccgcttccggaagcttctggaagggcgtcccccccacatgagcgtctgatcgatcggccgtcgtcgcca

SEQ ID NO: 46147 - DNA, 1501 bp, Oryza sativa
tggatagtctctgtccctgtattcacattccaccttcaacaaagtgttgatttcccgtaaagctaactgtagtcctttaagtaagtagatatcttaggcttttgcaaggcatataaccaaggaaggcataatatggttctttttagcataaagcaagttttatttgcataaaacatttctaaatcaggtttactttcaaataaatttcagcaaactagtacttgacatattgggcatcaaggtaggcattaatcatgtataaatatgcacctcattgccttccatggcagcaaggagatcattctcaaatctcatcacaatttgaaggtaaatttcagcatttagaagaataaacacaactctacactcaatagatatccacacgccgctcatgaccgcgagcacggctaatcgattagtttaaactctgcagagtttgtacactttacccacatgatgtgaaataataatcatgcaagagcatggcacgcgatacataagttcccgatttattacccgcaacaaagcttttccaaaattcatgatttagccttacaccagcacgatacgtgttactccatcctaagccatacacgttatatgacctagaaccgttaagtggcgggcccacgccttaaacttaacgccgtggtggcggacacaacgggaacccacccacgtggcacaataccgttgtattggacagacttagtcacctaaactaccacgtcggggtaaataggaagttcctctgagttatccgaactcatacacaccggcctacagaatgtaaggctaaaccataaataatttactaagcttgggctatcccatactagcacatgtggttgtactgtatacgaaatgaactgacattgagtgaagtccttaggtcggtttgggcacactctccccctatcggtacacaactaatcaccacatgtgcaccacttgaggcctaaacctaaaatccatgttttccacccttttatttattcaaatctccagtattaaaggtctgcccagaataaatataaatcaattttcaagtttgtaatgagcccataatgtcaaggaaggcccttcttagcaagggttagctttatagtaacctagtgtcccccaaactcatataaaaagtgggatagtcataatggtcctaaggttagaataataggataaggatataaggtggggtaaggttataaagccaaatataagaatttgtttaaccagttaacccccattttaatttgttagtaaaccattgacaagcaagaattggcaaccatttccaataccttccaaaacataggttcaaagtgatcaaagaaaggaaggtgggacttgccttgaatcaggaaaatgtcagcacctaaatcactttttcaccgtttaagccatcatctataccaagtacacgttatgccatttaaccccaaaatatgcgtaaaattttaaatgctctaaaatggatgatttgtgcacagtgaatagggac

SEQ ID NO: 46148 - DNA, 1501 bp, Oryza sativa
agtttcattagcgagcagacaaatatcccaagtgtgaggctgaaatttcacagatgagtgtgtctttctgtaatgttccacctaataaagtatctataactagataaggtgttagaaattgatcttttcgataagcaagacaagatttagcaattggtgaaggcaaagtgcttaatctgaacaaacttttgattattctacttcgagaataatctgtcactttatttctctcatcatagacaaatgctacttttgcaacatacaaacaaaatagcttttctcctttaagaaaatgatataaccaccaatgctcttggcattcagaatactggtagcgttatctctccactaaccaaatgtgacctccatgacgtaggaatttgcactactcactctacttgtatcagataccatccccacatttcgatacattaattccatgagagcactgtcaatcctgcaacataccattactagcagcagatttgatacactacatcacagtaatgagtaatctacaggtgatactaagtttcatccaagtcaacagttctactgcagctggatacttgcaagacgcttaaatcgacagctcaaagtactatcggattatcagttccggtcacaattcgatcaataaacgagaagactaatcaacaatagaacgaacaacctactcctagctaacaacagctctggaaacaattgatctcggatctcagaatctgagcagaaaacaagaacaaagacagacaaacgaatcgaagcatcaaggaagagagagtaagagtaccatcaactttgggagtggatccagcgcagcccatggcgacgacggccgatcgatcagacgctcatgtgggggggacgcccttccagaagcttccggaagcggagccggatctcgcggcgggagaggcggggtgtagtagtgggagacgaggaagaggacggtggatttaataagggttaataaagtggacgagtaggagtaggagacggcaaagcatcagcagcagcagcaaattcagcggcatacgagcggcaaagccagtggaaaaagagaaaaaaaaaaaagaaggcaactgctgctcaggtgacgtcacctacgcaggtgaggtgtcccgccacgtcacctgccgccgcgggcccacgtatcctcccccgcctagacctgttccacgtcgcgacggggcacagatgtcgctgccgagtgggccccacgccggtccacgcacggggatcgcgcctccctccgcttcccgctcttcgtggtcccggttcagtggaccaacggaggctgacatgtgggccctacatcccagccggtccacgtcggttcacagcaccggctcccccttcccgtcccttcccgtcgtggtgccctgcacgcatcctctccgccatttttccgccgcatctggagctctaaaacccaaaccctagccactgcgccgccgccgtcgccttcgccgccggcccgccgccgccgcttcagcca

SEQ ID NO: 46149 - DNA, 1000 bp, Oryza sativa
ccactaaatgagtggtaatataaatagatttgaaccttagatccacggtttagattactttttactaacaatagagagcaccgtagtgggctctaggcagtaaggcacggtatgttaagagatcgaacaaaaagaagtttgttgcatcattcttaggctgcatcaacgagtgattttcatgttatactttctcgttcgaagatagcaggatgaatagatataggatgtcaatccatacatttttcgacgttgggacttgggagcaaaaggggaaggatgtgctcagttttggtttatctttctttgccaccggtgattattttcgttgatcttttctatagagtaaacacctggtgttattaatttatggctgacatgattagtcactacggtgggtccaagccattcagccgttcatttctcgattggtggcattgctgtcgttcacaaaggcagaagttatggatcggcctctcgctgcccaacaaaactgaaactaatctatgaccatataatgttgtaagctgaaagactttttggcacatgcatgcaaattcttgatgacaaaattagtttttctatgcgacaaaaaacgatcttgacatgcggtttgatggctcacctgcatacatgtgtctgcgaaaatcaacatttttgcatgcaggtggcccaaccgcatgcgaagactcacggcattattgcaggccagtctcttaacgtgatcccaaggaagatcaattatcacatgtgccagcctgcaataatgtgtttctcacgtggcctataacccactggccatttgggaagattgtgcccccatgtgatataatatttcccgctatttctaatcgaaatctgaaatgctatgcatagggcctaactgatttgtcgttcttagtacataatacctaatatcttgcactgacaaataaaatagtatttcaatatgtaaaactgaaaacattcgtatacatattgttgacggggatacccgcggacc

SEQ ID NO: 46150 - DNA, 479 bp, Oryza sativa
tttggcaggaattttggaggtcgggtggttttcttttataatagggggtttcttctataatcccatataaactgaattagggctattaccttacgaggggcctaaaccagtataatccttatctttttgtgtgcttgatatcgtatcgtgtagatccttataccaacgtaccccaataccatcaaaatacggtccgcgggtatccccgtcaacaatatgtatacgaatgttttcagttttacatattgaaatactattttatttgtcagtgcaagatattaggtattatgtactaagaacgacaaatcagttaggccctatgcatagcatttcagatttcgattagaaatagcgggaaatattatatcacatgggggcacaatcttcccaaatggccagtgggttataggccacgtgagaaacacattattgcaggctggcacatgtgataattgatcttccttgggatcacgttaaga

SEQ ID NO: 46151 - DNA, 1501 bp, Oryza sativa
tatgcgcaaggaatcgaaccatggctcaccgaggcagcggtaatcgacgatgacggcggaggcgatcctagattggcgccggtgaagaaaaggatgtgttctccgtgttcttgatgtttccggctggggttcttgaggcgttttgaagaggaggttgaggcaatgacaatggcgcagcagctttctctgaggtgaatgagaatggccggacgacgatgatggttgaagcggcggcgctccggtgcgtgctccagggcgttgtcgacgtggcttgcgttcccggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccggcggcgaggttgaggatgacggagaggcagagaacctctccctcggcttcttcagctccaaagtgatgtgtggagaatggcgacgcgtctgggaggagtagagagcgagaaaagggaaaccgagatcgacgacacgttgcggccacgcgtcggctcgctcaatctctccctctctcggctggaacagtggaggaagtgatggacagagtcaaggcaagcttaagaggctgtcaggtgggtccaggtcgtggcaaactaggctagggtgagagggttgggtaagattctgggtaaacttgatttttagattaattttcggaattattttctcctctaactttgaaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagagaagaaaaattctagaaaaattacatttattcatgataactaatctagtatttgaataaattattttccatgttcacttatgtgcagttaaatgtacttttggatgaaatatggttttagccgattaaaatttaatttgatttcttttagttgtctgtttcgaccgattaatttgagatatcaacttgagtgttaacacgttaccaaattacggaggataagtttgtgctaatcattgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccacatgttatcactcaagattaactataggtttgtttagtgaaataattcttttagattatgctcatgggagctattatggaatacaagtccaaaactccaaatgcacaaagaactcgagggttaagtttgcttggcctggaccaatttggga

SEQ ID NO: 46152 - DNA, 1501 bp, Oryza sativa
tccggtcggtcacccatcccaaattgctccaggccaagcacacttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgcccatgtgtccaatgacagcgcatgtgccatgctgtgtaaccactccaggtctacaccagccatgcgcaccatgcctgcgcaactgcgatacacgcgcccgtgaaaccgcgagagtcggctctgataccattttgtcacgtcccgccttcccccaagccgggcccacttacatctgatagctttcataggtcatagactgccctcacagaccaacacatgtcttttctgcacattttgtcctcactcgtgtgcacccgggaaattcttcccggtcggtcacccatcccaaattggtccaggccaagcaaacttaaccctcgagttctttgtgcatttggagttttggacttgtattccataatagctcccatgagcataatctaaaagaattatttcactaaacaaacctatagttaatcttgagtgataacatgtggacttaatattaaactcaaatatcatcttctcagtctaaaagaagtttaatgtaatccctataataatattagatgcaattatgaagtgggaacacatatacaaacaaaggtcatcttaattctctaaaatattttgtgcaagataaaatcatggaaaaatttatgtggacaatgattagcacaaacttatcctccgtaatttggtaacgtgttaacactcaagttgatatctcaaattaatcggtcgaaacagacaactaaaagaaatcaaattaaattttaatcggctaaaaccatatttcatccaaaagtacatttaactgcacataagtgaacatggaaaataatttattcaaatactagattagttatcatgaataaatgtaatttttctagaatttttcttctctgtttaagcctcctaaaaattcaatctagctttctaatagcccatctttgtttaatttctgtgagcagtccacccattatttttgagtgcaaccaaagaaaatggaatctaggtgtaatcatttacctccagtaaaatcaacactaattaatttggtccacacattgaattatgtagtttcaaagttagaggagaaaataattccgaaaattaatctaaaaatcaagtttacccagaatcttacccaaccctctcaccctagcctagtttgccacgacctggacccacctgacagcctcttaagcttgccttgactctgtccatcacttcctccactgttccagccgagagagggagagattgagcgagccgacgcgtggccgcaacgtgtcgtcgatctcggtttcccttttctcgctctctactcctcccaga

SEQ ID NO: 46153 - DNA, 1349 bp, Oryza sativa
aatgctagaaagtcttatataaatatgaaacggaggaagtagttactagtactactgtagtgaggaataacaagatatacttgttatacaggctaacaaggacttaaattcagtttgagaccaggcacactattcaagggttctgggcagaactaaaattagcaaaacaaggggcggcccacaaaccctagcatcaattttcaagcacatttacaccaacttatatcgttttccaatgaacaacaataaccatatggcagtttcaaagatatttcagtgaccactgaccagcaagcttggtattgcacgcaagccaaagacaacatacaaactccatccttgggaaagcattttacatcattctaggtacggtactataggaggggccctccatttccatgggcaaattttatctggacatcatagaatttctagttttgcaaatcatgggatgggatgcatatcaagggttaagcaactgcagcagtatgacaagaaaacagagcctaataaacaatctgattcattaactaaattgattttgcaatgttatacctttgtaaatcaaatgaattttgacaagtccatgcctcacaataagcttagatagttaccgccagcaggaatggaaaacccttacgtgtaattgttgatgatccaaatacagggtaatagaataaaagatgctagaaactagtcccggtggaatatgtcatctgacatattgtcaactacgctatttacatcgtagaaaaaaaatagattatttgattatgatgtcaaatatgtattatcaaatcatttttgtcttgaaaataatgtaggagctctgctcgacaagtgataaaaataagttctgcatcctacctgaaacaaaaaaaaaagtatggatgctgctgtgctgcaatattgcaactgacgagggaatcttaaattttctgcaaagatttactatttcatgatcactcaccagttttgcatccactgaatgtcagaaaatttagatacaaggtgaataaaccattaagcactaactaaagaatgtatagggattctggatttccttttccaaggcatgctttcacctttttgccaaaaaattggcaaagtgtagcagtaaacccatgtttgctccactcttctttcacgttatctgaaacatgacactgtacacatatgctgtggagattgcagcctccgatttccatgggattactcacaaaagctgagctataaataatcaactaacctttctgcttaaatcagaagaccgtacacactgatcaacaggttaaacaacagtggcatcactggcatgtacctactttgaagtaactggcaatgcttgt

SEQ ID NO: 46154 - DNA, 1501 bp, Oryza sativa
caaatttgatgtacgagttccaaccagctgcgtcaggacgccatgccatccacagctcaaacaccttgcgggcgttggcgacggctccaagcacttgctccatatggatgtacttgtaccagagctggtcctggtccacccagggcaggagggagacggcgcgatcacacacattacattcggttcatatgccgattccgcatctcgaactcggcatatccacgccacgccagagcgtgtggtcgcggtgggcgacgtcgagggcgcgctcgtagacggagcgcgcgcgggcgaagtccccctgccgctcctcccacctggcgtacttgacccacgcgccgacgttccaccgggcgcggcggatggcgtcctcgaactccttgcggcggcggaggcggtactcggagagctcgacggagtcggcgatcttctgcttggggggacggacctcgggctcctgccgctccgggcctcgcgcaggatctgctccgcggtgatctggaccgaggccggggtcttgttcttcacgcgcgtcgcccggggcagcttcacctccgtgtcccgcttggtgaggaacccgagggtcgggtcggaggcggatgacggcgccatgtcgccggcggcggcggcggcggcgcggatggcgagcgccatggccgccggtggtgatggggagagagagctagggttagggctcgggagggccggagggagggaggaagaggaggggattttcgagttggtgcgtttgggccgtacgatctggatgcgacggtgggggttgatcgggtttcgcaaacgggggcaagccgccaagcccgcgcgtgggctatatgattgggtttttgggtagatgggctttgtgatggatccgcagcgcggctcgaattcggtttcgggtgcttggctcgagttcggtttgcgctagccctgtggtagggcgagtggtgcggtggccctgggccccgccgtgataagggcctcgatcagtcttgattaatcctaacactggattatttattcaccgttccacacattttctcctctctcttctttattgagatgattattgatggtatttaatataaccaccactaaatacaggatcgatcactgatacatgttgatacgtacaattatagttatcactgcattttcttataaaaatgctagcatgaattacttgatactgtcacaattttctcaaagtcgtggaactattaataggaaattggattgtgtttgcaatgttgtctctacaataattacaataatttaataagtataagcttacctagcgtagcgtagtgtcatcgtaatcgtaatttgggctggtttattttatgatggtgggagtggggccaaagtataggtggccaaatgggccgggccaaacgggcggcccgcggcacggccgttcctgtagcaggcacggcccggcacggcctgctacagtaacgggccgtgccggcacggcccgtgtagccgtgccgtgcttggg

SEQ ID NO: 46155 - DNA, 1501 bp, Oryza sativa
gtaggatcaattctaagcatcatttttccttttgtatttgaaagccatgcctacatgaacattaatttcaagcattcaccccacctcttcagaagaaaaatgcatgtggttgttctggtcttagtcttgagtctcaaataaattatttcaataagtaagataatatgcaacaagactaagtcaaagcaaacctttttctaagaaagtatcctcaacgaactgatctgtgttgttcagcaactttacatatacatttgatgtcacattgtacatatttgtaatggacatatatagaacaatgtactggagagattagaaatatgcatgatgttttcactgagctgttagtcctagtatttaaaaattgacactagaccaaattttacacaccccactgaatccatataatgccagtatcacttgactgattagggtgttgatgttggatgttagcacgtaaagattctcttcttaaaatgaatggcagagctgcttcccttggttttacaaaaacaaatgttgagaacacttttctttttgttagttacttagttacagtctttaaaaaagggtctatatttggtccctcaactatggacttggtatgacttttgtacctcaactacaaaatcattcattatttgtcccgcacctcttaaaaccgtccatatttcatccttgagcccaaaccggggtttactctaatgatgtgtcattgaaattgatggtattaaatgatctgtgcctagtaatgagatgttcacggttgtaaaagttgaggcaccaaataatggatggttctgtaatcgagggacgaaaaattggagatcaaatatggacttttcttgtttttaaataaaaaaggcaattcaaccaaatttcagacatcgaattgaaggactagattccatatgactaaattccatactaaaacttttttagctacagtgctgcatggaaataatctattaacatttcttctgaaccactctatatgggctttaagcctctaaacattcaaaggcataaaacaaatgcgccacttttattacagccatgcagtatgttctttttttttctattatgtgcattttgttttttatatgttgctcttctaaatgggttgttcaacacgtgtatttcttttcatgcagaatctaacttccttgatttgatcggatgaaagcagcgacatttgcttctgattgtagctttactgttgccatctgaataagaagcctttctcttaattaaaaactaagaaatggatcgcaatgatacttctggatttgtcagtgggggatgcaaaaaggcaaaggagctgcttatatttctgacttcttagtttctttgtgtattatgtaacccagaagcgccactgactgtacttttcccttaagattggtcaaatttgagtcttaatattctcagccacctgaagcagttgaattacaacttgggctcccaggatttactgcatatcctcatccactagaggcaa

SEQ ID NO: 46156 - DNA, 1501 bp, Oryza sativa
acaagtgttcataattacggttaatttcagtgatacacgatatgtcgatgtataaagcatccaatatacttccggagggactaaaatcaccttcggattttcatagatcacgtcgttaactatttgacacgcgattgatcgtttgttcttttaaaaaaatcacgtgtaaatatacgaatgtaaataatggtaaaagtacatttaatgataaacaaattcataataaaaaataaataattctataaacttctttaataattaagatgaatactcaaacgtgtatcaaaatattaacggtttcacgtgttaaaagctcatggccatcggccatgcacgtagagagagagctcatgcaacagtataatgagagggtaaatggctttggaggtcgttggcccgctagacgtgcgggaaggccagtcatggcaattggcaaggaggatggtgacgcgggggaagagatgaggagttttctatgttttttgtattctttttatcaatttgcttttaaatttttagtcaattgttcagtcttcagagcattttggtattgaaaaaggtaaaacttttttttttcaaggagagttgaaaccattttgacttgctattagtcaactttaaaagtaagtggtattttagaacaactttttttaatgaaactagtggtacatgagattagataaaaaaaccattagcagtttgacaaatacaagaaactgtggcatttatgtaattggccattttataatatgtattcctcagtttcacattatatatgttttggactccatatccatatgaattcggacacatatataaatcacatacatcgatccatgaatctagctatttgatacccacaacgccttatagtatgaaaagtgaatcagagaaggtaaatcgatatgaaatcgcttaaattcttgtgttcaacttatgagtactctgagcttccatgtatgcaggagggatcatctggtggtgtatacggtataccatccgtcccataaaagatcaaatcttagctataaatttgtgtataagtgtgtccagattcatagttgggattaaactttttttttttgacttagggagtatagtgtttgcctactcatcaccacatgtataaagtgtaaactttaaaaggtctcgccgtagtggctggctaggaggttcatccatgatccatcctttcatttttcgtagaactttaagatgtcaggacaaaaggagaaaaaaaaagagggtatgggcgagtcctcttattccaaaccttagtgctgtgtgcaacaaaattttccttttatacggatgattgtgaacattaaaaaaaagttaattggatctatgccattacaactttgtcaaattaaaaaaataccactactattcgttatataggctacatgccattgaaaatttctaaaattagaaccatgccaatttaatcacattttccgtcctcctctctcacgcgtctctgttcccgtcctcatcccga

SEQ ID NO: 46157 - DNA, 878 bp, Oryza sativa
gtgggcaatgctagaaagtcttataacctgaaattgaggtagtacttaatactatatgttggccttcggaaatagtgaaacatgtgaatgattaggataattgctagtttctgtttcagaaatttggccactgttaccttgtacaaaatcaggattttgtgtgttcgacatattgttagaagccatacatgtgaatcttttgctaattctgtgccctccactcctgagcttatcattcaaacccaggtagtttatgttttttttttagtggcatttccaggattgaatttttggtttctttccctccatcaagaaatatcttgagtggcaattttcaggacagagggattctttcccctccctcaagaaagcttttcacttccagctgagctagctgtagtctactttctagggttctaaaggcttacccatctgaccgcatgaacagtggacattcctttatctggctagtatgggttaagggataacttgcttttcatgtacataaaaaatgagtctaatgctttctcaaatttagttcttttatgcatgtttggttttttcaacactataaatgttcacttcattcatatgtgagaattgagatgcaaaatatgttagctgtcacaaacttaagttacctgcatcagctggaaatttgtctcagtgcatactcttatggaacttgacaggtgtcatactacaattatgcaaatgcttttctttttttttttaccctgatctcagtaccgtagtgcagctgtatccctttgggggaaggaattgatttaaaaattggaaaatcaattgattatatcaattcttcctgtataaatgtctgtatttttttttagtcaagtgatctcttggagcgaaca

SEQ ID NO: 46158 - DNA, 1501 bp, Oryza sativa
cccaagagcttcgccttaggcgcaccccttggacttagccgaagcttgatggattaggttgtttcggcaggttggtcgaaggtcctcgtgacatgcctccaacaatttggaagggggatttattccagagggggtgtggtgcacatcgggcagtggttagtctcagtttacctgaaatggattcaggggggacaaatcttggttttgtcttcgatgtactggcctcaaagggatgatgagatgttgatgttcttggaagagatgacaactattagagaggtttatccaggggaatggataattgtatgggacttcaatcttatcacctcagctacatacaagaacaattctagaatcaaacaccagatgatgaacatttttagaagcaagatagatgaactagaactcaagaagatgtacttgtttgaaagaaggtacacatgaagcaatgaacaataaagaccaaccttggtgaaacttaacaggctttttgtcacaacacaatggtaggaggtttttcctgaagcgcatatgcaggccatgagttcatctggctttgtccactgccctttgttgctatcgtgtggggacagaccgattaggcacagaagattcaaatttgagaccttttggacaaagttagatgacttcatggtccatggaggtggttcaggaggcatggtagagggatgttgatagtgaagacccctatcgtattctatatgtcaaaaaatggaagattgtaaggtgctaaccaaatggggacagcgacgcatcagcaactttaggttgcaactgtagattgcgaatgagataattctcaggttggatgtggcgcaagaaaagttctgacatgtttgtagcggcgacttagggcaccgttgaaggaaagatatcttacactggcctctcttgaaagtataagaataaggcaatgagccagaataagagatctgaaagagggagattcaagcattgccttcttcttcatgaacatgagaactcgacgtagaacgctgttgatcccaaggctggaacatgaggacactttggctacgataatgaaggataggcaatagatgactaccagctatttcaagacggttatgggcttggccaggaatgcatctaaactgatatttttccatgaggtgcagatggccacactcaatctgtcggagttaaatgccccttttactgaagaagaggtgtgggcatcaatcaaaaacataccaaatgagaagtcactaggcccggatgggtatacatgcctattttatcaaaaatattggagtatcatcaagccaaaattaatggcagtgttgttaaagtttggttatggtaacaaccaaaacctggacctactgaacacggtgatcatcaccctgcttcctaagaaagaattatgaaccctgctgaaagattacagacctatcagtttaattcacagcttggccaagctggcaacaaagatcatgactcttacactgaccataaaagg

SEQ ID NO: 46159 - DNA, 1501 bp, Oryza sativa
gcttctcctttgtcctcccttctctccaccacctcaccatgggagcttatatggcacataggagcgagtgtttcgatgcttatagtacttgttgtaaaccaaatttctttcagggatcccgctaagcctaattcccttcaagtaatcacatttaagatagacattagaaatgaaatttaagagcttttatggtaatctttttagttttcttcaatgtctccacttctcaaaggataggatagatacttgggcatcgcaacactagaagtttttaaataaataatcaaatttatagctggacgtgtagtaagaaatgtgacaaagagttcatctcatttgtactacctccgtttcacaatgtaagactttctagtattacccacattcatatatatgttaatgaatctaggcatatatatgtgtctagattcattaatatctatacgaacatgagcaatgctagaaagtcttacaatatgaaacagagggagtacttcataatatacttagttacttactgaaaacaacccaccacttctatgcaagaaggtatgttcgtctcttacattaagacgcaagtccctaataggtgaggctctcccttataaagtcataagcccacacatcataagagctttattgggatctgttctttaaatagtcatgattagctcctttataaggtagaacacaaaccgtaacaactaacgagatgttgtaagtttgatcagaatataaactccacgcagtttgagttctttagtttatattacaccgtccatctaaccctcctaattcactaaaaactagtaccacctgtcattactgtgctcttctcaggagacgaccaaattgacaaggtactacatcagaactgcgaagttatggattcttagttattactccatccgtttcaagttataagactttctagcattgtctacattcattcagatgttaatgaatttagacgcgcacacacacattcattaatatatatatatatatatatatatatatatgaatattagcaatactagaaagtcttataatatgaaacggagaaagtactatattttagttaatctctctttttaactaccaccatccaaaaagaatgcgattctcatcttcctcagcgattaagcacgcacatcagcgataaattaatcgcaagttcggcatacacaagaaacactaaacagtaacatacataacttgtatgtgaaatcagttaatcacaagaagtacatgacaaaagaaaacttctgcaattaaaaaaaatggcatgctatatgtattgatccaccattatctaagtttcacattttgcagggaagagtttaacttctaaagaaacataagctcattaatcagatcattgttgcaatctagagtggatggcaacaccataaacttaattgactagagacctcaaaaacagcttaagtagcaaggaaactcaatatcagagctcaaacggttaaatgcatagacagga

SEQ ID NO: 46160 - DNA, 1501 bp, Oryza sativa
ccaaatcaacagatgaaccatcgtccctgtcctttgctgaagacatggtgcagcatgttcccatgctctgcttgctcgagtctgatgagcttgaggagttacctaaacccaatgacaagtcaacccacttccgcttgatccctcttgacaaaggattgtgcatgctatcttgggcaagcacatcaagttgtgaagaacaagccattggttggctgactggtggactaacggtggtccatttttcagcatttcttggattcgtgccagtaaattccaagaatccaagctgtttatccattgcctctagtggatgaggatatgcagtaaatcctgggagcccaagttgtaattcaactgcttcaggtggctgagaatattaagactcaaatttgaccaatcttaagggaaaagtacagtcagtggcgcttctgggttacataatacacaaagaaactaagaagtcagaaatataagcagctcctttgcctttttgcatcccccactgacaaatccagaagtatcattgcgatccatttcttagtttttaattaagagaaaggcttcttattcagatggcaacagtaaagctacaatcagaagcaaatgtcgctgctttcatccgatcaaatcaaggaagttagattctgcatgaaaagaaatacacgtgttgaacaacccatttagaagagcaacatataaaaaacaaaatgcacataatagaaaaaaaaagaacatactgcatggctgtaataaaagtggcgcatttgttttatgcctttgaatgtttagaggcttaaagcccatatagagtggttcagaagaaatgttaatagattatttccatgcagcactgtagctaaaaaagttttagtatggaatttagtcatatggaatctagtccttcaattcgatgtctgaaatttggttgaattgccttttttatttaaaaacaagaaaagtccatatttgatctccaatttttcgtccctcgattacagaaccatccattatttggtgcctcaacttttacaaccgtgaacatctcattactaggcacagatcatttaataccatcaatttcaatgacacatcattagagtaaaccccggtttgggctcaaggatgaaatatggacggttttaagaggtgcgggacaaataatgaatgattttgtagttgaggtacaaaagtcataccaagtccatagttgagggaccaaatatagacccttttttaaagactgtaactaagtaactaacaaaaagaaaagtgttctcaacatttgtttttgtaaaaccaagggaagcagctctgccattcattttaagaagagaatctttacgtgctaacatccaacatcaacaccctaatcagtcaagtgatactggcattatatggattcagtggggtgtgtaaaatttggtctagtgtcaatttttaaatactaggactaacagctcagtgaaaacatcatgcatatttctaatctctccagtacatt

SEQ ID NO: 46161 - DNA, 380 bp, Oryza sativa
cacccatctaagcaggtagtagccattgtgggagtagataatagcaacatccaggtagtagtgctactgccggcaagagaggaacaaaaaatagcatgtgtacagtgattttctgttagttgtactaaaataatagagtagcagttagccgttacatttgtagccgttgcaacttcttgcagcaacgctgcaacctcatcctctacaaatacaaacacaactcaaagtcattttttcctgcatttcatcaaacaagatgaatccccccaacagaggttttatgcacatgcttagccagggctcccaaagccaagcttctggaaatggtagccaaaactccacttctccacaattctcctcaatattctctcaaacacagt

SEQ ID NO: 46162 - DNA, 216 bp, Oryza sativa
ccaaggtgctggttcggccgagccagggaggcgcccgatcagccccatttttgaacttcgctctcccccgctcgttcctagtttgtttagatgcgcatttggaggtagaacgctcggatctcgctagaacacttcttcttcctctttctctccacctttgcatactctcctctccaatccaacccaattcctcgaattcccactcatacccaccaa

SEQ ID NO: 46163 - DNA, 1351 bp, Oryza sativa
  unsure (1)..(1351): unsure at all n locations
ttatgttggtactcgttctgtaagtgagagcgaacgaggggtaaaggaaaaaaaacttaagtaaagatctttaacaaatatgttcaatgtgtatatcacgtgatcaaactcatctaacttatatacaaattagataaaaaaaacactatccgaaatcaccttaggggttatataaatatgtcggagcccaaaaccaataacttggatccgactgagattaatgtatcaatccctggatcagtaaaattgatacatacaatataactggttcttcattacatatgttaaagtcttacaatactaagggttttacaataataggtactcacctatctaattaatacacagcggaagtttctatacattctgactagtgaggtataaccttnannattttctaatttatcggggtcttcgtagtaatagtcataagggtcctcctcttgacccagatctgaaaaaggggttataagagcaagggtgagtatttacaatacttagcaagttatcacgggaatatgttatgcattgacatataagggagagtctacacatctgtcgacagatttttcatcataaatntgtcaaattttgtacctttggattaaacccataaacgatagatggatgacacgtgtacagcactgctgaggtcccgcatctactaatcgatagtatggatgggcttccgacgttaattcacactctcgtttcttaatcaaaattagttggttatgtatccatattaattattaatccttgagagctcatctgctcatgtatgtgtgatatctactagatattttttagtgcatacaaagatattaccaatccatctactaaagttacattgttgttacactataattataccatagttacaaatgtaattatggatagttacactgtaattttaattacattgttgttacactataattacaccatagttacatatgtaattatggtataattgccctgtaattttaattacattgttgttacattataattacaccatagttacatatgtaattatataattatagtataattgcactgtaattttaattatattattgttacactataattacaccatatttacatacatgtaactatagtataattacattgtaattttagttttctaacactgtaacttcaatataaactttattttgtcttgaaccaacttggcttaattgctctgtggtgtacgtttaacagggaaaactagtgctcttggaatcgatcccccgctacgcacggacttgtctcttttatccatcgtattagttagcacaaatctccacgcaaatcatatggcccaaaaatcgacaaatcttta

SEQ ID NO: 46164 - DNA, 174 bp, Oryza sativa
acttatctgttatatgctccagacttgtgatagtacgttatgctgtcaagttaattttgattggaaatgaagtaggatcttgtagtcaaatggtagattgtttgtgtatgtgcatgcgaattgagtggacagccactgtggtatctgctgcactcaaatttgtggtttgttctt

SEQ ID NO: 46165 - DNA, 231 bp, Oryza sativa
aggacaccgaaggcaatattttataatttctgggtaaaaagaggtgatatatttttccaaatgacgagattgcccagtgtgcaaagaaaattatatattcagaagaagaagacatgagacgtacttgataaagattaatacgtacgtacccttaaagatgcactaatacaagcatggcaaatgatagctagaagatgaattcatggaaatctactgtcgtcgatctagaga

SEQ ID NO: 46166 - DNA, 1017 bp, Oryza sativa
ttcctcccactttgttttctccacaccacaatccatgtgtcatggttgatgctggttaatggttgtatttccacttttttattttgggtgaagtcttcagttgatttgcatatttagaaagtgtatatagtccgctagaatttcttatgattctttagaaaaaacatattctctttgcaaaattatgtatttaatttggttagttcaggtagagggcagaactatatactattccatttgtaatacataaattgctctaaaagcaccccatttatatttttctattataagtattgacatcacatgcattcttactcttcctcaatttatgcgaaagattgatttattttccatatgatcgtagataaatattggcattgtcgttataggatatatataatacaatgctcattctatatttagcctatctacacgtgatggctaatttctgtcttgtgccatgtggaggtgcttcaattgaagtgggttcaattcaagtctatgtttcatatctattttttgcttgccattctttcgacatgattaagtgacataatagttttgcggagacagtatttctagctctattttgttagttgaacaacctcatatatgaaatttcatctgagttagtgctatatgaccgagttgtagcttattcattatgcttggaaattcatagtgaaatggagattcacttgcaaaagcgtgtttgggaccttgggactgatatccaactatcagcatttcttattatcttgtataatctggttatggtacaagataagactaatgcgaggatgagctttctcttgaacatttctgtttgaaccaccttatgtataatctgatcatgagcattggtgttgcatatttgtttcttgggcaaattaaaccaattactatttatgcataagttgtaaatagcatatgttggctgtaacaattcaaaaaatgtagtacttaatgccattgcttgtcaatttaaatgtttgaatatagacaccttgtgagagt

SEQ ID NO: 46167 - DNA, 259 bp, Oryza sativa
attaatgttttggcaattggcagtagctaggtaccataagcttttggcacaaactacataatatattcgttttcctaagaagaaatagcatatggtacatagtaaaaaaaaaagacatgacctcagtacctcactgattttcatggaaagcttatcaagcacctcaatgcgctgttttatgctttcaagagctttggtcagcttcttcttttgcacaagtaaatccacttgggccctcaatttccttttcccttttttt

SEQ ID NO: 46168 - DNA, 1501 bp, Oryza sativa
ggttttatattgagataatctaagaaatgccattgacaagcgtctaaatccaagaaatgccatcaacaagtgtgagttccaagaaatgccattgtacaatcgattttgtccaaaaaaatatcatcgccgttagggttccgtccattccgtgatattaaatacaatgttcatcctataacacttaacggcacaggacgtaaccgtaacggcgatggcatttttgggacaaagtcgtttatacgatggcatttcttgaaactaacacttgtcgatggcatttcttggaaatcacactttttatgtaaaagggttaacccgggagtgatatggttgaagggcacaggcatataggcaaatgtccaggaatacgccccctgttagcgcacgtccgtacgtctagtgcaggcgccatatgccatgtcatgtgcttcacacagtgcccacaagtgccatatgcccacccactgacccatacgcgcaatcgtgagggtcggctttgataccatttgtaacagccttccctccaaaatcgcgtagccagctcgcctgtgaatataaatatatacaactggggtaattgtgctactatctacccatggatataaataagtacaaccgaggtcactgtatctatctctagatcaatataattttcagcacatcaccaccctcttttctgaggttttatcaccggtaggacttgacacctgatacggggctgcatcttttcgatctccgcgaaggagaaatccctaagttcctcgcgccatggcaattgtatcggctatattggcgttgtttaaggctgcatcgcttcaatctcttggattgctctagttcggttgatatgtttgcctacccaatattccaattctatctttagttgcattgtgtttagagacgcgtcggtttagttgggattgtctcggttaggtccaatcttctgtcttagtaaatatatctctacaatcacaatattattttaaatagatttgccatatccatcacgttagcatatatctatcggcttatctagcttatctgatcagaagtaacctagaactatcttggttgggtccgatattctgtattactactgataatctaagtcttgctaagtttatatatttgttctatgtttaatcggagtgttaaccaataagttatatttacattggacttttagccgatgtatgttttaaccaacgagcctacatttcatattctatattgatatcggtcgactggttcattggacatctactttctcatattattatcagtcgattggattgtttgttccaagttcttccattgtcagaatctacatcggatatatagtcgattgtttaaaaccctattgacattggcttattatcttattggctcttcgatcaacagttcatctatcttgttagttataggatcaaattaactggcatgtccgtgcccattattttaggacctgcactagagtaaacaaatctcccaggactttgta

SEQ ID NO: 46169 - DNA, 380 bp, Oryza sativa
cacctcacaggtgctattcgcgggggactgcggccgaattacggcgaaccggagggctatttcgaaaaatcgccacctcgctcgccccatgcgcgacgcttaataattccccgaagagtgagagaaggcaaaaaggttgggttcgatccccaatcgcgatgtgctagggtttggaggcccgtgctcagtcctcgccgccgccgggcgccatcctccccccctgcacctgctaaggtcagctttctttctttccgtgtctttaagttccctgttgagattcgatttggattccttgctgctcaatctcatgggggcctgcacctcacctgacctgcttcgatcacatctcggactgatttcgttttgtttttggttttagc

SEQ ID NO: 46170 - DNA, 578 bp, Oryza sativa
catacaaccgggcatatgctagtaacgacaatatatactacatgtcaatattgtacgtacctttgactcgttgtgctatgtacaggctcttgactactcccaactgagcttagcagtggtcaacattaggttaacattacatttttacaatttgcacgttgtcacttgtcaggttagttcacattatttaatcattgaaagctcaatctgttacatttgcaggtacacttgattagttgattacctgtcctaattcacaaaaggaccgagtttggcagcagacaagagatgtaccaccagctcaatccacgactccacgtgtaactgaacctgggcccgtttagttcctcaaaaaattttcccaaaaatatcatatcgaatctttggacacatgcataaagcattaaatatagataaaaagaaaaactaattgcatagttatgagggaaatcgcgagacgaatcttttaagcctaattagttcgtgattagccataagtgccacagtaacccatatgtgctaatgacggcttaattagtctcaaaagattcgtctcgcggtttccacgcgagttctaa

SEQ ID NO: 46171 - DNA, 1501 bp, Oryza sativa
taatgcaggcttcaaggaaaggccgttgtttttgcaattgattttagttgaactcctttctgaaaacaactaagtgagtgcttctcaaacgacacggttgagacagtgcgtctcgtccggtcggagtatgtgtaatgtatcggtctttagacttgattcaaggttggcatccggccaacagcttttcaaacggccacccgggcctacaactttcaaacggccacccgggcctagctgatcccatcagctgcagatttttcaaacatcgaacccctttccacaatagcaatttcacaagcagtagtcaaacaaaactacgctaggaatcacctcacatccgcccatgaccgtgggcacggctgttcgaacagtttgttaacctctgcagaggggggtacactttacccacacgacattactaacccggatcacccagcccgtggggatcagccacgtcgggagacctccaagctttcatgacaaggcatttccaaagccgatacaggtttaccatatgccgacgagaggggtcccagaccaacaacaggttaggtcccagaccatactgtgccaggaagcccaggggtcctccccgacaccaccccagcgaatccacatgtctctcgacatcaaggctcccctgataagctagttactcagccaggggtgtcccattccacccatgtggtcgtacttgtcttatgtttagatgaaattccaaggaatcggttcttaagtgcgagagcgggaaaaccgtacacccggtacgttccccggtccgcggttttggaaattcatttagttcacaagcaccgacctaggtgtcgggttttccaagtcttttgtaaaactcaagttttacccaagaagttgctcagattttaaatttgaaggcgcccttcggtactcgcacagattgcatgatttccgaggcgcaactgggtggttacaagggcacatggtataacaattaacaaaggaaggatcaaatgcaacaaactaggtagatccgccaatctgccttgcagacgggacaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaataatgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaaagaaaagaaaagggaaagagggagggattatagacttctcctcgagcggctagggcgcggcccaagggaaaaggagcggactggccgagctaaa

SEQ ID NO: 46172 - DNA, 1501 bp, Oryza sativa
gcggcaccgctgctccacgggattgggccggtaccgcgcaacagccctgcgggaccgagccggtgccgccgccctgccctgcgtgaccgctcgggccttcgtcccgctctgaccaacctgcgcttgcccgtcgctcccacatgccggcatcgcgggttaggtatattttcgcaaattcatctcatgtatgtatataaacgtaaattattaataaaaaaaaaaggatattttcaatttttattcgtcaggtatcggcgtatcgctgtttcaatgtcggtctcgctcttccgttccggccgcgaaggcttctcgggccctcagtgtgagcagtagagagagtgagaatgcaccatcggatatctcgcagcgatccaaaatctgatgggccgaaatgggttgttaccatcggctgccgcccaaaatccacgggaccgtacgctgacgatggatcacttcagcagaggaccgacgaggcgacgaggtgacggccgtgctgggcacccgtggcgacgtcgcgcggtactgatcctgcacgccagcacacatccggcaatccggcaggcggcagctttggaaggtaaagaattgacgagagcaatcaatggcaacgagtgatggattcatcaagtgacgcaaggcccagtggcagagggttggtgaggggctttatttggtttgatttatgcccttgaacggaccaaaccagcgaccaaaaaaatgcagcagttctttttaaaactaaaaattgcagcagttggcaaagaatatatcatccccgcttcagtttatcgcggagacggacgagcagatcataattcagatgtcattttcttgttgtaatcaccgcttacaccacaaccacaccccggccatgacgtgtcactttccaaagtcatctctcgtcaatgacaaacaggcaggcacagagtcacagacacaccgcacagtacaaaacacagtgagacacaaacatcttgtcgtactatctctattcctcgtcccaaaatataaacatttttaatataagatatatttagctcacgctaaaattaaacgtttggttgaaattgaaacgatgttatgaaaaatttgtaaatttatgtgtgtataaaagttttgatgtgatagaaaagttgaaagtttaaagaaaaattttaaaactaaactcggccatagtaccaaattaaatatttgtaactttgactattaataaaaaaaattgaaaagaaataatcatataaaattgttattactagatttattattaaacaaactaatatgtaactctttttatttaaaactagatattgttgaacaaaatagcatttcggaaaccgcttagaagtaaagtgcttatattttttatattttactaggacagagaggaatatctgattattaccggcatgagctgagctgattgatcggtgcattcactgccatttcaacgccacaaaccacagactgacaagctcatcctgttcccatctcaactgcggtc

SEQ ID NO: 46173 - DNA, 1501 bp, Oryza sativa
gtactatttttcttcaatcgtggccgtgtcgggccagcccaccgtgccgtcgggccgagccaaaatggcgtgccttgggtcgggccacgggcctcgggccatatgaccatctatagttctagaagtctcccgattgctacaaatggattccactttccttgatgagctcctgattggtcaaatagaaatccttctatgtgatatgacactatattttttagagtaaatttcagaaaactacaactttagtgataaaactattagtttgctacaacattagcgacatatttcagtttgctgcaacaatagcatgagaaattaccacaaaactataacttttataatagcatgagtaaaagttgctgttttttaaaatttactctatttttttacaaggtacatttgatggaccttgttgttatctctggcttttaataaatgatgttgctgacttttaaaataacgtttgcaaagaagaaagatcttctttgaaccccgcatcgaatttatctccgatttgtaatgcaaacactctattcaaattttaatataaaatcagccttcgttccacagtcgagtgatatatcacatgttaatacatcttctcaatttttttcataaccatttaagtgacatataaacaacgaggggatatctcctcgagggatcaaaatagtttccccctagacttacataagtataatacatagattttatcttagggttacagaagtacatgtacaaaattaagttctaataagtatgttataaaacaagagagaaaattgaaaattttcaaagatataaaatatatatgtcaaattaaaggtcattttaaatgtatagttattgcaggaatctagcggagattgaatatactaatcctataaaaattatgcaaagttttttatatcagtaaacaatatgtatgggtcacaaagagtatgtgttgctaatgactagtagtgattcagtttaggctcttgacattttttttttttgcggggcttgacatctgttgtttgacctgaccaaataagaaattaagaaatgctgctctcctctgaccaggaaacggagaacatatgttctgtccatatatgtatggccttctttgatctgtcacgcgcaaaacagccgcgttttggctcactagtcacttgtttgacttgctgtgggtaacgatgtcagcttggaacaaatactcaattgactacttgatgataatgtactttagcttcaaacatttgtatttccttacatatatcacatcaggtacacttccaagaacttgcacctgagaaaattctcagctattacacgacaatacacgcttcggagaatttccgacaatacacatactcctacttaaggctttgtgtgtgtgacagtgccattctcaagcacaactgaactgcccataggtacaaatcattccatccagccatggcacctccttcccggccgttttacctcgtgtacgtcgtaatatttgtggccg

SEQ ID NO: 46174 - DNA, 1207 bp, Oryza sativa
ggtgtgccgtcgctgttcgacgtggaggtgacgacgtcgctggaggcggaggccgcggcgctcgcgccgctgctgaacggcgccgaggcgaaggcggcgctgggcgcgcggggcgacgcggagtggaagatgtgcagcgcggcggtgggcgcggcgcagcacaaggacgtgatgaagagcgtgaagccggaggtggaggcgctgctgcggcgtgggacgacgccgacgcgcgtgctgctgtacggcgggatccgcgacgtgaaggacgggccggtgtccacggaggcgtgggttcgggagctggagtgggacggcctcgccgcgttccaggacgccgaccgcgccgtgtggcgacaccgaggcggcgagctcgccgggagcgtgcagcgccacggcgcgctcgtgaacgttgcggtgtatggcgcggggcacttcgtgccgttttctcaagggcgcgcggcgcaggagatgatcgaggattgggtgttcggcaagggattgttcggcgccagcggcgggaaggcgtaaggcaaaatgtttcttcatttatagtagggagtattttctccgtttcataatgtaagactttctagcattgctaatatctatatagatattaatgaatctagatacatatatatatatatatctatatttattaatatctatatgaagtaagtctagaaagtgttacattatgaaacggagagaatatgtagttagtccgctgccacggccgtacacaccgtattgtgctctgtagtttatacgtagatcatttcagcacctatgataaataaataaataaataaaattttggatcaatgcgccttgcctctttccatcgttccttggtgtagtatacatgctagatcatttcagctcacaaagttcatccccaagtccgcgcttggaactggatgccatgtaggatctcggcagcaatgtcttctcggcgtaacaaaactggttttagtagttggatgaatcgatatactcacttgaggataaattagagtcaacctacagtgggagctagtagaattacagtttttccttgtcagaatggttttgaaaaggacctaagtgccaacgaatctcaaaatccctcattgaggcccaaaaatctaatcccaaaatttctatccaaattctaacctcgaaggttgaatttcacaattcgaatttttccaccgaaattattcac

SEQ ID NO: 46175 - DNA, 1501 bp, Oryza sativa
ttgcccttgtgtgggcaggcgatggagctgggggggcccttgactttgaagggccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccagaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgggccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatagcgtccatgctctgtgatcctacctgccccgttgaggcgcaactgctacggtttcctgacgggctcaccattgcaggaggaatggtcggctggggatcatgggaccgatgtgcggccatgcgttcatcaaccttccttgccacctcctcttgcatgttgagttcgtaactcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcttccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagca

SEQ ID NO: 46176 - DNA, 359 bp, Oryza sativa
tattagtctaaatgggccaagttacatatataatcatatatgtattaccagtaaatcgtataagtagaaacgcgttcgttctaacacttttagtacaagtgcattcacgttcgtaagcgtttcgtgcacgttcgttcgcgtttcgtgatcgtatcgttcacgttcgttcgcgttcgttaacgttttgttacgttcgtccgcgttcgttaacgtttcgtgcatgttcattcgcgttcgttaacctttcgtgcatgttcgttcgcattcgttaacgtttcgttatgttccttcgcgttcgttaacgtttcgtaatcgtatcgttcgcgtttcgtgaatgttcattcgcgttcgttcaaagg

SEQ ID NO: 46177 - DNA, 1501 bp, Oryza sativa
tccaccatatttcttgattagattttgcgtaaggtggttaaaacattctctatgtccagcccaagggaaaactcggtgcactgcaatctctaatcctttgcatgcatcagtacaaattgcaagaggagatacttttcctatggccttgagcaattgaatcataaaccaggtccaattatcagtagtctcagcatcaaagaaaccaaaagcaatggggtacatccagttgtttccatctatagctatggcagatgctaaatgtcctttccacaaaccatttagggcagttgagtctacactaaggtatggcctacatccagttagaaatccagtaatccatggactaagtgcacaaaagaatctgttaaaataaaccttcccatcaacctcaatagtgtcaatctcaataacactaccaggggacctctccatgactgcagccctccacctatacaacatatggaaattttcttcccaactaccttgcaattggatcatagccaaactcctacccttagccacagtatcataattgattttgcatttctgatcctcttgcaaccttttttgcagttctttagggcccatacctgagtctgtcctaaggatatggatggccttggaagcaacccaggcgctggttggtgtggtagtctttcttctaccgctagatgtacacgtgtgataattagtaaactttgtcacctgcaaattaaaacaaataaaacatggcattagagcaaaataaagaaaataacatagaagtgaaaatgtcaatgacattaggaaaaaaagtaccattacggttcgctcgtcagcctgtctacgcccattcacatgccaagggcaatcacttgcccctttgcatgctcctacatattttttacgatctgtcgcctttacccaaagttcaaactcctcattgatagcaaactgtctaaccgccaatctaaagaccttcatgttgggatacacagttcctttgaccaaggatggcttattcgcgtcattcaccatcatcctttctcccgcaacctcgtcctcgaccggaggctcaacctcaacctcattttcatcgtgattccgattttcagcaccattgccattgttaccattaccctgttcagttgtagccgccgcttgagcattctcggcggcttcatcctcagccctcaaacccaaaagcacatacaactcgtcatcatccacgatgtttacccttccttcctcatctaacgattcgataatctgtaggttttcccaatcaacaataggtggtggatgtggttctggctgtggctgttctccttgagtaggaggagaactaccaccactatcaggttcatcagcaggtgattgtacaactactaattgactcccaggctcctcctcgagcctagagaaaaagatgcaaataattgcaaacaatagtcagatctatctaaccccttacttccagcaaatcaatcgtgtaatcatgtcactgaaaaaaaaatagaga

SEQ ID NO: 46178 - DNA, 1501 bp, Oryza sativa
tgcttaactctagtgtaggtccaaaacttgcccttgggtgtatgagcgtgccagttgatttgatcctgtaatcaacaagaaacaaagacaaagaaaccatggttaaatccataaacgatagccaatcggctaggtgccgatgaaatatcatttatctttgagccgataccatatatgcatcgatcggcaatcattaataagtaaaaaagaaataaatctactcgatcagctgtagatattaacaatatataatctttatgtcgatatatatttaaatcaagtgattgggatagatcggttgccatgccgagacagtataaattacttagatcgaaatatatattaacaaacaagattatatatgttcatagcatagccgatcagatagatctagcatgtatcggctaatactccgataccactctatattaagatattaaagcaagtagaatataccaaacaaaaagcctaatatacttaaatgcaacaagatcttaacataaagggcagatttaacatgtcaataaaacatataatataagcttagttaaatcagataagatcggctgaaactccgatactaccctaatcggcaaccaaagacaggctagagattgagattctactaagatcaaactcaactgatacagctataagtatgaaaagaaggacaatatctagacaatcaagtcgtcggatgtttcatagggtggtagatatcttatataatctaagtcaacgtcggtatttagcctaatcggctgccttttgataacagatattagccgattataggttaaagagcgatattgccggagattgtataagatatacgataactcgccggattacataaataagattagagtatcatgaagatggaagcactaatcccgagaatgcaagccgccataacaagttttacctcttgttcaagatcgaaaccgatgcagcttaacccgaaagcaagaattcgtcgaaacaaaacgaaagtaaaaagggtggcgatgcaccgagattgtattgaacgtgtgttcatttgattacatggggctcggggtctatttatacgcaataattacaaaatatgtccatatcggacacgactcttatctctaacaaactctaagataccataagtctttgcggcagacttttgcccaaatatatcttcaagaaaattacataaaatatcctacaattgccttctcaggactctatccatgcgtggcaatcaccatgaagcacaccaacctaacctgacaacgtatgccgtgtcatattgtcagattcggctcaatcggctaaccctgtccgactcgaactctgccgatcctagtcgcagccgatttggacctcagccgatccttactctgtttctaggacgatctctatctcgaactccgtctcgactcctttttcacatccgatccttggattaccaaatttgctccttaacacattcctcctccgcaaccgccacaaaccaccgcctcttgtt

SEQ ID NO: 46179 - DNA, 156 bp, Oryza sativa
gctttccatcccgaccagttcactgttcacaaatcggttgggagggcaaggggggcgattttttgctaaaattcaaggtaaaaaacacattattctccattccttctcaatatatcgatcatcatatatttttcttcgtatgttgttgatttcaga

SEQ ID NO: 46180 - DNA, 376 bp, Oryza sativa
ctatttcctttctagtggcggcaggatacaaggcagctcacaaaagctatcggcaacagatcaaacacaaatagaaagtgatttggtgggtgactgcgacggcggtgacggtggtgatgacggcaaaattgatgaaggtggcgatgtgcggtggtggcaagaactcgaaactctaatcgcctaacactaagactagcaaattaacacaaccgatgcaatcgaaaactcaacaagccttaactaagcagtactagtaaaaaggcacaatggtctataggatcacgggaaaactaatctactatttttttttgttggccttttctggactataggaaaaaaaattaatgacgaagggaagggtaaattctctcaccga

SEQ ID NO: 46181 - DNA, 563 bp, Oryza sativa
agtaattctgtactcataataagtgaattcagcactaagtaattctgtactcataataagtgaattcagcactaagaatagtagtgaatagttgtgaattaattataaagtggtatcagagcctggtaatcatagagaagctaaatttagaagctaatattggaaagttaataaataccaaagataatatcaacataaggtgtagactaagccatactgaagaacatagttggcactctaataatagccaactaaatttaattgtagatttaatatataatttctatataaattggagtaagagacaagaagatttagagcaaaagttagaagatatatataaagaacaaaagcaatttgtagaacaatattcttttcttaataataagctaaatactacattagaattattagaagattataagataaggcaaaataaaatttcacagaatagtgattatattaaagaattactagacaaaatcaactctagtaaaggtaaggaaatagttttggcttcatctggcataatctcatcttcacaagccattaattctgaaaaa

SEQ ID NO: 46182 - DNA, 263 bp, Oryza sativa
cggtttagctaacacgtgcgctgcgagccggtagtaagtagctatctctatcatcaaaacccccagtgttcttggtagcgactagaggtataagaagaggggaagaacgaccatagggtcgtgctccaaccctaggacgcgcccctaatgggcccaacttggatacacagcccattgggctaaaagaagtgacgcagcaccatggatagaaaacagtcgggagtaaaatgataattgcggccgctccagaatagatatggaca

SEQ ID NO: 46183 - DNA, 906 bp, Oryza sativa
taattcctgcagcccttttagttgaaatcatttaatatttgaaaatgttgtttgaagttatcatattttcaaattcaaattcaaattgttcaaacaaagtcatatagaaaaatgatcaaaaataaaagttatagatcttgataagttatacaactttatttttgacaatttttccatttgaaatcatttactacccgaaatatttttttgaatttcttacattttagaattcaaattttatatagttcaatcaaactcggatgaagaaatgaccaaaataaaattggtagatctcactgagttctacaactttgcttttgacaactttttcatatgagttcatttagtgtcataaaattcaattcgaatttattttttccaagaagtctgatttgcctcctctttgggttgggccggcttatgggccttatgtgtaagtcggatatccgatggaaaataccggataatatccgattccgacggatatcacctatatcatattcgttttcacatccgaaaaaaaatatccgaattcgtttccgaattcgaaaatttccggatatatccgaccgaaactatccgaatccgaaaaaagatccggtcggacggaaattatccgaatcactttcaaccctactaataggagtttcagatgaatattcaaggcagaggaagaaaccccgttaacctaataaaaatcatcaaggttcaatccaattaattcattgctctgccggtggttcgccgcaccatcgtttccttgttgtttttggcttcgccctgtgttcacgggtcgagtcctgtcttattccaattccgtcgccgttttcctttcctttcctaaaatggcaccgcctccttgtcctctccctctaccgcctctcctccccctgccgccaccccagc

SEQ ID NO: 46184 - DNA, 408 bp, Oryza sativa
tgagcagcgctcgaatctgggcgtgcagattcgtttcgtctggagacatggtaacgtcgcttcggtcggcgagcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggggcgagatagtgggcacgagaaacgaggagccggactcagcgatggcaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgaca

SEQ ID NO: 46185 - DNA, 1501 bp, Oryza sativa
cccgcacccgggtctgacttggaagaaaaatacgaaatatgatacatgaataatatgtttttactgtactccacccaatttcacacttaaaaaaaaagtaaaaaaaactgtaataaaaggagggtgtgggaggttgatacgttccaaagaaggatggccgtcaagatgcggatcggacggcgaagagcaatccagcagggtattgctgaggtccgcatcccacccgccgcatgtggcccggagcgcacatacaaaaccatccttgcagtatttgatttacggcaccacgaatccacacacaccatctctcgcgaaattaatccgctcccctccttttgatttcgagcctttccccccgttactcctctcctcctcttcctctttccccttcctctctctcgtgctcctctcaggcggacgccgcgagatcgggaggaggcggacgcggcgggagaggccatcggccatcgccatcgccttcaccatcaccgaccgcgcgccggcagcggcggtgctcgcgactcgcgcggtgtggatttgtggggggcaggggggattcgagtggcggcgcgtttggggttgtcgcgaggcggattcgaggggggcgctgtgggagttggtctggggggagagatctgtaagggagcggaatgcagcaggagcagcggaagaaggtgggtttcccgggttccggcgatctctcgcccctcttcccccctcgtgtttctctgtgtagctctctggaacgtatatgggtgcccgttgatgttggtgcgatgcgcgaatcgcctcggtgtccttcgatgtttttgtcttgttattttgttctttataagttgtggattgtctaatggcgttctggtgttgctgttcatttcagttctagcgcgcgatttgcaaataggctagttttttaactccccatcgccatttttacataaacttttttgagattttttttttacttttttttacatgttctaatggatttagttattgcgttgttcatcatggacgaaatgtgcgatccagctagcaatctggagtatgtggttgaaaaggccaaatgcgatgtgcaccgaacggtgagttacgaacagctcatccttcacatgccaaagttgaccattaccgtgtcgctgcgagatgcttctgcgccgaactaaacaacgccgcatgctgctgctttgccctgtcggtgggaaaaagcttttcccttacctcgtgtactcgtgtggggctcccggcttcggtaatgcccacaagcaaacccatctcggtggtaaaacgaaaacaacagttcgttgctgtgtccatgatttaatgctggtggaagatggaagcttctcaatgttcggtttcgaattgcaataattttgtgacctcaacaatatggtgccgttttttttatgagattgattatatgaagttcattgcaatcttcagtgatgggctgttgattcggtgtgtgaaatttcttttttttttcagagctctgcgg

SEQ ID NO: 46186 - DNA, 160 bp, Oryza sativa
agatcgtagaactccagaacatccataaagaaagaagaaaaaggaggacccaacccgcccattgcgaaggggaggaagaagatggaccgccccgggtaatctggtgctgggcgcgcctcgcccagcatcactatctcccggccggtggcagattccggca

SEQ ID NO: 46187 - DNA, 565 bp, Oryza sativa
ctggcttcaccactgtagaaagatagcaccttaccccatgtccatcttgtaaaatcatcaaaggtgtttttgattattattctgtgatgaacaattggcattggagattattggttttgttatttggaatttatttacgaagtggttttggagatgattggatttacaggtgaattgcaggtgctgtgattttatgtgaccggtcagaccgggcagtggttgccggtcagaccggctatatgtgcgcggtcagactggctagcctgcggtctgaccggccgacgctgtgttggtttcggtttcgggttgtttgtttggatatccgtgtttatttcatgattatggcttctagatggatactatacgtatgtaatactgttgcttgctactaatgagtcaagttggagatagcttggtctcggaatatggtttctttgtttatttcatgtgtaggtgactcgatgcctcgggagagtatttgcggtgatggaccgggagtcggcttggggataagacgacgtccgtggtggtcagagatcatgcgggatacttaggctagagttga

SEQ ID NO: 46188 - DNA, 419 bp, Oryza sativa
tgatgacttggacttagcatcaccaggagtacgcggacagatttttctggctcttatttcctatatctgtaggctccataatacttttgaatggctcgcgtgttgttgaattgctagtttgctactagtcttcctactccgaccaaaatatacatattttttgtggttctgcacaacacacgattctccctcaaaaactacaacagtttcttgtttgtactccatccacagatcatcatttttttgtataattaagagagcatacttcagagcattacatattgaatacatatatcttcactaatttgcttcatatagtgtgtgagcacttgagtagagaaaaatttgctaggctagttctttgtgtttttcctacctaccaggctaccgcagcaactagctgacataattttaatagc

SEQ ID NO: 46189 - DNA, 188 bp, Oryza sativa
gccaagatagcacacaaaatcaagaaacggaagaaagatttgggaggatggtgagtttttatagtagaatggtaatgagtgggggagtagtgtgggaaaaagagggaaggtgaggatgtgggggaggatggcttgcacgcattaggaaaaaggggaaggacagatgaggagggtggaggtggcggcaa

SEQ ID NO: 46190 - DNA, 682 bp, Oryza sativa
atgtgcctggtttctatttttgtatatgttatccttcggtattgttgattgatgctcgacattttgttcactcttccttttgctaatggaagcactacagaaattacagtgcatgttttgtctgatgtaacattatattttaattagatctttgttagctgtcttcccagtagtatgatgcatgaccatccaacagtctacaattctatttttgtttatctatgtgtaatagtttggatgatttattcagctcccgtaggtaaacatgagacttaccaactgcagtgtcttaacggtgtctgttttgtaatactttctagaaggtggatttatcggaatatctagtttgtacataatggagtcaggatttctccatatatgttaatgagtttatgacctaaaattatacaactactaatgtcttggcagagtagtttgttgtctgggagacatcatgtgtagtgttccagaaattttcttctctctttatcatgcacttttcatttttgtagacctcctaaccttttatactcatttttcagccatgctactatcaatgacagtcttattttatcaagtggccaagctgatgcaaagtccactcctctccagcccccttctcaagtgaagcatggttggggtgggatgccagggcgcccttccatggctgatattgtcaaga

SEQ ID NO: 46191 - DNA, 704 bp, Oryza sativa
atattttccttacaactaaatgaaccaagcatagtagcttaagttgttactcatgatactgaactgatcgaactatagtctgtgagcggctttggtatataaggcgcaagtgccaagtatttactagctatcaagatgctggttctgccagtttaagaatcgaaatgagttaactctgatcatagcttcttcctgattagattcttaaatcttaagtagacttgactctccccatgaccgctcagcgggtcacagttgtaaaagttttttcttctgctaatatatcggcatgcaaggctcttgcgcattcgaagaaaaaaaaaaactagacttaactcatttcaaccatgataatgtatcagacgaattcacagaaagagaaactattgagtaagaaatgtatagcctacatgaatgcatctctatttaacgcaattctgagtaaatcaaacaaaagatgtggccttcagaagaagctcaccgatttcagattattgttgagtttcagcaggtcgtcggagacaacctccaaaagtgaagaaacagaaattcgctcagggatcattgttgttgttctcgcactagaaatcgcctctgctggcacatcaactgcagcaaggcctgcgcaaatacgctaagtcgttagctcagctcactccaaaacacagcggctcaacagaccaataggaacaagagctgcagga

SEQ ID NO: 46192 - DNA, 1501 bp, Oryza sativa
  unsure (1)..(1501): unsure at all n locations
tacactatatattagtcgattggttcatggtttgattatttttatcatcattgttagttgcaggaacaaactaaccggcacattctgaacctgatttttggcatgtcgtgaacccgatttctaggacctgcactagagctaattagtaaactctcaaaccttcgtgtattggataaatttggtgataacatacatagggctatctcttgcgacatactacctccgtttttttaatagatgacgccgntgacttttaaacatatgtttgaccattcgtcttattcaaaaaaaatttatgtaaatgtatagatataaatcatgcttaaaatactttgggtgataaaacaactcacaacaaaataaattataattacgtaaattttttgaataagacgaatggttaatcgtgtgataaaaagtcaacggcgtcatctattaaaaaacggaggtagtagtttataatgtatcgacgcggtggattgttatcctaacttgacggttaacactccagctaaatgcatgaacgcggccttctctgcagcatggcaagtgatattgttgtagcttctgctttggttgttgaaaagacgatggttcccattcttctctttccaaaatggaatcacgctgcgagaattattacggtgtcgaagcctcgtcaatatggcctgttgattaatttgtttccggacacggtttcaccgccaaaagaagtgtaaaatcaaaggtgttgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccgctgagaagcgtaacaccctactcctgtgttttggtggatctgtgtgtgaaggaatacagagagccggagagcgagagagagttcaggctctagaacccattcgccagagtcccaacccctctgcttcctcttcctcttttctctttttctctttttctaggcctgggcctcctttttatctgttccggggtcaccacatgagcctcctgctgcctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcatgtgacaggccgcctgttgccacctaacccgcgatctctgaccggtcacacaccgcgaccggtcacggaccggataagcgtgcgctgcgccgcattaaatgcggcgtggcgcgctcgtcca

SEQ ID NO: 46193 - DNA, 1501 bp, Oryza sativa
cctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccgtcgtattttttggtgatggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccgttgcgtaggcggcgcgacgagtgtcgtgccggcgctcgatatcgaggcgggcatccggccccccacgcacatcttcttgggttggaggcgttgacgagggaatggcagacgaacggcgggtaacggccgccgctcgccgcgccctccgcctcgacgacatggagccggtggcggcagcgccagaggcctcggtggcggaggaccgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtcccgccgtcctcccccgtcgcccgcgggcggcgaagtcgcggatccttcgacctccccgagcgcctccccccgcccaagatttcggtgagagggggacggtggggtgcgagcccgacggcgcgggttctgctccccgtcgtcaccactagcgttcggagggaggctgtgcgccactgcccgttcggccattgggctgagcgggagaagcttggcgcacacgaaagaggacgagggcttcgaaagacacgcgcgccctctacctggcgcgccagatgacggagcgtggggctcctcaccgggagaccgcgcaggcccccctttgccggttcggccgggggcgctaagtgaggttcttcgccctcgatctgaggaacgtcagcgagagaggaaatgcacaagatacgggcgacgtatacaggttcgggccgctgagaagcgtaacaccctactcctgtgttctggtggatctgtgtgtgaaggaatacagagagccggagagcgagagagagttcaggctctagaacccattcgccagagtcccaacccctctgcttcctcttcctcttttctctttttctctttttctaggcctgggcctcctttttatctgttccggggtcaccacatgggcctcctgctgcctaagaaaggaaacatgctttttacaatgagggctagtctacagccggaagtgacctctgacaagcagagcacacgcctcctgccccgctcgcccgcttttccggtggacgcccatttcaaccttcatttaatggccaaagacttcct

SEQ ID NO: 46194 - DNA, 1501 bp, Oryza sativa
gggattcgtccggattcatcccgtaatcctcgacggcgtcatcaatggtggccgagatctccgcggacgtttactccctctcaggccaccctctgtccctaccggcgctatataattgctccccgtgcctctctcctccgtttccgccgttcgccgcttgctctcgccgtcggattcgtgctcgcgacgtccacctctctctccgccgtcgccgccgacctccggtccgccgccgtcgtcgctccggacttcctcccgactcggcgtcacctccttcggcttcgccacgtcgtcgtcgaccccgtccgccccttcgcttcgcccgccgaccgccggagctccgtcgccctcgtcgtcccgaaccgcgccgccgccttcctccgcttcggtcgccgttcccgtcgtcgtcgtcgaccggggtgagccgtggaccgtccctttcgcttccctctctcctccgctctctcgggcgccgctccgccgcgccggtggtcgccggcggtgaccatcggggcgcgggcgcgccgcctcccgtcggccgtgccggcgaggccgccttcgggcgcgccccgcggctgccatgtggggcccggccgtcagccgcccgcgccctcgggtgcggctgacgcgtgggacccacggcgccggccggcgcaagccgcatgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctacttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaactatgttgatttaaattattgcattatcgctttatttaaattcccgcgttatcactgttttatctagccatgcctatttacctttgttatgaccttattattgttattgttattattaccttgttcaccctaggataaacaaaaccccaactagtgggtactctattcatggttccactagtatgaatttaggtagatgcttcgctgattaaataggataacattaggtggttttacaactctagactttgggaatattcatatcacctggacactttggaatggttggcttatggtggaattggacatacacctctcttcctctttcaaaacccctaaaacctgttttccggtggggtttgggtgcatgccagttgtgggaagtagcaccccggccactataaggattaa

SEQ ID NO: 46195 - DNA, 1501 bp, Oryza sativa
tgatgtatgtactgtttataagtcagatctcagcaaagtttctcatatttttagcaaccagcaatataaattagatatgtgaataccaaaaaattataatgtatacagcacaatagagaacttcaaaataagtctatttgagtgctgttgcatatattttcagctatttagatgtgagatttgggtaatgtttgtcataataagtctatttggtactctgtacacttttctaaggtaaatataagaaggaacctaaatgatactttttatattggccaaatggcttgcgctgcaacgggaataaatttaattacactacaattgttatgctacggtgacaacccaactacaagacatgcatgtaaaggtctcaaaagttgtatcctgaatgtcatcaatcttttggtgcagttctcaaaagttcagccaagaaggccaataatttattccaatcatttagatgatatctctgaagaaagttgaagtgtgacatccactcacacacaccaatcttgtctcaatgatgaaattgaagtgatcatgcagtagggaccatacttcttacaaccatcttttaaattcagtagtccgcaccataaaaatactacaaactagttgttccttctcacagaagcagactgctatcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggtcatgtcaggcccccccgggatcaccgggactaaagtcgtaactttaccaaccgggactaaagatcccggtgatctttagccccggttggtgctaccaaccgggactaaagtcccacccctatatatatgtcttcttcctcctccagctgcccgagcaagcttcaaaatttctttaaaaaagaggggaggtcatgccaaaatttctattgaatttattttggtaattacatacaaatcggaggtgcctaaaaggtttgcaaattcatcctccaatgttttttttgtcatactacatttgcacctatgttttgcatactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 46196 - DNA, 156 bp, Oryza sativa
ctgcacccccgcatccgcgctcctccgctgcacgtaattgcatataacatgtgagtgtgctcagccatatacacatgcttggctaatatatacgtctgcatgttatcgggcggcaaaccaacaagaagctagctaggctatagctggtcgtctcca

SEQ ID NO: 46197 - DNA, 635 bp, Oryza sativa
ttcaaatggccataacttggccatttgaactcggaattggaccgttcaagtctctaatttttccttaagaagtcaagaacccatttttgtgctttgttctgctattatgtggagtttattagagttaaagcctttttcttttccgttggtcgtgtagacgctgcagcttcggaagatccgctcttcgtggaagttgaagccgacgtttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccttattattattgtttttgttattaataccttgttcaccctagattaagcaaaaccccaactagtggacactctactcatagtaccactagtataattttaggtagatgcttcgcaatttaattaggtaacattaggtggttttataactttagacttgggaaactttcatatcacctggacacttcggaattgttggtttattgtggaattggattcacaccatcccctttattcaaaatccccaaaatggttttaggctgggctcggggagca

SEQ ID NO: 46198 - DNA, 1501 bp, Oryza sativa
aatagaaattttggcatgacctcccctcttttttaaagaaattttgaagcttgctcgggcagctggaggaggaagaagacatatatataggggtgggactttagtcccggttggtagcaccaaccggggctaaagatcaccgggatctttagtcccggttggtaaagttacgactttagtcccggtgatcccgggggggcctgacatgacctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgatagcagtctgcttctgtgagaaggaacaactagtttgtagtatttttatggtgcggactactgaatttaaaagatggttgtaagaagtatggtccctactgcatgatcacttcaatttcatcattgagacaagattggtgtgtgtgagtggatgtcacacttcaactttcttcagagatatcatctaaatgattggaataaattattggccttcttggctgaacttttgagaactgcaccaaaagattgatgacattcaggatacaacttttgagacctttacatgcatgtcttgtagttgggttgtcaccgtagcataacaattgtagtgtaattaaatttattcccgttgcagcgcaagccatttggccaatataaaaagtatcatttaggttccttcttatatttaccttagaaaagtgtacagagtaccaaatagacttattatgacaaacattacccaaatctcacatctaaatagctgaaaatatatgcaacagcactcaaatagacttattttgaagttctctattgtgctgtatacattataattttttggtattcacatatctaatttatattgctggttgctaaaaatatgagaaactttgctgagatctgacttataaacagtacatacatcatacatgtacaggaacaatgactgtagatgtgcagtacactatctttgtcaattagcggtaccattcatttataaatccatatagtccatgattaatgaaattttgaagtacatgcactggttaggccaatttctgattcaagtccacatccattctttattattcctttgggatatcaaacatttgacatgtgaaatactgtgttcgtttgtgatatcattcattattcgtttgggatagagttttgaaggaattaaattcaagattgtgttctcaatggaaatggacatgaactcataacttaacatattggttttctaataaacatacttttatattagattgctactcaaataaaaggtgaggagaccgatcgatgggatctggcagtcttaacctgtgattgattgagcgagtcttgttctctgatcctgacgacctactctgctccagat

SEQ ID NO: 46199 - DNA, 313 bp, Oryza sativa
  unsure (1)..(313): unsure at all n locations
aaaatgaccggaagttcctgccctgtaagacaggaactttcaaacattttgtcaagaagttccaaacttctaataagcacaaagaactaaccaacaacttccaaatataatacaaagaannnnccgcaaggatcttactatgattcatatgtaatttccaaaaattcacagggcaaaatggctgcttattttaatgggaattacaatgatgagtaccgcacttgtgtgggggtgccaaaggctttggtaactaacatcaagggacccaaacttagacaagtttgggttcctaaatcccaagcttgatttcttt

SEQ ID NO: 46200 - DNA, 309 bp, Oryza sativa
tcgcaattaggattttgccgaattagtttttaacgactcacgaaaagcggagcgttacacaaaagtgatggaaaaaattgcaaaaaaagaagagagaaaccacccacggattcacatccgattctccacaagattcaatcataaggaaggcgaaaatcgaatcaaaaagagaaaaaaaagtgcaaaaggaaatttctttcaaacattcatcacaaaaagaaatttatgagggggatggaggagcccagcgtgcccaccaccgccacccccgaccgcgctcgttgatgtcgtgtccgccaccgcgccagc

SEQ ID NO: 46201 - DNA, 234 bp, Oryza sativa
ctattagcccctaacaaacttatctagcttgatcatctatctcgttgattaagacacagtttccacctggggaccgtgtgatcgacggagtcctgaaatttgttactgaagcagtcaagcagaggatgtaatactgtgctgtaaccagatcttcacgttgttcgctagaccggcaaaccggcattactacatatggtctgattggaatttgatcagttcgtctgttcgtggcca

SEQ ID NO: 46202 - DNA, 468 bp, Oryza sativa
  unsure (1)..(468): unsure at all n locations
ttctttttactcctacttcttttagcatgtattttttattgaattaaatcaaattcgacgtcattgcggttgcttgttagtgaggttgactagttctatttgttttttgtattatttcctgcatgctttgttggctttcagtttcgtaggttgtgcagagacgttgtagaaagtgataggagacaagagatcctgatgtcttattttctgtttggacccccaaaccgcaaaatatgggtctgtgtcatgttttttgctcgtatcccagtgtaacctgngccctcattttcttcgatacactcaaaactgaagtcaaatgtacatgaataggatcttgagcatttgcttcaatatagtattaaactgatcaattcgatcaaaccgtcatattatttggttacggcgatttaacattatgaaccattttaagtttttaaccaagacaatgttttgctcttgaaatgcagg

SEQ ID NO: 46203 - DNA, 745 bp, Oryza sativa
ctaaaggagcccaaacgaacggatggctgctgaagcctggagaaagaacaacgttaggtaggggataatgttcccttttgcaagtggcgcctagtacttcctcagtccaagaaaaaaaggtaaatcctagattttcgtgtccaacttcaactgtccgtcttatataaaatttttttataatttgtatttttattgttgttagataataaaacataattaatattttatgcatgacttgtctttttaattttttttcataaattttttaaataagacggacggtcaaacgttagacacgaaaaccacggtttgtctttttttttttttatagatggagggagtagacagtagcctctgaacggtgttccgatgacgcgttcgaggtacgcacgacacgatgatagcgagaaccgccacaaaagcgcagtgccagcctctctctctgcccatccgcgacgggttcgcaccagcagcaacttgtatagctgactctgttttttttttaacgccacttgcatagctgactctggcttccaacaattttcagcgaaccaattggcatcgttccatgagaagctgtgtaaactaagaactggtcgactgttttatcgggcaatcgatcgagggaggaaaagtcgaacggcagctctcgtccacaagagaggcaagattttcgtccatcctgtgtcatctgacgccgacgagtcgacgaacttcagtatcttgtattcttgtccgctcatca

SEQ ID NO: 46204 - DNA, 231 bp, Oryza sativa
aactcgtgttcgacgtgccgcatgctaaaccatatgccaaaattttcttgctcaaatttgtttcaaagaattttctagctcaaactgatcgaagcaatttgttgtccgcttgcacgagagaactcaaactgctctgctcttgggcagactcactccatccagcgtcctcatcaatgtttgcatctgtccgccgactaaggtctctctctctctcgtccgtttcctgacagc

SEQ ID NO: 46205 - DNA, 224 bp, Oryza sativa
aatatccaatcaggaacagcgtctgcgttcgtgctactctcgacacgtccacgtcgcatatgttttcgtggcgttacatcatgccgatgctttcattgatgctccattctcatcatacttgacgctaatgcgcaccacccatatcatacgtgtgctgcttttcgctgatgcgtgctccttgattaaccatggtgatggactgttcgtctaggtgtatggcaata

SEQ ID NO: 46206 - DNA, 272 bp, Oryza sativa
atcatctaatcatctcctttatcttttttttttatctacctatcctcttgttttcattcttaatccttgggtagaaatggtttcttgcataagaaattttttcttcatctttttacctctgccctcgttaactctcttgccatatcagatttttctcatgtgataatatatttgttgctacagacattatataacatgaaatgaagggtcggggacgccgcttcgtccgttcgacttgtccctccacctccggccctctgtggtactacagt

SEQ ID NO: 46207 - DNA, 333 bp, Oryza sativa
tttttgtattgtccccagacctcagccaagtgggggagcttgttggcttggaagggtgcttgaaggtcatgtgaaaggttagaaaaagcatcatatgatggtactctaggtctgaattctctggttgttttcaccttaaatattatctggcagctttataattttggttcccgtattgttttcacttctttagcatattaaaagttgtaaacaacagaggtgtgctagctgcttcctctcgtcctgttttcttttaaatctacaataggcttgcaaaaaagtttgagatcagaattccccccttccttgtgttaggataaaataccaccatca

SEQ ID NO: 46208 - DNA, 1501 bp, Oryza sativa
taaccgtagatccgtttcaggtggttcgagttgctaaatttttctaaaataaagatctacatattaaaattgtccataaattgaattaaatttatttaattctttttaaatgggctttaattagatttgatcttgtaaaattcataataaattcatttgaagtcgaaataaggccgttcaagtctcataattcatctaaaattatgatctacgtgtttgtttactttttatgtactgtttatttggtttttattagtttttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttgtttcaactgtgcatttattttcgaatgtcatcgggtggtgtgaacctattcctttgttatggccaatttgcattgaatgccctattccttgataccttggggtaataaaattgattagcttgaaccttatgtattggtttggttcagctaaatgttatgtatatatataattgcttagcaatgcttagaaacattagctcactaatgggatgaatcatatatactacattaatatttatggttatatttaatggtagctcacgatggttaatcgtgttatgaaaattaattggtaattaaaatatgattaatggtgggttgtgagcacatggttttgaaggtcgtgctcatggcaattaaggaccggttcgcgagctactgttgtgaaacatttatcgtgccaaccacaagccagcgtgggcaacggctttatcctttgtatagcatgatttattatagtgcgccagactgagaagtggcgagaagtccataggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattatggatgttatatctggtaataatttgcttagctcctggtttggagttagatctgttcagccgggtatggttgttcagaatggttgggcctgtgcagcatgggtgtgctgttcagtgttgattaaaatcgatgattaactactctactgttttacttatcttaaatgttttgctaaatgctgctttcgcaaatgagcctatattatgccatcctttggaatctttgtgcacttgcatatttgctgtgtggcttgttgagtatgtcatgtgctcattcttgcaataatcaatcaacctcag

SEQ ID NO: 46209 - DNA, 1105 bp, Oryza sativa
gactcaccagtgaccactgatcactgaccatgcgtgaagccgtcaaagatgatggtttgggtccgtgacaggtgaccttggccagtgtagtgtgtgctctcacgtgattcatcggttttgcatgccgccgcatttatccttcactccagtgtataattcttgcaatataatattaaatatattttagaaacatataatattcaacaatactaactgcaacactgataacaactataagaaacattgattactaacgagtgaaacatagaaaaaaaatcatataattaaaagttaacatgtatttgcagaaacttgatgatgttgaaacatttttatattatgtccgaaacattaagttgtaaatattgaaacattataaaatactcactaaaacattcaaataacaccatgtaacatttacaaattaactagtagtgaaatagcataaaatactagctgaaacatttaaataaaaccacacgcaatgtttaaaacaaataaaattttaaaaagctaaatattttttcatcggaatataaccatgtgctatgtgtgtttcctttataaagatttgatcacaacaaatttaatggtgtaatcggatcattgaataaaaaagtaatttgcaagaaataagtatttaaaaattatattaagagggaggtatgtttgcatgttatgggtgatgctgcaagatgcatgcattagagtgagagtgacaggacttttggggcaaagtacattactgcagaaagcctcatcagtgttgatttcaaactcctcataggtgccggtttttatgtagatttttcctcatgcaaggtgggagacagtaagaccggtacgtacgagccataatctattaggtgatttgtagtagtggtaatctcccatacattatagaaatgaataaacaaatgaagtataaaagaataatacagcttacagtttattgcacaatcaaatcgaaaggaatttcacacttacaaatgagtatccaacatatttgtgttgtactcgacagtataattaacaagaggagcatcaataatgggtgttggccaccgagcacttgagcctgacctccgtcggagtccaccaatgc

SEQ ID NO: 46210 - DNA, 1501 bp, Oryza sativa
ccgacggtgtgcgcgccggagagcgcggtgaggtcgcgctcgtcgaggttgttctccttgaacatcctgatgagctcggctaggctgtctgtcggtctcgggagatccttgttggccatgtccatgcgggcggcgagggagtccttgcggccgaggagcacgccccagctgggcccgccgagcatggcgacggcgtcgcgggcggcgagcgcgagaacatcagcgcaggagacggtggccgggcagctgcgctcgagttccgacttgatgtcttcgatcacgtcgtacccgacgacggaggcgttgggcttggcgtccttctcgctctccatggagtccgtagcgttcagaaggatggaggcatcacaaccctgcaaatgtcaccgatgattgttagacaaatgcatttcgtgatgctctaatggtggcctcctcgtacgatcgagagattgtggtgtacttacgttgacgaagcagtcgtggaagaagaggcggaggatggccggcgccgtgcgggggttggcggcggcgtggcgctccatgaccgagcgcacgatgctctgcgcgttggggcacgtctcgtcgtagtaactctccgtgaactcctcgtgaccgaagggatttggaaatccctgagcggcggaggcgagagccgcgacagcgacgagcagagcaacccaagcgacgccgcccttacacctaaacgccatggctgatggtctccctccggcctcgagagatcgatcacgatcgacaaagctccgaaacgagagatcgatcgagccctaggcccctagcttaatgattagcttcgccttggtactgacaaactccgaagtgatggtgagctctgctgctgctggctgctgctgattgcagatgttgtggtggatgatgatgagtaggaagcatgcgttatatagatggccagttaacgcgtggcgaacgtgcgcacgacggggtccctggtctctgcaagcgcaagacccagcaaagctcgtgcggcaactcgtgacgaggtcaccaacaagagaaaaaaatgggaaagtatagagaaaagaaaagtaaggaaacgaaccaaaacaaaacgtgtctctctacgggtagtggtcacatcgtacacttgcagggttgcagcaaatgaattgatcaaaggatatattcatcgctgctggacgggctagactttgatcattattgcatggtcggattaacatatgtataaactactgttcacatgtcttcattattctatttagcacgaacctaatcaattggtgacttctcaattattgattcgatgcctgcatgcatgcatctgttactccctctaccccataatataatgaatggttaaagttggtatggtctccaaaactaatttttagcttataatttctcatacattataaggtttgtagcaacaaaatgataaccatatgaaaataaatttaaatctcaatctaatgatataattttaacaaatactacatccatccta

SEQ ID NO: 46211 - DNA, 1501 bp, Oryza sativa
gatatggaagtaatccacacaaatcaatcatatcctaatataactctaactaccatatactctaacactgaccaccacaacacccgccacctgccgtcgcctactcgccaaaatccatcagctctttcttcattgccatcacttacttcattgcaactgattttatttttatttgctcacgatttaaaaggtatgataggatttggaatctatggttcatagaggtagaaggaggggatcgttctggcttgtggttaggtcgggacctagggccgggaggacataaacttaaccaagggcaaaacagtcttatcaagttgctttgtatttccattaaattaattatttttgtcctattaattgcatcagtttggacggcagtggcaaacagaagcacagaaaatcaacttcagttttaaatttgcagtttgtgtttttataatggctatttcgaattaggggttgaaagtagtggcatatttgcaattctccctaaaatataatatctggtcagccaaggagagaaagctatgcaaaatgtctatattgccctcctcttctaaagcctctataagtgatgaatatgttggtgcatctgtaggtgaggtacagcaggcttgaaaccatctataggtgcacctagacacatctgtcccattcatgtaaaaaatacaaagtatatggggcccactgtacaaaatacactggatgcaatctctcctcctccggagaaaattttggtgccatactgaatataaactccaggcactgcaactcggccacgctgaatgacgcttggacaaccgacctaccggacacatgcaagaagacgtttgttgcctcggctccaggtgcagcgcgatgacgaaacccgcggctcagctcgggtccacgcgctgacgcagtcgcgcgcgactcccatcttgatctcctcgctcaccgccgcccctctcgttcaattctgtgccgactgccatcttcggttgttgacggctgagtgatgcagtgccaacggcgtccacgccagcatggcgaagcgccagaaatgtcgcaagtgttgccgccgaccccacatgcatgatcgtcaccttcattgcccaagttttgtcaatttcatgtgtttctctctccattaaacacagaagtaataaaataatcgttgcggcgtctttcaacaaataaccaagctttttgggtgtcctatagctaattcacgttttagcggtgtctaccagcaaaggccacaaactttggatgtcatatagcaaattttgccattccgttgtatggtggctggaaaaaacttgtcaatagacaaacatttatcagcaatgttagtacaaaatacttcaattttctgcatgttctatcaaagttatgcaaattctggcaccatactcccctcgaccacaggggtgataacggcacatgcgacagctgtgcaggcgctgtcctgttgcctattgccctggtcacacactaggtttttatgcgttgcctc

SEQ ID NO: 46212 - DNA, 163 bp, Oryza sativa
ctatctagcaatatgcaggctcattttgctgggagaaaatcgcgagctataaatatgcatgcaatgcagcgttttctcttgcaagagctgcttagacaggagtagttgctacgagtacttgctaggaagaaactgcagtgtgctctgttccaaagagtagtga

SEQ ID NO: 46213 - DNA, 547 bp, Oryza sativa
ttgaactaatctagattctgaacggtgaagttttacctgtatattgaaaattctccaaaaaaaattgacaacattcacaacatatatatgaactactctaaaaaaaatcaagtaaagactcaactcacacattgagaaatgaaattaaaaaacaaatccagcattaattggtactattcacatatgaatttgtctttttatttctcaatgcgcggatcaaatttgaatataatttttggtagaatggtatatgctgtttatactctacattagtaattttttaaataattttacaactatttatattaaatataaaagaaaaggttatacgcgttgatattctctcgggggattagaatccctcttccgtgaaagtaacttacaacttcagattcttctgaatctttgctgatcaactagtataatgtacgggtgtacagattctgattaatcacaaacagatactgagagcagaagaaatatcaatatattgtcattacaacttaattcagtactggccttgattggctgcgattgctgctacaga

SEQ ID NO: 46214 - DNA, 366 bp, Oryza sativa
tcgagagctatcattcatttgaacccgcaagagctggaatgacaatatataccgtccataggccctggaaggtttagaactgatatttgggtccggcacatctgatgatctgaaggtttctgaagcaagcagattcaacattaatagtcaaactgtatgtcgtccgaagaacaccaatgcaaattttggaccatctcagcactagcagtaacatcgttcagacaatacaaattcgagcctgagatccaggaggcgacatacatacactgtacaggatgaacaaaaccgaggcaacgccaaatatatgtacaacgactaaggagcatttgtgcatccacgaacaccactactcatctcatctcaaga

SEQ ID NO: 46215 - DNA, 460 bp, Oryza sativa
ccttcgtggtgctttcacctgaagcaagcaactaggcctagaataaacaaacataaaggatccataaatatatctgaagttatgagaagctcgggaattgataccatcatgattgatcaaaaaacaagagggaaaataaattagtcttgtaccaaaacaaccattttatactcgctcgttagatagagaatatgatggagcattacacaactctccatattgcgctactaactccataattgttgtttttcaatgctccctttgtcgcaagagctcttgtgctctcaagcagctagtaactggagcaggcttctactagtctattcggctattccatcaccgcatgttcagttcagctgcataatgcaatgcaaagacaacgagaagttgtcttgtacttcgactcagcaccaatctgccatttgatgggaaattctttcatcctaacaacttctaatca

SEQ ID NO: 46216 - DNA, 151 bp, Oryza sativa
atatctgggtggtttcacgtggcatcctagtcagaaaaaaagaattaaaaaagtatatggggtccacatgtcagctgcacatatctctctcttctcttttcttctccctcccttctcttttctctcttctctcttctcttctttggccagg

SEQ ID NO: 46217 - DNA, 406 bp, Oryza sativa
aacagagcctatataactgtgatttcttttcctttttctccttatcattacaattaacaggtaaagtgcagtagggagaaggggggaaatgaagaaaaatggcgtgtccaaaatgtcatccgtaattaaataacttgcacaatggcacactctcgcgggaaacagtggaggagcaacatattactgcctattgtgtcaccgctttatcatcaacaatgctactacctccatttcaaaatagctttgtttatttttttttaaaaccaaaataattttgtttatcatcaaagtaagaaatctcaatgcaattttatctagcctcggtatatttatccttcacctttacaaacaacaatggaatgacttttgaaagatgaaactattttaggataaagataatgagaaa

SEQ ID NO: 46218 - DNA, 956 bp, Oryza sativa
cagttacgtgcaaatgacaatgtaattacatataatcatactgtattcacatttgaaactaaaatataaaattacagtcctatataactaaaattacatttgtaagttcagttgatatgatatgtaagtgcactgtaattacactatatttacactgtaactacactatagttacagtatagttacactgtaagtatactatagttacagtgtaactatagtgtagttacactgtaactatagtgtaattacacagtaacttttagtagatgagttggtgatattttttttgcgaagtaaagatctaataaataaaatatatgcaatatatataattaatatatgttgatacatatataaactcttctaatcaagtgatcaaatgagcctaatccaactatctaaaatctgtgtgatttggacccaaaaatctgtggcgcgatggatagctaggccccaattattttatattgattttaatagttgagatgagcgatacactcggtttttttttatggaggtataccagtcaaatcctacctaatttgagggagccacagtagactttttcctgcataagacatctccaaggcctacttagccctggaccaggtctgctttattcagaccagtccaattcatcagttccgaatgacgagccgcacttatgggccattgggcctacggtgaacatttcctatgacggaacatttcaaatgccgaaaactgtctgccacacatttaaatgtggggttcactttggcattttttttaacttttagagtacacagaagagaggacgtttaggatggtaataacgagctaatagttttttaaatagtctgcaaaaactatgatgcttcgaacaaagtacagatatacaaattcttaagctgtagttagctagctagagaaaaaaaataggcaaatataaacgagacagctttcacgctaca

SEQ ID NO: 46219 - DNA, 359 bp, Oryza sativa
attagcctgatttgcaataatccctagaaatcgtacggggatcgatcacaaattttgaacgacttagtgggatagagggaaccggaatattactgtcagcttgacactaatattttcctattccattatctaacaaaattagtgtcagtctgacttagctcaatgattttaacacgcgctttggccagtaaaaccatgaagcccttggtaattaccagccaagaaagtgacgctactcaaaagtaagactggtgttgtttcagctgtctgcttgtgccatatgtaccatgtcaaatgtagcgtctttgaattcgtccaattgtccagctgatgccgacttaacgatcgagccacggcca

SEQ ID NO: 46220 - DNA, 165 bp, Oryza sativa
ccgaggcgcaactaggtggttacaagggaacatggtataacaattacaatggaagggtcaaatgcaacaagttaggtaggtccgccaatctgccttgcagacgggacaagtagattaagtgcgatcctagcaatgcataatatttttcaagcaacataattaagt

SEQ ID NO: 46221 - DNA, 1501 bp, Oryza sativa
caccgacgacatgcttggatacccccacctgtgagtcaccgcttgcctctctccttcacatgggttctcctgtcgctttcgatttggaactgaactgctgctagatccttgggactggaagcgatcttagatggttggttgttttctgtggctcctcgtaatttcttagtagttaacgaccttaatcaccttattatttctgtaggagtgttcaatttatgctcagaatgacacgatgtgcagaatctgttaaaacctctacacttttttttttgcattggaaaatacttctacttcattcgagcattgatgtatcagggattacacaaagcaattaactcattttatggaatagttaatttgaatatggaaatggtgatttcgtccttcttttcatttaggtcacccaatctagtgtttcataatctggatttgtttcaactgttatgcaggcttgtgtttcataatctggatttgtttcaactgtcatgcaggctaatgtcacaaaaaagaagaatatatgcaatttctagagtgtgaagatttactcttctttttaaaaaacttggatcgcttaatttttgttccatttaatgggcacatatgatacatgtggtgattgataccctgcattaagtaataggccttattgggattagcgtatttgtgaccaaccatactatgcctggcagatttgttcattcagttgattctttgtagtgtgaaattattattatattctcttgtatcttaaaagaattagtactcactgatcccctccaccacccacatacaataaaatctacatttataattggttctgtaggtaaaaatggatgtaaaatctgtacatcgcttgaggtttctagatcagttattgtagttctgttgtttttgcgagtgctgtaaaagcgcaaacagctcttcagatgtgttcccttcagagttaatcttagtgtcctttgaaatagatttgatcatatatcctctctttagataaaaaaaaagagtattaaacctcctgtgccactgacatatagggtcatctaaggtcactgacatgtagactgaagggtaaatcctcaatttcaatctaaaagcaggtatatgatcaatcattacttgaatctttgataccatttcactgtcaacctgaatttcattggcgtgctaattcttaaaatatctgcacaaatatatatgatatattagtcagccatacagggggcaaaaaagcattcctgttaaatataaattcttattgatgttttcatctgcaaaaaggattaagagattaagagtaagattggctgttacaacatgtggatcatcaaattgttatactgtagtattgtagtttctcagagaaaaatcacagcctaaagcataatgcatttatccataccactaatttcaactgagcacctgcaaaatgccacaacttatggagcaagtttattaattcagttagctaccatgatccccgtgttttcaatttgtt

SEQ ID NO: 46222 - DNA, 1501 bp, Oryza sativa
gacaggcaagtataacaaaagagagcatcatttcgcagcaaaaatcgtcgtctagctgtaccaaattattataggcatgtggcctgttcatgattcagggagaaggtacaccattggaaaggaacattgcaatttcttttcgggcaatccattagtcggtcacactcactcgtgctgtgtacttctggcaatcggtaacattctaaaaccaatgtggagaaacatagcgacaatggtctggcctaatgcttctactgcttctcgcctcacatctgaggccggttaccgagcatctgacctaccatattagttacctgaaaaagattttaacccaaagttagacttagtggcgttggtaatttggtacaaatggaaataaattgatacaaatagaaataaattgatacaaatagagcaaaattaacccaacagtcatttcaaatgaatcgggaaaatagtattcagtgttcagacgaggggaaaactcgaaatagaaaaacatgtgctctgcatggatttcaaccactgcctatatgtccaactatacaaggcgtgaagatctatggaactcatattcaatgacatttgttcaaggatgaaccctatgatttagtaagatgatctaaattctctggatggagatcagatgcactaaaaagatgactttcttcacaacacaaagtaggaaagacagtcatgatacatattcagcatgttaccaccaagctaactattgctataaaaactccagacatctgaatcagcatcaagcatgacagcaaatatataattatcagttaacttgcctgccagtacttcgaaacacatcgatcaatgcaactgttctcacccatattgagctcagcttctttatacctgttgaaatagaacaaatcccaggggaaaatgcacagttaattcaacagatgatagttactagagaacaagacacatgatgaatagaaatgcccaatattggtcaccttagttgaaatatattgatatagatatattctttaccagcaatattttagtctatcatcccacaaccatgtatgagaatgctaattgaaaccaaacagaaggatgagaaaataacagcatgaaacggataactcagctatgtgaaacttaaccagacgatatgtaccttttctcaatgcacttgtcaaaacaagtctgtgtaagtctgcataaaggaaaaggacacaaaggcgtcaaattagtgccaaaaagatgaccaggagtgatgtgggctactgggccaatcaaaattaccactcaataagatacttaaatactagaatcgcacaaagcatctcagtacaaacaagggagaacgttgctaaaatatacctgggcctaaaaatatattaactacctgcccgcagaaacttaacattgctaatgccaacctaattgatcacttctatttatcaccgaaaatattgggtgctaacagatagtataggaagtacaacttgccagtaactacagatat

SEQ ID NO: 46223 - DNA, 186 bp, Oryza sativa
aaaaaagggtgaagaaaataaatcatatccatccctttcgcactaccgtttgaattttttttggaatatatatgtgtgtggtttgttcggatttgggaggaaagtgaggaggtggatgctcctgatttccgtgaggaactttgctgctgttggttgcaggtggagctccggtgatcgacgccgcga

SEQ ID NO: 46224 - DNA, 241 bp, Oryza sativa
ctagtactattctaataagatgaaataggtgcaatgcatcaggagttttcagatgtccagaactgctaccaccaaaaaagaagaagaaaatttctgggtgcagaacgaaaagtcgagcaaacaacagtgagaaattacgaaatcagtgaatctgtgctttccttgtttaatctcagtcatacaaactgaattctgaaccctgaactctgaagagatgcattcaagtacagcacagcagaca

SEQ ID NO: 46225 - DNA, 1501 bp, Oryza sativa
agccgcaggtcgatcgaaaagtggaggtgtgggggacgaacgaacgaccgaaggcgatatgcgaggcgacacgacacgacagcatgtggccgtggggacgacgctgcacacgttctgctgccgccgtgccccccgcgcccgcgacgccacggggacaccgcgctttcccctgcctccctctcctttctgcctctccctctcctcctttctactaccccttgctatacatgctactatgcagctactgatgtttgtttctttcctttctctttggacacttcagattatttttaatcaccccctgctggttgattaagcctcaaaggaatccagcaaccagcaggtacaaacaactgtcagctgtacgtacgtacctacatggtccctctcttgttaggagtaggagtatataattaagcatgagcatgcagcatctcatctcgctcgctccctttcgctttcgttgttttggggagcaattgattagcacatctgcataacataaacaaaggcggcgtaatctgataagcatctgtatgctggcctctccgatgggctgcaggccttgacgctttctagctgccctcaacttaatccaggttggcttcagttcgttcgcggcttcgcgtcgcttgcgcgcaaggcctagctatccacggaatggaatcacttcctccgcactttagagggatacaaacacaaaacagtctaatctaagcagcctggagatcaacttcgtttagctgatcagatcagtagctggggttaggccctgtgtagatctcctggtaaaatttttacactgtcgcatcgaatgtttagacatatgtatagagtattaaatataaataaaaataataattaattatacagactgcatgtaaattgcgagccgaatcttttaagcctaattgctccatgatatgataatgtggtgatacagtaaatatttgctaatgacggattaactaggcttaataaattcatctcgcagtttacagacggattctgtaatttgttttgttattagtctatatttaatatttcaaatatgcgttcgtatatctgctataacacattaaaactttacacctctaatctaaacacgggagcgtatcctatgcacacaggccctcgcgtcgtgtacaccaactaaaaattattacaaaaaattctaagaaaattcatacatgtactttcaatagtattacatctacgtgcaaagtcgcatcttcaaattcattctacatagagaataacaaaaaagataaaattctgacaaaattgcaaccttaaaactgtcagattttttgtttttttgttacggctaaaatataatgaatttgacgttaagattttaaccctaggtgtaatacaattgaaagtatgtgtatgattttttctagattttttggtgacattttttagttgatgtgcacgtgtgtacacgtgagggccggtgtgtataggatatgttgcctctgaacacagccttaatata

SEQ ID NO: 46226 - DNA, 205 bp, Oryza sativa
gcatttctagtacaatcacgttaatggatcgtactagagacgtagaaactagtgtcatatatggaggctgcctaatgattgagtgaacataatcatgcgtgatgagtgtgtgagtgacaagttggaaattaaaggatccatcaaatgtcttgaacgagattacatcttcgttaagtgcagtagacgacccaacggtagctgaaca

SEQ ID NO: 46227 - DNA, 158 bp, Oryza sativa
ttttctacccgccaaaaaaaagcatttcaatttctgccgctggtgaattttaatgggccgaagtagtggcagcctgccaagtaaagagtaggcctttgcgccgcgaaaataagccggcccacgccccatccaccacgtagcacgctcaccggcataga

SEQ ID NO: 46228 - DNA, 155 bp, Oryza sativa
tggtgcagaacgtcgtcaattgtggatttgcacttgagaatatgagaaagtgagactccagaaaatttggaaggagcgtcgtgataagttgcaagaaggtgcacaagataaggcaagacctctaggagatcattctgcaactgatggccctcagg

SEQ ID NO: 46229 - DNA, 234 bp, Oryza sativa
ccctacccctaatataccattagagcccccataatattcctaaaattctaatctatatatttatactatgtattagaaatatagccaatttatatgagacatgtttcaatttttattggccactttggtttagccccgctataattttattctggctccgccacagtcaacaagccatgtaagatgaaactgcctccaaaactccttttgcaccagtttcactaattggaagca

SEQ ID NO: 46230 - DNA, 456 bp, Oryza sativa
tttctagatctgtatttgttctgcaacgcgaggtgttgtggttgatgcgattcatgcgaaaacttaatctgtcatacatacttggaagggtaaaaaaagaaaaaaataatctcctttctactggagatgcatagcgtgggaattataattagcctcttgttatctgctagcctggttgttgagcgaagctttcggatccaaccttttaattcagggtagctttatgtagtacagaaaactgtgtaactgtattgtgtttcctgttactttcttttaaaacaagttctggttgaaaagcgtagaaacagtcttaactggcatgtcttgttttcatgcatatgtgctgtgcagtagattaatccttttacctagaacttctcaattgagttttatgttagttgattccaactagtagttgtccatgactgaccttattgcatcttcttcttttggcag

SEQ ID NO: 46231 - DNA, 375 bp, Oryza sativa
ttctcggtcttgtcaacaaaactggaaaatattaacttacttattttgagaaataaaaattgaaatatggcatgtagcctataggaacaaacatgaacttgcaagatttcagatgatctttttactcttacctgtctacaaaacttttagtcgaagccatcaagtaagtatatatgtagctgaaattgtacagaggaacacagctgcagtagaaaaggatattttgaaatgttaatgttgaaaacgtctataagatgataaacattggtacataaaaaaaattgaaattcaaactacaacataaagacttaaagcatactgactagtggggaatatgatcagaatgtcactctaactctctctaacctatagaga

SEQ ID NO: 46232 - DNA, 1501 bp, Oryza sativa
ttaactctgaagggaacacatctgaagagctgtttgcgcttttacagcactcgcaaaaacaacagaactacaataactgatctagaaacctcaagcgatgtacagattttacatccatttttacctacagaaccaattataaatgtagattttattgtatgtgggtggtggaggggatcagtgagtactaattcttttaagatacaagagaatataataataatttcacactacaaagaatcaactgaatgaacaaatctgccaggcatagtatggttggtcacaaatacgctaatcccaataaggcctattacttaatgcagggtatcaatcaccacatgtatcatatgtgcccattaaatggaacaaaaattaagcgatccaagttttttaaaaagaagagtaaatcttcacactctagaaattgcatatattcttcttttttgtgacattagcctgcatgacagttgaaacaaatccagattatgaaacacaagcctgcataacagttgaaacaaatccagattatgaaacactagattgggtgacctaaatgaaaagaaggacgaaatcaccatttccatattcaaattaactattccataaaatgagttaattgctttgtgtaatccctgatacatcaatgctcgaatgaagtagaagtattttccaatgcaaaaaaaaaagtgtagaggttttaacagattctgcacatcgtgtcattctgagcataaattgaacactcctacagaaataataaggtgattaaggtcgttaactactaagaaattacgaggagccacagaaaacaaccaaccatctaagatcgcttccagtcccaaggatctagcagcagttcagttccaaatcgaaagcgacaggagaacccatgtgaaggagagaggcaagcggtgactcacaggtgggggtatccaagcatgtcgtcggtggcctcgcgctgccggaacttgttcgccttctcctcctccgcggccgccggcgctgcggcagccacgagaagggcgcataccgccgcgaaggcgaggaggggacgcatctgagtacaaaaccctagaccccgagggcctcgccgcgccgcggcggtcgccggcggtggagagggaaggagatctcggcgtggaggcgccggtgtgggaagtggtcggagactcgtcgggtggggaatccgaaatggcgaaagagacgaggggttttctgtgaaactgcgggtcagatcgtctcagcgctcgctgacgagtgggttcaggatgggatggatggcgtgcttgcttacatgtggggcccgcatgtcggatcgaacgccagcggggcaggcagacgagggtgacgtggactctctgtagcatcaatgggactcatcttttcgtctagacgtttatgtttatcaactaaatttaaatttttaactttagatttgaagttgattttgaggtttttttttcagagtttattttttagtgttttcttttagatcattaaa

SEQ ID NO: 46233 - DNA, 639 bp, Oryza sativa
acttaaaggaatctgcttcctgttactgaaaataagtctggtagatcaccttgctaagccttgatctgcctatcttactcctgtagccctgttctctgtgttggtaagccttttaacctcatgtactgttttcacggttgtgattttggaacagaaacagttaccaatctcttgtgcgattaaaatatgcctttttgcctgccatggtaagcttatgggcttttccaacatgcaggtgaaggaaatttttgaaccaatttttaatgatcatgctagaaagactgcaaaggtcctactggtaaccgccagtgatcattaagcccagcctttgttatcatccttgaaattgcaaaattggaccgtgaccaatgacttgcatggccacttttttaccatatgcaagcaggtatggaaaatatttacagtatgtagtttattgccgaacatcctatttatggggaccaacccagaactgtgccatgcacctaaccttcccttaactttttccagttgaaaactggtccctaagacttggggtttacttgaaaaggaatttgtagtccccccatattcttttgattgagattggctgcttttcttttactttgacaacttacatttctctggattttcttcagt

SEQ ID NO: 46234 - DNA, 230 bp, Oryza sativa
cactgtgtgctctctgctagtttaaagctggagtttgggttatattatatcggaagcatcttgtgacgtcatcacctaataattatttcttgtgatgtgacctcatcaggccagcttgctagctagccgccatgttcttggattaggttacctaattatgtatacagtacacgaatcttaattaaatcttaatcgtttgttatactgatgattcttcctaaacacgcagg

SEQ ID NO: 46235 - DNA, 472 bp, Oryza sativa
aggattacattagctcggtaggcagtagtgagcagggtttacgattccgacaggcccttctgttcaggtactggcggaatacggaatttcgcaaaatccggtgaaaaaccagtaaattctgaacaaatttcataaaccaaaatttgaatacaaattccctaagtttgccgacaagttctcgaaaaccggtcggttttggcgaaattctgatcgaaatcatcgaaatcagtaaatgttttcctttttttatttccggtcggtttttgcccatgtaagtgttttccttttcttgattatttattcttttctttcctgatgtaagtttcagtaaatacatacaatacatcatttttttcgaaaatttatatcccaataggttctatgaatatcatagtatttataaaattttatttgatttttcttttttatcaattcaaattttaatttggatgaaacttctcgaaatctcaga

SEQ ID NO: 46236 - DNA, 193 bp, Oryza sativa
acattgtgaaacggagggagtaaatcggcttggtcccaaacaagtttttctgatttatggttttcgtgccaccacttcaacagcagatcagcaatacttcagacactcttcagtgttctgttctatttgcaagtattcgctggtccacatctggagccaattaatgtaacattcatttcatgcactatgtagg

SEQ ID NO: 46237 - DNA, 1501 bp, Oryza sativa
tcaaattaacatgcgagttttttttaaagagatttcttatacgactccttctgtatttgcaaaagcaaacgaacttaaaaaccgactcaaacactgatctatattttcaaaagcaaatgaacttaaaaaccgacttaaatatggaggacgtaccaaaataccggtaaaaacatctttaatttttataatagtagagatggtaaatatcaaatactattgtttctctccgattctttttgttgttgttcgtggctctcatcttcttattattctattggatctactactcgttggtgctgccatctgattggcatggatgacgatccagagatgtgctgtttgtgacgctccaatcgcaagaggcgagaccgcgagagcaacaagtacaccatgcgccggcgctcttctcttctcatcctgtgttactccagcccagatgtgagcatgtggcccgtgcagaaaaagaaaaacagatgaaaggccacgctagggccgtgccggtgaaggaaaggagagatgggctgagccagctggttcgctagggccgaaaaaggagagaggaaaagcgggccgtcgaagaaagagatgattcagcacatcatttgtattttctactagtgtgctttttttttttggaaaatatctgaacgtatttggatttgaattcaaaaaattagttggaactaaggaaagattttaacgaaaatatcaggaaatctatttttgtactttaacccctctctccatctatttcttctcctcctatggcgttaggtgttgctactcgccattgtctcatcacgctccgccttatctatggggccttcctcgctggtacggtgctctatctgccggtgcccatcatcaccatactgggtgaaaacctacattcattcgcatctggctggtctgcatgtttcgcagagcaaatggtctcgattagtacattacaacaagtgcttttcacggttggaaaggtcaaaagaggttaagctatccacttgcccagaccaagcaggcgtctggtagatgaatgcattgatcacatgctcagccgcataatccgggctaccataacactaaagaaaagaaagtcataccacattatcacagctcgtaacataaaacttcggttgactcgcactttgatcatggagacatatgatcaaacttacagtgtagcctacatatttactgcagtagtttgcatcaaggaaaccgaagcaatgccccttgctaacacactattccattcgtcccataaaaaatcaacctagtaaagtggcacattctagtacaacaaaaagacatacgtctgtttagatttgttatactggaatatgtcacatctagtcctagattctttttttttaagaacggagggagtacactactactcctatgctgatgtgtgttggtactagaatgctggttttaaagtggagattagtggctcattagcatcgtttgaatggtggttgtttagccgagggaattggtg

SEQ ID NO: 46238 - DNA, 1501 bp, Oryza sativa
ttcaccgaacgaaatgaatcaaccgaggaataacccggcttacgtgcgagcgttccttgcatgcgtgcactggattcggggattcggccgatccgcgagcacggcacgacttgtttcgtcgcgcgcgaggctggcggattcgcgggtcgattcgccggcgcgcacaggagtggagtggagagtaatgtgtcgatcgagtggcctcggaagttggggctacagatagaagagaggggtagcttgcagaaaaccaggacggatttatgcatgcagagcctccgtcacgtcgtcgatcggcaatgcaccattgatgcgaggtgaaggtcgggttggtggcaatcatggccctgtagcaatgggcgccgcagagatcagatggtcggagttgagtgacagatattctttctccgtcgatctctatccatgctgctgctgctgcctgcacgcatgcatacagtgttcgttcctactctcagctctcgtctcctcctgctcatgcatgatgcgcggctatatggctggagtagagtacctaggtatagcacggtgcacagctctagctttagctagcgacatgttggatcgaatctggcctgtttggtttgcagggacttactctctaagtctctttcatatcgaatgtttagaaactaatttaaagtattaaacatacactaattataaaacctatttcataaccttggactaatccgcgagatgaatcttttgagtctaattatgctatgattttgacaatgggatgctacattaaacttttgataattatagattaattaggcttaaaaaattcgtcttgcggattaactctcatttatggaattagtttttttattagtatatatttaatacttcaaattagcatccaaacatctgatgtgacatgggctaaaaagttttagccccatctaaacaccctagctcagctctgacatggaagatcttcccaacagttatcaacgccaacaacagatcgtattctgcgttgcgttgcgtgtgcatgctactcgatgggagtactatatactcctatattaaggctgtgttcagaggcaacatatcctatacacaccggccctcacgtgtacacacgtgcacatcaactaaaaaatgtcaccaaaaaatctagaaaaaatcatacacatactttcaattgtattacacctagggttaaaatcttaacgtcaaattcattatattttagccgtaacaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcttagaattttttgtaataatttttagttggtgtacacgacgcgagggcctgtgtgcataggatacgctcccgtgtttagattagaggtgtaaagttttaatgtgttatagcagatatacgaacgcatatt

SEQ ID NO: 46239 - DNA, 1501 bp, Oryza sativa
cccaaaattccctcccaagaggatatcatgatgttatgaggtttacacatttcctgacaacgaaggtgagagttttgcttttttttttataggtaactccggtatttcattttatttttgccgtatgccttaattagctcgagttcatttgaatcaggcttatcattctttctcacaaaagaaagctaaacatgagtactccattatgatttggaggaataataacgtattagtctcagcctttccatgctctagcaaatggttaatatgttaatggtatttgcaatgagcagggaatcgatttgggcacagcttatgccttggtccatctgtgcttggataaaaagctccaaccttcggagctcattctagacaaacacgagctaaagcagatcgattttcactgtgagcgtgctcattacctcctggaatacaaagggagcatctttggtgattccaccgatctggatgcctgcaagaagatgctgaaatggtgttgcaaacttcgcattgatcctgctgcgaccatctcttcttgattcccacgattcaatgcactcaatagagaattagggatattgtgctatctcgaactcatgtttaattagcaacgaatttggtagtcatcacgtttaattagcaaatgtattctcatatatcaagattgagttagggtcctattatagtctaatggacttgaaagtgcatgaacctgtattcgttgttatggcattagattatgaatgtgcaagttgccagtcacatgataatcttgatccctgtgaagatcatccaatacagcaataattaagtgcacaaaagtaacttaaaatctctgcgccccatcatttcgcttattcgtggaatttaaaaataatctgtgaaaaacttttatatacatattcttagcgatctaaaagcaaaggctaaaaaataaacttcgatgaaaaaaaacccaaaatcaactacaaatttaaggttgaaaaattcaaattttagctgataagcataaacaaaaagatgaggttgctacaacatgtactatttttaaaaagctgaaacacaaccaaatcacctcgtgaaacatttttctataacgtatgaaacaacagttttaaaaaaaaatgggcgtcatttcaccctatataaaaacaatgtttcaacaaatagtgaacgaatgttttaattcactgcaacatttgatccatacatagtaaaacatcacgagtatactttactaaaacattgttggtggaacaaaaaaaataaaacggatttccttaatagaaatgttttcgcaatatacgggtgctttgttgcaacgacgcgtgtggtggggcgcgtggaaggggggggggggacaacgtgggaggcggcgggcacccgacttttttgccgctgattgggcacccgatcgcttgcattttccaaataatatagcttgatcagtttttagagagataacagagaaaatagctacaaattgcaaaaattgaaatta

SEQ ID NO: 46240 - DNA, 1501 bp, Oryza sativa
tgaaattcacttcagtcacctacaacaacactaaaccaacagccgttaaatatgcaaatgaggtcattttaggtctatgagtattcgatgaaaagctcttatagttatctttccaaattttctgacctcatatccatatttcatccgagtcaacggaaatcgtacaaataaggtgccacatcgtctagaatggtttttcaggcttgtaactaggtggagcacaaccctagacatccttaggctgtcctcccacctccgtaaatagctaggtatatattctttcagagatttgggggttttgttagatcgaaagttagctaatgctacttcgattgtaattccatgtattggctagaccgcctaattacttgtcttcaaaaccccacctttgtgactaattcatattgtttgtttatatttttgttagttatctgttgcttacgggaacaaatgccttatggttggtcgcacttcgtcaggattatgactcacgagcaaccttgaaattagtgtaacgattgctgaggcacatcgtccctggacagttatagtcgggtggccaacttcttccccatgcatgcaattgacttatcccctcttattgaaagatcgaaatacctgagaacacatcaaatcgtttcacctatagttgattatgggacgcaacatttattagcaactaaaaataatttatgagtaaaactgttacatgtgttaaggaaaacattgaatcgtttgacctatagctgattaagggacgcaacatttattagtaactaaaaacattttagttatggatagattcttttatgtattcttaacaactttagtcaatgctgaaaaataaactaaagaaaacccatcaaaatctattcattaaatttaattcttagttttgagggttataggacggatcgcaggctcgcagcacctggtacacctctaacatgcaaccgttgtttttggatatttttgagtttcatttatggattttgccttgtactgggatatcttggagaatggaaacttattttttttaattaatagctgcccatttaattgatgccttgaaaagatatcttcttcaacagtttccctttagaaaatgttggtatattcccagattgttgtagaaagatttaaaataatttaaattttaatttggtaagcattggtgaaggctacaagaatcaagttgcctctagccctctacacgtgaagaaataataatcaaaaattaaatttaagacaaaaataaaaaataattatttacattcatttttttaaaaaataaagtagtataaaaaagcaccgggtccttgatgaacaggggaattaccgaattagggaggggtgataagacgaagcaaatgatcatgggcccatttgtcatgggccgagccgctggttggcccaccaagcaagcggcgctgctgcctctctcttccatcagaagcccacctcccatggagcccgtggcttcccgtctcatcagagaaga

SEQ ID NO: 46241 - DNA, 1501 bp, Oryza sativa
cccccgggaagtcgttgctccccccctccatcgcagccggggtacgatcggggcaaaggcaaagacggatcggagctcacctcgggcgagaggaggatggctgtggctgggggcgatcgtgcgcggcgccagctccgccgctaccgcggccggtggaggatcggaggagaggagggagatcgcgaggtgaggcggctcgcgtgcggtggcgcggccgtggcggagtctgggatgatatgtggtgtggtgttgacgagtggtgtgcgtgcacggcgcagcagccgccgcgtttgcttaacgatccaatttttatctgaaaaacaaaaaacataaatacgacggtagtagtattttaacggaatagctaacgcgggcctagaaaaccatgactaaatttagtccctctcacatgtttctgtgagagggactaaagtttagccctactttagtccctccaaccaaacaccacctaatagctaatcttataataacagtagtctacttataaataatttgttcgagaagtttaatattttgaaaagcagacggttgacaaatcagcttttgagaatttgaaaaactatgttttcctagctttggacttttagcttatttttaagattctaccattacaacttctcaaaatctaaattaaaggctgaactatttgagaagtttctaattctggaagaaattgaaactagaaatttctacaaaaagatcccgaatcttataactatgattaccacaagtagatcgtaaatcttatacctatgtattgtaccgatactaagggtctgtttagtcggtgaaatgaaaatttttggatgtcacatcagacgtttgaccagatatcggaaggggttttcggacacgaatgaaaaaactaatttcatactccctccgtttcacaatgtaagttattctagcatttctcacattcatattaatgctaatgaatctagacatatcccacattcatattaatgctaatgaatctagacatatatatctatctagattcattaacatcaatacgaatgtgggaaatgctagaatgacttacattgtgaaacggaggaagtaactcgcatggaaaccgcgagacgaatcttttgaacctaattaagccgtcattaacatatgtggattactgtaacacttatggctaatcatggattaattagcctcaaaaaatttgtctcgcgatttacatgcaaagtgtgcaattattttttggggcaattgtgtttcagtccttgatttacaattcaattgtgattttacccttactttttagggtttgtgattttgcccctgcttttatgaaatgaagcacccgtctgcctctggttttgacataagtttggtgggcctgaaatttccgaattaaacgaataaagaaaatgttattattatttgtgaatgaccattctacccttggttcaatgagcaaaatcccgaattcctttactgtccgggttgcaagcgctgggttgca

SEQ ID NO: 46242 - DNA, 1501 bp, Oryza sativa
tggtggtaatctcccattaattctattacattctggtcaatcaggccattggtgaagaatttgttgagtttctggagaacgaactcaagatcgatgactcaagtgatgcggaagacaatgcaaatgatccgtacacacagtctggaggcaaaaacaagcaagatgttaatacatcgacaagtagctttgatgatagcgtatctgagatagaggctgctttggagaagctgaagaaggaacttgggctcagctgagccatttgataccgatagcatagcatatcatactgctgcaactataggtctatagccatctgcaactgacttggtgttcttacgaagttatttcttatactcaaatgttcttggatgcatgatacctatagccatcgcaacctgcttggttgtctgtgtgcaggtatttgatgtacccattcttgtcttcagaaggtgatggtagctcagatattgttagtttaggtgatacagctcacaagttcagggcatccagcctctttataagatgtttgtggtgtcttgggtgtgttctgcacttgtgaaatttttgggagtaaaagatgatatcctgttacacagtgtatgttgtcatttcgtgcggccaaaatgggtttaattttgacatttcgatgatgaatcttacatgaatgaattaatatgcagtgcttgtgtaattatgctgctatatgggctgcacgtaagttgcattcccgttcgggcccagaaagtgttcacggcccacaactcccgattccagtgtctgagcccagagcctcaccctaacccggaccaaacccgcgccaaaaccggctgggccggttccccaacccccgggatccacgtataacgggccaccggaccgaccggaccggctccactcccactcacaggctaaccaccacacacactctctctctctcctctggtttctctcgcgtcgcctcctggttttttctcctcctcatccgcttcgcctccggctccgtctccggtcccctccgatttggtggcggccgcttcgccttcacgaaaaaaaagccgggtgagtctcgcctctccccaatctcactctctctccccttcatatctggttcgccctggtttgcttggttttggtcggtttattttctgcgatggcgtcgtcggctaatcggggattactagggatttgatttgacgcgagagggtgtcgtgtccccatcttcctttgggtttgtgggttttggggggtattgctcgagaggaaaatcaccttctgatacgagattatgtggctctgtctctggaaatggtttgaggttttgattcggagtgggctgtgccgtttcaatggaagtttgttggtgtaaaatccgtgtgaattcgcagttggttgggctcatatggtaggaatttttgcggcaatggcggggaaatggtagtaacagtgtgggtgtggtgatgggtattgcgatgcaggagagggtggttgctcgcggcggaga

SEQ ID NO: 46243 - DNA, 1215 bp, Oryza sativa
aaagtgtggcttgcaaccaaacacacccgctctctgctcctctttgctttgtcagtttgtccggaaggtgttcgattaattggttccttgtggtaggatagtacgagttctcccgttggcgctggtgagtttccagaggcgatcctttagctgagatggactccctctgtccaaaaaaaccaacatagtaggatgtctcacgttccgtactaggttggtttttttctgacagaggggagtagtaatttgcgttagtttgctttatgatcgttacttgaagggtgtttatcttccggcgccatccacgcagactgcctttaccgtactactgtaagctactgctactttgtactcctttgatcgcaacactatcacagaaagtcgttttatacatgggaaattcaactctagcagaacaggagaaattccgtgttacgaaggaagcttagtagtccaaggctcccttccattttggttcttgcttggttttgatgataagtactgatatcagcatgggttgtacttgtaccattggtccccagttttcttgaattgtgtgaagcccttccgatctcaacgtattcttgatgagactcgagagccttgctgttttctcattcttgaatatatctttaatttttatgatgataatttttatggctgtatcatcattaacgaataaggatagctgaactattctaagcatcagtttaatatatctgcagaaagcattttgtctattcccaatttttctaaacccataaccacaatggatattccttctatatgttcatttttttaatgtcgaatccttcgtactaacaaaatagaattataaaacatcttaaaataccgataacccttccggttatctagtcgaggcagtaatgcagtattgataactaatggtgcatttcctttatggcaaggatattgccttttcactttacacaagcagttcttatgggttaaaaaaaatgattatcctgcttcatggaaaaccttgattacatagtgctcatttctcctactgttctctctgcacttgttgtattgactaatttttataggtttttgcacacctttatgaagttcagttttcttaaggtggcaataagactagacttagttttgtccaataggatttgatcatatatatatatatatatatatatatatattgttttaacttgtagaatgttttatgttattagg

SEQ ID NO: 46244 - DNA, 168 bp, Oryza sativa
ccatcgacccccgggggaggcaaaatagacttttgcggaggaatttgatttggaaggattggattcggaattggacttgacgatagatcggggattgagatcttgagatggcacggacactagacaacaagcaaagaaacaaatttcgcaattagggtttttaagaga

SEQ ID NO: 46245 - DNA, 1501 bp, Oryza sativa
aaaattttcagagctagttattttgctaccccatcatgtacagaatcagatgcagagtacgtatgtcacgcgtgatggagagtatgtatttcacgaggaggttgcctcgtgctcctcctctcccgccgcccgcccgcagctcgtcccccgccgccgcctcgtgggcctcatgggtggtggccggcgggggagcccgcgtgccgctccttcccctgccacccgcgcgccgcgcctctcccggccgcccgcgcgccgccccttcccccgccgccgcgtcgcccgtcgctgcgtcgccggtctccggctgcaggtcgccggtcgccgacggcctcctcctctcccgcctcgcattgccgcagagaacggagagagagagagatgaggatgggagagaagagaagaaaagagagagaaggctgatgtggtaatgctgacatatggggcccacctgggttcaacgctgactaagccgtcatgtaggacaaaaccagggtcaaaatcacaggaggatctgaagtgaacgggtcaaaatcataggaggatctaaagtgaacggttttgttagttgagggaacgtccggtatctggttttgtggtcgagggacgattttgtaactcgatgacaagttaagggaccttcggtgtactttttccaactaattttcatccctgctgccgaccccatcctcagggccgagcgcaccatggccaccgacctcgaggccatcatggcttccgactggtcgttgaagcctccacaccgccgccttctcgtagcagccggtgccacagctagaaagaagtagtcgaggacgaagcggccagtgaaaagggggagaaggggaatgaggtgtcgctggagatagagaggagaacggggatcactaatttttatcatttgtcttaccgacatgtgggccccacaattgtaaaataaaattatttatcatatttttgcttccagtgtcacgtgaccgccacattaaatgaagaccgaatcaaatttgccatgtagacgtcacgtcagcttaaatcgttgttcaaaccgccatgggaccaccggttttgacaattaagggacttgttgtatctagttttcggttgaaggacaaaaatatgattcgttgataagctaagggacctttgatgaacttatttccttttcgtaatccgggcccaccaaagaaaggatctgactaggtgggcccaatgacgacgtggggaaccaaaagacggcccggcccaagacgccttttccacctgaggaggcgaagcgtaggttcaggaacactccggactcctccgccgccgcgtcccccgtctctctcgacgacgcctcgactgacgagaggaggagacctctccctcccataaaagggggaggacgagggcgaggaagaggaggaggcttgtgctgcttcgtcttttcccgccgccgcgcaccgacgcctgaaccaactgtctcgccgtgaaccctcgccggagttggtagaggaggaga

SEQ ID NO: 46246 - DNA, 353 bp, Oryza sativa
ttaatagttgttaagtgctgattatataatatttgcactcctgtagttgagagcccaatgtttgtcccacttccaacttaattaaaaatcactgtactgcaataccttaatttgtcgcatgctgttttcacattttggttgcacatattgatggttcttaggtggaaacaactttactgaaatatagttcatgtataatttaacatttagttaaattgacagcctttttttactgtctgtacttgcacagtttgcaaaaatgaactataaagatgcataaaagttgatctaattttttatacttatgtttgtcctaatttttgccatcaatattccttttttttttggtctca

SEQ ID NO: 46247 - DNA, 1357 bp, Oryza sativa
acttaaatttaatgtgacttatctcacatgatgtcttgaatgtggggccggctaatgggcgggtgaccgccctaggcgatcacccccctatctcccctatacacttctctcttccttcatcctctccttctcttcctactacaccataaattttaaaaaaataaaaaacacaaagttaaaaaaattatgtatagaaatactatatataaaaattttgaattcaaattcaaatttaaaacaggtatgtaaacttttgacttataaactttgggtctataaactaatatttgaattcaaattcaaatttgaatcaggtatgtaaacttttgacttataaactttgggtccataaactttaggtgtataaaatttagatgtatagaaatactatatataaaaaatattttgaattcagaatcagatatataatcttttgatttataaacttttgatctctaaactttatatgtgtaaactttaagtgtataaatttactataatatgaaagtaatgcggtgccaaaaaaagaaaccacgtggagaagagggggcgtgctaggagcgatcgatcgccccttagcaatcccgtttggatgttgggtagaaaccatgtcgagacatggtttccttctttttcctcatttattcacttgccacattatttttcattttaggttgcagcttatttgatgctatggacaccatcctagttattgggttgggaatgacctaagtaactattgtatgaattagctattaaattagctatagataatttggagttagtagttatggttggctatactaaacttgctagtagggaataatctgtgcacaccagactctcgtgacaaggttcagtaaattcagagggaattagttggagccagttcaaaaggagattcttatgtggaccatagtggccttcggcaatatggattagtagtttagtactgtactactccttttcgagtgtgaaatgtataggtaaaggagaatgaatagatgctgtagttgtatgtgctttaattttcacggtggagaacaaaagttgcgcttgcttgcagaaaagagaaaggcacggtcgtagattatttaagcttcagaacagagagacaaacagacatctacacttcgaagctgtgtaaacctgtgagagtcaatctctctctactttccaaacatggctgtaagctctactctgttcttctgtttatgcaacagtactgtataattttaagctctactctgttcttctgtttatgcaacagtactgtataattttatctgtagtactgtacatctactaattgatcacgcatatgcttctcaacaacgggtctgaattttttttgttt

SEQ ID NO: 46248 - DNA, 1369 bp, Oryza sativa
gttacatggccgttctacttaatcttattatgtgttgccatgttagtggtcaaatctggagaagtcctattaatgattggaaggttcgattttagttcatatttttacaacgaatctttcatgataggtgtacttccttggaagaaatatgctgcatgcgcacagaatcaaagagttgctaaaattggaggtagaaagaacattaaacacgctctactgaagcctatggaaatcggacgcatttaagcgcattcaactcaagtacatgaaaccaaatacaggaatctaattcaaatcagctcgatttcccatataaacggcaaaaataatcctgcctgcaaacgtgtcctaaagatagtcccaatttgcatatgctcctcatttcatttgctcctacctgaatttctgggactgcaattggcaagatccaagatgccggtcacatgatccaaactggagtaaaacatggacacaccttaggcccgtagctcaggtcttcgtcaatgacaattcgaaggcctcttgtttagttgcttggcacgggcatcaaatacgtttcaaactgctaataagttaatacagtcttcgttcagtgcttatccagtatactgtgcagctgaagtggacctgtcagcaagtaaagccaagaggccaatagggaataattaacaccttactgtaaatgacagttgatactaatgtaatgccataacttctataggatcactaagggtgaaacctcataataaaaaggataatgtagaaatatactagtactaggcaggaggccaatgtgtatcacacccatgaaaactgttcgaatatttttggcagcacacctcaagagccaagagttggtaaggttcacatacagatggttcatttcaatgccaatatgaacccagctcatacgactcaaaaatgtcgaacccttgcctggttctatcaacaagggaataagtattaatattttgacaaggctgtgagacaaggatgaccagctcgatctcttagacttcgaattacaccctaaaaaattttcaagctaaaatgtgatactcttcaaagtttcaaaacaggagaaatatctctacaattctcgactaaaagaaagcaacttacagtgtgttgtccaagtgaatgggctagttgatgccttggggttcggtcttccacttgacatagtatccacttgcatagtcgcattagtagccaatactcatgggcacactgacatcgcgaacctccctctcccccttctataaaaactcagctgcattgctaagttcttccccatccattgcaacggcaacatacacacaccaccaccaacatagcttcttttgtcactgactacagtatcacagaa

SEQ ID NO: 46249 - DNA, 1501 bp, Oryza sativa
ctagatgatttcaaccctttagctacaccgtggcatcctcaatatgttaagctatgtgccaacgtaagactttacaatcactttttttttagagaagtttagttcaagcttcggctgtgctgtgcctgtaaggctctgtaggtggttgtgccattggagctaaggccttaaattattaggtgagggggtacattcttatgtgtattgatggggatatccaggcttcattcattgcttgatatcgttaactagtaccatgtgtagtaatgttgtactaccatctactggatagacccagtactggattcctccaaccatggcagctcgtaattggcatgacgatgtctataatatattgtgttgacgacgaaaggtaacatttgattgaagcaagtctgctagtaatgcgtatagtaacctttttatggcattctgttgtgaatatttgcagttgacatattatatgttcttgttgcaaaatgtctcaaaagaatttatgggacagcttgttaagaaaaacaatactgttagattagttgtttctctattgcaattgattttttttatgtgttgttagttcataaattattgatagaatgaggaaaaatcttagattcttatttagtttgaatttgatgctatggtatgagattggatcgtgtgtgttttttactcgtcctgtctatttaatttggtttgccgcccagatttagcaatgttctgtcaataattgattatgtactttacatggcttgaggcggttagacataacatcacaaaccttttctcttttccagttacaacatacactttttggttgtatcaagatcgattatttgcttagtattcagtaatctgaatatatgaaaatgaccgtgtatgcctcattaaagttctatgtaattacaaagactatagctcacttctatgtcaggtgcttcattttgatttgaacttagttgattcatatcataacggctacttaagaaatgtattattactaaagatagagtagataaatatgagctttctggagagccgcatggtagcggatgtacttctgatggaataaggttactagcgcatatgattgtttccagtttctggttgggtgggaactccccctgttcccattatattcatggctactactctatgcaaaatcgtcattttgttattttaaaccagagcacatcatcattcgtaagctgatagcaaatctagtatatctagtagtgctacatgtaggcgcgtggcaattggctgatagcaaatccttcatctgtcaggactcataccaaattttagcgaaggatcaactgatgattgatttagttgattcctaattaatgtgcaaagcttccttttaaaaatagaattgaacattcagaacattatatacattattactgtgctatcatactatggacctgggaaagattagtactgggacttttttctagagaacttctagattacagctaaatgcagtcatgtgctt

SEQ ID NO: 46250 - DNA, 1501 bp, Oryza sativa
ctaaccaattaaagtttgaccctgacataattgcatgcaagatctccaagattaagtcgtcactaagatctgaaattgtcattatgtcaatgtttatgctttcctttccagaaggagcaaagggaaaagcagagcagacaccatcatttcacagttaaacctccagcaagaagcagatcagctgatgatcgagagccggattagtcagagcactagctatacacactctgcctgcaaaaagtcagaactggagaagctttcaggccagcgccaccaaattacggacatgcacagtaggtcaacagataattaagctactaagatcctcctggttttcatgggactgatttgaccgtaaattaaagaaatggatcgatgcatgcgtcggattttgtttttcttacttgcatgttaagtaagcttccagaagtgagggattgacttttgctgctgctacggccgggaaacagctcgatcggtttttttgcatggatgtgtgattatgagttggttgctacggcgaaacggtcgtaacgccccgtgcggtggggaacggcggtgtcacgtctctttccggctttcgccgttgttctcgccgggcgtagcgagagaactgacgatcgatctagagagagttgtagtacgaggggccccttggcttttgacgaagctttgggttggcgtcgtgttactactgtacatggtggtagatggctagcgttcttgcgcttgtgacgtctggatcagcagcgtttcgttctcttgctggttggcgccgtgccccattgtaagaccgtgggttgagtacatcacatcggcgaaaagaggcccatatgtttcgcgtaatctcttccaacggcctacaagaggccttgggacggggtcactttccacgtgctccgttgcggcccatctaaaccaccccggcgtgtgaagcccacaaagaccgcctcccacggcgaggaggctctctgctctccccagcttccacagcagcgggcagcccagcagcagcgattgtactgtgtaacaaaattttttttcctctaatatatcgacgtataatttttttacgcgttcaccaaaaaaatcagcagcagcagcaggaaggaatcacccgtgtccactgcgcgctatgctatgagaaccgtgactccacgtgagggcgtgaggctgtgctcctctgtatccaagaagcttgtgcattgtagtacatccaagaagccgagatgagacagtgctggcgttttttaaataggacagccagatactgtcatactgataaactcaacacgtcgttacgaccattttatttcttgcaggccttagcccgatacaaactatgtgcccagccaatctgcagttgttgtctgcctctgtcccaagagcatcaccgtaaggcgatggaaactagtaagatcaagctcacgtttctctccagaatattacgtacttgttgtgtatatatgaaactagtaagatcaagctcacgtttttctct

SEQ ID NO: 46251 - DNA, 1336 bp, Oryza sativa
gagttgatgctctatcaaataggtttgaaatatatcatttaacaatttagaaagatactaataaaaaccaagataaaatccatatcttaattaaaaccatataataaatagtaatattttaagacggagaaaagtactatggtaccaacaccaagcagtcccctgtgttcatcttctgaagtctgattgtctggagtgcgacctcgcgctgtcgcgcatggcgtagtggcggcgttcctccctccctctcgtctcgacttgccgccgcgtcggcgccccgtgcatatggcccgccgtcgctggccctcgctcgctgagagcgccatccgccgacggcgtacggaccaccctctcctcgccggcgcctttcttttccccgccgcatccccggtttcggtttcccgtcggcaagagatgaatcccacggacaccacgccatcggcggccgattcgagacggaggtaaatccactcggtttcaaactcatcgcccatctgctactcgatcttgcaatcgtttttgatcgatctcgcgatcgaggaatcgcatctgtgctttgctgatggctttgttccggcatctattgatcaatcttgttggtttaatcgggcattgtgagtagatttgattggaccgagttaatccgaaacgatgatattgaaatatctaatagcaatactctatttcagtttacagggacagaattaatccattctgaaacccacataaaaaagaaccaaccggaccaccaaccaaagtattcgtagttagcacattacaacttgactgatgaccaccctatattacattcttctgaattccgtgtggccatttcgaatgttacatgtattctcctctccagaagctcttgcatcttcgtgttgccaagccattagggcattgctaagctttgttctcacagttcctttagtgtcgttttcactgtattttctgaaactttaagcatgtttgtttgcttgtttctttgtgtctacgtgtctgaagcattacattcgtgccgtgggggaaagtcttgatagatggaccccctacagtttctaaagtggggaattgcttcatgatgatcggcggaattagtttaatacctgtttgcagatgttagggcattgtcatgctctgaataggatacttgcagaaaaaaaaggggaggtactagctagttctagtaggttagcttactcaggttgtccccttgtaatttagcagggtgacgtggttcggttgattaacttatctgagtaatgcctttttgtttcatcttcttatgtgcttggctatgagagttctggtagaaagctggtgtaggaatctgaga

SEQ ID NO: 46252 - DNA, 171 bp, Oryza sativa
tactaaccgggaataaaaatcaaaacacactatataatccatagtaccgatcctcttttcccgtccacacaacaaactcctccctctatctctttttttcctctctaacttcttatctctttccttatctctaactcccctcctctccttccttttttccttcaccacagt

SEQ ID NO: 46253 - DNA, 549 bp, Oryza sativa
tagtcagcccaaatatatatatatcataccatttgatcggagattgattttgtagtgtagtgtagtcctgatcagtttagcacaccccatttagacacaaacctttgcagagttgggacaaattaacccgaactcatggcacctttggaacctaattaagatttctacagagttttcatatatagtagtttgattcctacgaaaatctttcaaaatcctcctgttccaaacgagcccttcagcttgctgcgcttacaggataaacgactgatgagtagtcgcatttttctgcaagatcagaaggccattttttatgactaaagctagaattttgtgagaaggctgaagagtgcaaggctgagtaatcaatccggatacaagcagtagcagttttagtcaaagacaagacccacccaggacaatgacagccaccatgttaatccttcgtttatcctaggtagaagtgatagtaataatttacccggcatacttcttttccatcctgacagcgaccagctccaacgtgtcaacaatccagtacatgctagc

SEQ ID NO: 46254 - DNA, 1501 bp, Oryza sativa
ctgaaaattttgttcagaacatgtagtggtgcttgtggtcgatcttggtgttgcttctccggcggtggtgggaagagctagagatagaagaagcagtagggtcggggaagccgatgtcgtggacggcgccaacggtgttgaagaagaggcgcttgttgagctcctccaccagcgtcctgtgcagcagctggctccgcatgtccaccatcgacctgttccgactcatcctcccccgccgctgctcctcctctccgccaccctctcgctgccgcggccgtccggcgtgccctcctcctccgtcttcagatgcagaggctggccctctctcgccggccgcgcgccgccccttcccgccgcccgcccgcagctcgtcccccgccgccgcctcgtgggccgcggccggcgggggagcccgcgcgccgccccttccctcgccgccacgtctcccgtcgccggccgtcggtcggcgacgccctcctcctctcccgtctcgcattgctgtagagaacggagagagagagatgaggatgggagagaagagaggaaaagagagaaggttgatgtggcaaatgctgacatgtgggtcccacgttgacttagccgccatgtaagataaaaccagggtcaaaaccaccggacaaccgaacaacctaaagtgaacggttttagttgagggatgtccggtatttttgcggttgggggacgattttgtaactcgatgacaagttgagggaccttcggtgtgattttttcaagttagtttcggcgtaaagttaagggttctcaaatgaaccaattccttacgaaaacaataggcccattattgagttagtacattgaggcccaaatttgtagtgaacatctttatgggctgatcaatcgattgttcgcgaccttttggagtcttttggagttttgggcaaggacgcgcgctgggcgctgctggctgtggcacctgggacgttcgtgaaacctgcacgaaagcagctcgccgctcaacgcttttgatgcgatttcgacacgaaaacaacgaagcgtcgggagaaatcggcacgtcccatagtttaagcagatgaactagcgaaccatagaatcgaagatgccgcactttgcagttccgtttcatacaacatcacatagcagaaggtagtgttagcacaagtcacatttcagaagttcaggaacatttttttcccattttctgaacttggaataacatgtacatagatacatagggtttttttccccctgctaaattaacaggatttcacacgcagggcggtagatagatacagctacttcccatcacaaaagcagaacagcaaatgcacatccatcttgctccacaaaaaaaaccaccaaacaagatgcaactgcagagttagcagcaatccctacacaaaaggctaaagctgtactagtaacactactataatgtaggagtagcagcaaccaacacactgtgcgtgctgctgcacggagactgggcgcagcagcacta

SEQ ID NO: 46255 - DNA, 1501 bp, Oryza sativa
agcattagatatgtggagttccaacgagtacatacatccacagtgggatgcaactcgcatgtgatcccttcttgggcaatgatctcctcaaacttttctttgcgagatagggaattatccctgtacttcacactttcacggatgttgcaaacaatagaatcaataaccttcaacccatctttggctatgagattgatgacatgtgttgcacatcggttgtgaagtagcttccctcctgctggtatagttttcttagctttcaaattgcactttaacaacttagccattgaatcattggctgaagcataatccaaagtaacactgaatattttgtctgcgatattccaatcttgaatgcagctgagcatagcattgaacatctgcactccagtatgaggtgtctttactccaaagaactttataatcctcttctgtactctccaatctgtgtcaatgaaatgacatgtcacacacatgtatcccattgtttggttcgaagtccacatatctgcagtcaatgagaacctacaatttgcacccttgaacatgtccttcattgctaacttttgctctttaaaagcagcgatgcaatcattccttatagttgttctcgaaataatcttgaagtaggggttaagactagcagcaaaacttctaaatccatcatactccacaaactggaagggcaactcatgtaatacaatcattcgcatgagctcttttctagaaacttcaggatcaaagctccaattctttaaccttacactattaggagacataagtgtagagtcaagatttcccacaatcttaagagcactaattcgcttcttgcatcttgtcaaatgcttcctcaatgaacttgttcccgctccacgctttgcacggatctctgtatcacagtgcttacattttcctgcaccaacttcattatcaatgagtatcggcacaaactctttccaagcctcagatctgaatttccttgttaaagcttgtattactggattcacatgctcatctacaggaccaacttgttcagagtcactatcaccatcacccatctcaatatcttcaccactgttagtgccaagtccaaaaaatgcgttgggtgtccgcatttcctcacttgaaacaaagcaacgaacaacacaaatgtatcatttgccatctaaaataattttctatcacataatgtatggaaaggaaattttggtgtaaaaatctgcacaacagcatgttgtcagaagcatgcaaaaatgctacttattcagtgtttcgttcagtatatcctgaatattgagaaaatccaggttatatagagacaaagtaaaagaccatctattttacacaaggcagtaggaaactttaaattagcagtaactgaaactttctcctgaatggcatgaaagcaaaatgaaactttttcctggcatacaaatctgggcctagcaaaatggcatgaaagcctagctataacagtcactgaaactttctcctgaatgag

SEQ ID NO: 46256 - DNA, 1501 bp, Oryza sativa
ccacaaacttctaatttttccgtcacatagttacaatttcaactaaacttttaattttgatgtgaaaacacacccatacatacatacattcaagtggtcaaggaaggttcacgaggccgcggcggcagatggggggcttccctccatattttccggcgccttttgttcaaacatggcattggcatcgaaactttaaaccaccaccaccgtatcgtatcgtctagcctgctatgctacgtactcgtcctactaccccagcagagcagcagcagctgatcgatgcggtagaagaggtgaaaccgcgcgcaaagcaaaagcagtggccaaaacgaaaaggagaagccccacacaaacgcaggagaacgtcaagccgtcaacctgcacaggccaccggccatccagagccacagccgcggctggccggccggcagcgagagagaggtgcagtggatggaaatcggaatggcacaacttgcgatggaagcaaagcgaaaggcgagccaatcaacgccccagccgtttgctccgtgtccacgaacacgcgccagtggccgcgccgcttttggtctcccctttccctccgctgccgccgctccgtgtcatcgcggccgtccatttagaacgaaggggatgacacatctgccactggcgtgtggggtccccgctgtttacaccggctgcgcgaaaggctggagcgcgaatgatagggccaaaatctggccgtgccaatgccattggcgaattcgcgttacgtctacgaaaatgtggtgttgaacttcttttttttgttcgagatgacagttacgaattccaaacggatcgttggagattgtcgtgttggtgtttgatgggcaaagatttatgactcgtgggctcataccaggatcctgtacgatcttgcagccgattccgccgtgcatcatgcgatcggatcacaacttcacaagcaatgcaaggcaagaggtaattggccgtggaatccaatacgatccgagttactcaattccggatccactgccctggcttccaacagattaatcaccaccaatcggtgaaaagagaacaaacacttcgcatgcatgcatgcacgcaaagattaatctgctcatgcttttgctttagttcgaaccaagccaaaaaaaaaagaaagaaaaaggagaatgaatagttccaactgccccgcggtgcacgagatgacggccgcagcgaggaggcaaaatcacagctgtggcagtagtacttgtacgtacacacacagtagtagtagtgtactactgctattgctactactaccacgcagcgggtgacacacacacacacaaaaagtcacaaatctctacgttttttttcctcgcgaggcgtagggcgcgcatacgcgacgcgcgccattatttggtccgcctcgtgcctccataaataccgcctccgtcccgtccgcctcctcccccacactccactccactccactctcgccgctcgccgttgccactcgcactcacaa

SEQ ID NO: 46257 - DNA, 1200 bp, Oryza sativa
aaaccatctttttcggtcgacccaaatccacaatagttccggttccattaaaaaccgggaggaaaaaggttaataagaggaagatctttagtccctgttgttgttaccaaccgagactaaagatcgatttttagtcccggttatttgaatcgggactaaagatagcgatctttagtcccggattcgtagtcccggttagaaaaccgggactacaagggggttacgaaccgggactaaaaagcacttctccaccagtgggtgttatagctaaaggagccaagtggccagcatgactctaagtggggccaacatgtggagctcgagctagaagatgcatcgaagaggataattaaacttaagctcagactcgctagatagcgtggacctaagctcaaactcgagcgcaaacatgacatctaccgaggtagagccctaagagcagttacaatagtagactattagctagctacaaacatattttaatgagataaaagatgatagagaagagcagcagtctacagatctgtagccagctgcagcacagactccaagatgcaatgtgtgtatgacagtgtgaccatatactaatagtatagtaaacaactattgtatgaattgattgactatagataaattggagctattagttggctatactattaaccttgctctaacacgagcatagtgtcgacggagataaagcttgagcgctaatggtgagcatgatggtgtgggtgaagatcggaaaagcaaaagctttttggagggaaaagaggagcttgagctcacgtatgtactacctaacgagaatactgtggtgagttgctagagacaaataggaaaaatatgattggtctaaattacatgtgtttatgttattacctaacccaaagtaaaaaaatattggcgagatgatggtccaaagttaaacttattacaaccccagttgtaagacaatgtgattttggagtttattttgtggtgtttttttcatcatacttcatttatattatttgcttttgaatcgtcaaaatatgcgtataaaagtttcaccaatacttattatttcttttaataaatcgtacgaataagtacaagcggagcgatagaagtatcttctacacctgctttaacattttccactaccatatcctaaagggaaattttgctataagatactgctattggtgtttttagcct

SEQ ID NO: 46258 - DNA, 1501 bp, Oryza sativa
gaatttcataaaggtcttgatcgttgatgatggaagtactgatcatacatcaaaagttgccttcgagtttgtaaggaaacataaaattgataatgttagagttcttctacttgggagaaaccatggtaaaggcgaagcagtcagaaaagtgagtaaatgtaccagtcgatcccccccccccccccaactcccctcactagttcaataaacacacccaccctcacccaaactagttcaatgaaataagcactgattaattctttcccatctgtggaaaaattgtacagggcatgctccattcacgtggtgaactgttactcatgcttgatgctgatggggcaactaaggttactgatttggaaaagcttgaagcccaggtctgtcataagttaaatcaaaacatgttttataaagttttgttatgcatactttgatcgtgattggtaacatcttggaatcatatcgtgctcctaggttcgcgcattggctaaaaaggctgagtccagcctagcaccatctagcagtccatctcagagactatctgatgctgaaattgctgtttttggttcacgtgctcatctggagaagcaggctcttgccacagtaagtgccccccaccccaaaacaaaaaaccttttcaatcgtgcgtttttgttctcttagattttcatgttgtgttgtatttgtgcttttcctggcgtactgcagaggaaatggtatcggaattttcttatgaaaggtttccacctggtagttttattgacagctggtcctgggatcagagacacacaggtatgctttgcaaacataagtcgtaccattaattcatgtggacagttttgctttggtattgtgctatgaactaaattccattttcttattgctaatttagtgtggtttcaagatgtttactcgagctgctgcaaggaaactttttacaaatatcagattgaagaggtacctttgttgttatgttctctaaatattgtcatgcttctgtttatcaaatcctgtcttatttttggcgtgtaaccaggtggtgttttgatgttgagcttgtatacctatgcaagcatctcaggatcccaatggctgaagtatctgtaaactggactgaaatacctggatccaaagtgcgtatgacaagcatcctgcatatggtatttgagctcctgctgatcaaagtaggttatggactgagcatatggaaaatctattcatagaccatatgcacggtacgctgacaatcaccatagcttatcatcactggactgtataccaagcttagtctcacatgtaaaatttttccaagattttcacctagagagaatccatttgtggcgctgagtattccatcatagatttcaacaaagatatagatcacgtgtattgttcctgctgatgaaattctttaatcatttttttagcattttacgaagttgggaagaatcgaaaatttgactacccttcatgtttgatgtttgatttgacggatcgtttt

SEQ ID NO: 46259 - DNA, 691 bp, Oryza sativa
agcccattccactacctaaccatctctttaaggttggcgaattccctcctcctaccccgatcttaatatgggatcctaacttaagtcgccactatctcgctggctttcaaggagaaagagtgacaaggatctaatggtgaaggattcatcagatattcaactcaaatttgtgtcaaatgaaggttagcaattctgctaaatatcccatattataaacaagcgtttctcaaaagaaaattgaaaaataagtacaataataggcaaatggatctaatattcttttttcattggaatggatctaatattataatcttgaccccgcaaaaaaaattctaatcttgagaaactcaaaatgtttttgaacactgatgaaatttgaaacgaggtgccagtgtgccacaaaacatgtatattgccgcgatatgcgccatgcggccatgccgccatgtgctcctcccctgatgcatgggttcccagatgacagtcgaccagtcgcccagccaggagcagccttcctccaggcctcgtctcgtccttccacaccacgtccaggtcatttccgcctccttttttaatagaggaagagcggaagacatggcgaagcacgtcgctggaaggacatgatctacgcacacaagccattatagctcggggaagagactcacagagaggaagtgctcccggtgcttcc

SEQ ID NO: 46260 - DNA, 428 bp, Oryza sativa
aatagttgcatgtgttggtctagtggagcagatatgcgtgggaatttactactttatcttaaattattttaaatttgcccttagcatttatttttgctgtagatgtcaggaccatgggctcaaataacatttgtttatctttctggtttacaagagagaggtcaaatttggatggatattagtgggtccatagatttgtaaatttaggataaattactttggatgtgttgatagcaaggttactctgggtgtgctgagcttaattcttttgacctgttaaaaagaagccccctgctttgcttttcatctacttatattcgattcaattttatgtaagtatgtaccaatgcatgtttagaactgtagaactaataatatagaattcattctcacaagtatgacaatgcaatttaagcaggggcatatca

SEQ ID NO: 46261 - DNA, 1501 bp, Oryza sativa; identical to SEQ ID NO: 36178

SEQ ID NO: 46262 - DNA, 1501 bp, Oryza sativa
tatggatgtggattttcatcccttgaggggacattccctctttgtttgcatgtcatctaaatagttataaaaaaaattgaaagaaaaaatgacaacatagattaatacgaattatatcactccacaaacatgcaagaccaaattcaacttctataagttgcaacaaaaataacaaattaaagtgaaaatagttatcgcacattcgcagctatatttgttgtttttgttacaatttgtagaagttaaatttaaagttgcatgtttgtggagtgatatatttcatattaatctatgttgccaaaattttttttcatattttttgatgactatttaggtgacatgcatgaaacgaggggatatcccctcgagggatgaatttactttcccgttatatatgtccatgactctacttttcatgatatatgctgtggtgtttggcatcccacatggaagctatccaattattgtccaaagagatgcttgtatatcctgtaggatatagactaataatagggaggtgagagaactattttgggtcttgggatccagcatacatctgaattgttcctgtcaaaatctgccagtaatttttttttgaaacagacacgatgcaatgtttcatattggtatagcaggaaaaatctgacagtaatagttgcactcttgcctgaatatcctctactgtagtactaagctaccgaaaccaacaaatttatagtgcagggattgagaccaaactttgaaatacaatgttgatgttgtgccacccttgaacactttcttattggtattcacaatatactccatctgaaagtctgcagatctgctggagcttctgacaagaaaaatgaaacagtgcaacttcgtgtgaagacatgcgagatgcgaccactatggttgaaaaaaagacattgaacttcggtaaccaggtgtgttcagtataagacattactgtttttcagttagacttagtgttgatgttcgaatgttcgaccatgccctttatagttcatgagcactgctacacttactaaattctcttacgtactaacaatgatttcaaccatttgatttaactgcaggaaatcgaaaggcatgacgcatcagtattagtttttggaaattgcatgaacccacatgtttacactcatggaatttaattacagggactgatttttgtcaaaacattgtatggttaacccccagcagtgtactttagtattccggagctgcatgatagaaattaagctaacttctgcccttattagtattacctccgaatgcatttggcactttggcattggcatgttgtaaggagtgcggttatcgatcctggaacaaacagaacacggtcagtggctcgtctcgtccactcgccacttctaatcaacattctgttgcctactccatactactccctccgtcctatattataaggctttttagattatgcgacacatcttaatactataagatgtattatatgtacccaaaatctttt

SEQ ID NO: 46263 - DNA, 1501 bp, Oryza sativa
tattagacaatttatttattagacaggggcgtaagctcctgcctcgccatccaatccgtcgtagcacgagcggctggaaatgaacgaagacgtcacacatacaatccggcgaaaattccaaactcgaggtggtcatttcacctcacctgtttgcagaggcggccaggcaagcgatggatcgaggcgacctgtgtttgttgttgtgcgcgccaacgcgacatgcgctcgcgcggagagattccgtgtgccgtactacgcgcgcgggcaccaccttgcctgcctgtacgagcgctcgagctcgctgctattacgtacctacgcgcgcgccgggaaaaaacgccaaaataccgtgcaatcggcccgattctcccgggcgccgcgtggtggcggaatggaatcgctcaatcgcacattcgcattcaactgttctcgtcaaactttcaacttttcttttttcatatagaacttttctatacacaagctttaaacttttccgttatatctttctaatttcttcaaacttctaattttagcgtggaactaaacacagcctaaacctcatgattttttacagatcacataatcatgatatatacagtaatcgtacgacacagcgagttgctgaatgcttatagtgatagtgcgagtgtgaaggtgaagcagctggtagggtagagggcacatgtcatccatggaggcccaaagtaaagggggagacaatgcaaaggtggtgggcggattggacgggataatcccatttcccatagagaccgcgacgtcgagagagagtatcgtacgttatccccgggcgggtggggggacggtggacgagaatcgaggagggtgcagctgcagtgcagggacaggggaccgatccgaatctgcagtgcagttaaagtttgggcagcggaggcttctccttgacgcttcctcgatcgatcatcctgggcgcatgataaaaagcggctcatgtgcgcatgcatgacaaggacgcttgccgccggcctcgcgacccagagattccacggtcaaatcgcagtgtcgatcgatcaccaccccgtaaaaccacagctacttcctctgttttataatataaggccatgtttagttcgtgaaataaaaatttttggttgtcacatcggacgtttaatcggatgtcagaaggggttttcggatacgaataaaaaaactaatttcataactcgcctcgaaaacgcaagacgaattttttaagtctaattaatccgtcattagcacatgtggattactgtagcacttatggctaatcatgtactaattaagctcaaaagattcgtctcgtcatttcctccccaactgtgtaattagtttttcttttaatctacatttaatacttcatgcatgtgtctaaagattcgatgtaatgtttttgggaactaaacgggacctaagactttctatattaccaacatttatttagatgttaatgaatctagacatatgtacgtgtttaaatttatta

SEQ ID NO: 46264 - DNA, 1440 bp, Oryza sativa
agggtaagctcatgaaacccatgaatatcccggcgcccacctcgccccccccaaaagtccaaaggcatcgtctttctttcctttccttctcttccctggtggtggttgtctcgcattgtgcatcgcagcttttgcttttgtgccatggccttaaccatcatcagtatctgcgctgctggtgagcatatttggtttcttttcgaaggcagccgcatgaggggtgcagaactgcagatgtaatgttaggtgagatatctatctatgatgcggtgccatgcgctggagcatttaaggagatcgcccggctgcaagggaatcttgccatctcccgttggcagttcttgttgaaacagtttcttggagttgtctgacaactgtttttctttatgatggtttgtcagtcctaagtgtaagtgcggtgcttagggcacagtggcaaagggtagtagaagttcttgttaagataattgggtgtgtgcttttattaaaacaggggagaggagtggtgatagctgccttgtgatgtgatttgggtggttgcttttgtcatatgcagatgatcccaactgccccgtttagaaaataaactaaagcagattagcctgatggtgagtcctacggctttgactagaggaagagaacatgagccacgtgtattttatttgggacgggagattaccatgtagcagttgagaaatgtgatgtgccctgcatagagttgactcactctgtgagcatttctccttttttttttcttttatcctgagaaagaggttgcatcagcatcaagtgttgatcatgggaattattagcggttattctgaggtgatggctagctacaaactagagagctgttaaactctgttctgaaactctaaagcaattcttgtagtattgtacaaatccacgttgtttattggacctaatactgctggtatttagccatttgtgtaatttgatgtgtcaaacccctgtcaggtcatatcagttatacttgtatatattataaatatttgctgtggttagctggcctaggaatttgtccttgaaattatctaagacaatcccaatatgaaaagtatcaacacggaaacactacttctagatgttaatagtagcaagcatcttgttcattcaactctagtagtgttagattattttctgtgcaaaacagtcgctcctcatcttcaagattttagcatatttattttttaaatttggcaattggtgctgaaagtatatctaagggcagagtttatgcttcatgtttcctaaccttttattccttctttctacttgcactttactatattcttgctgttacgcaccacattgatttactttctttttctttttctcatgctagaggagtgaagagctgatgggaaagattggtttctagtgttggaccagtttgtttccaacaagcatcaaccatgc

SEQ ID NO: 46265 - DNA, 185 bp, Oryza sativa
attcctgcagccccgataccgtcgttgatgtcacccctatattatttttattttcggttgtatgagatcgactgtatatttctataaaaataaattacatcctaaatatttttaaaaataaaattgaatgaacagtatttttcaaatttaattcgctgctgctccacttccgcacggggcgcagg

SEQ ID NO: 46266 - DNA, 572 bp, Oryza sativa
atagattttagaggaaatctagcaagagctagattttagaggaaatctagcaagagctccagcctcttcaaaaatttcatttaagtctatatctctcatccaattcttacattttcatgcaatccaatcaaacgaccattcctatgttacacgtgtgttttgcacttgcatttctataataatcctatgtttttcctattcctccgtttttttcattttcctattcctccattttttcactcctacgattcaaaaagggccctaagttcaagatgagcgcaaaaaggcaaaagctagtgtttggtttttaaaacatgtttaactcgaagcaatagttctttagaaagaaagaagtcgtacaggtgtgcagttattcaactcgtagaaaaatgaaaaagaaatagaaaaattaaatcacattggagctaggtgcaccatatgattgtttcatgttccacaaactaatcaagattcaagaagcaacaaacgcaaaagcaaaaagggaagaagcaacataatcatatagtcacgttgatttgattaacgatcagaatctctgtataatttccaga

SEQ ID NO: 46267 - DNA, 1501 bp, Oryza sativa
gagtgataatcaccagcaggacagatcacaatcagctccaagcctgcctgccattagattgaaatttatatttagagagatgcaccgtattttgaacgtacgagcaaaaagcgagctagagttttctcgaacatcttttgagcctcgaaaaagggagagaaagaaagggaaggccgttgcagctaattggctgcacattcttggaagtgaacagaacacgattcggcagatgttgcgtccatcaagaatccagaggaggagactctgcagttgacatacctgcaagatttttttttgccactctcttgtcctccaatttgcaaaaaagaaataggataaacacctttgatatattgatgtagttcttgctttctataaaagatggaccctctttggcttctgatcccaaaaaggatatgttagcggagttgtaggtgcatgactccatttatcaagatcaaatcataatatctacgatcattcatacatgagtgtgactcttgagcatatgttaaaggggtgtactcgcgaatggcagtccgtgtggtctgtatgcgtagacgtctttcatgtaatcgcaaaaggaaaaatgcagaaaaaaaggcatctatctccatcctagcagaaaggattgactgacatttgtgccaggagaacatattcttcttcagtgagatcagatcagtctcacaatataagaccacaagaggtatgatgaaaaatcacaaggaattgtcacctgcttgccttatctctgtaagattctccatgcatgcaaacatgcattactgttcaaatgttctatgatcgccaagttgatgtctgaatcagcataaataaaaatgtcctgaaatgaaccagcccaaaaatggaagaatgattaaaatttttcatgataatgttcaaatgttctatgatcaccaagttgatgtctgaatcagcataaataaaaatgtcctgaaatgaaccagcccaaaaatggaagaatgattaactttctcatgatataaagtcagaagcgaatgtggatcaaagttacatggagttttaaggtaggagtcttagaacaaatgtctctcatgacacaaatggtctatgcatggccaggccagcactgacaacgatgccaaagtatgctgttcccggtccaatggaaaagcagattatgctaaagcagatagcatagaactgattctataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctga

SEQ ID NO: 46268 - DNA, 191 bp, Oryza sativa
aaatctccctccactgtacgtacgggggggggggggggggatggtctctgctcgtgtaatcgtgtcaactgcctcgaggtcaactcgtgatcgagctcgactgttgctttttgtattgtctagtagttggctcgtccttttggctgtttgtgtttctgctcatgattaatggcgctgctgagtgagtgagt

SEQ ID NO: 46269 - DNA, 558 bp, Oryza sativa
ccccaaacaaccctttgagcatgttgatcctatttaaagctattgtttctattcaactattgcatttattttcgaatgtcattgggtggaattaacctattgtttgttatagccctttttgatcttgattactttattccttgataccttgggttattataatttgactagttgagctttatttatattggttcagctagatattagatataattgcttagccctgcttagaaacattagcacattattgggataacttatgactcactattatttaatgatttcacgatggtcaatcgtgattggttaattaattaatgtgccaactaaaacctggtaatggtgggttgtgagcacatggtcttgatggtcgtgctcatgacaattaaggaccggttcacgagtttcggttgtgaaacattaaccgtgccaaccacaagccagcatgggcaacggctttatcttttgtatagcatggtttattgcggggcaccagactgagaagtggcggagataagcccacgggggtcgctggggagtccatgccttgtttataag

SEQ ID NO: 46270 - DNA, 1501 bp, Oryza sativa
ttatgcatagcattttccatgaaaatttacgggtatctgatgtattaaattcatgactcgctgtgtcgtgattcagaaaggagtagacactagtatcctattcttttgtcaatgaaacatcagggcagcatcgtacttgaattctcgtttgccatcttttagagggcatcatcttacacatatatgtctaaattcattaacatctatataaatgtggacaatgctagaaagttttataatatgaaatggaggaagtagatgatttgtccgtgcaagccaggagctctgcttcttctgcctctacacaacgccttaggaatttccaagatgacaggagaacttgtccatctgaatttctaaccacgagtccgattgctcctctaccagtttctgggttgaaagctccaacgacattgagcaacgacgctgatgattcaagttcccaggagcaccttgttccttcagccttcctttcatgccaattgtcttccctttatgattatcgctggtttgtcggacggggagcagtgcttcagctaaggtaaacaccaccaagcctttaactgaagcctggccaatcacgttctccaaaggatgaagagtatttccgccctcgttagctggtgcctggtattctagtgctgtcctagttagctggtatccccagaagtagtttaagtggttgtttgagaagttggtttttgtgtgtgttctagtgctgtcctagtttagctggtattccccagttttcctgaagtggttgctgtgttcgttttgttttgtttcctgtaatgaactctgcttgatttggaccttctcttcgaaaaataacaatgtttaatgatagatgcaaaacttaccagcgcaaacccaaatccaaaattttaatttaagagattgacatggctcgtaaacccaacggaccaaaaccgaaaattcaggatacaaggagcctatgcaatcaagaaccaaaaccaacagtagcaagaaccaaaatttaatttaagagaattggtagaggccgcgcgaaagcatacgaatgcaataaagaacttaaacttaaccaacaatagcaaggaccgaaatttaatctaagagagttggcaggggccgcgcggacgcgtaccccctctaccacaaattatgacgtccactctcccacttggggagatggtaagctaacgcgcccaccaagtgcaatgtgggccattggcctaggccacgagccttcttgatcgcccgttgaccccgtccaggtaagtatggagcaatagtgcacggggctctctacttatagccatctctcccacccgcacctcctcgactccgcgaggtggtactaatccccgacgcttccacccgttttcggtaggaattttttttatttataattttttttattaaaagttttacaaaaataattttccattttgaaaattgacgggagtagtcgcctaccgccctctgggagggcgaggcgaaaatgacgtggcagccggcc

SEQ ID NO: 46271 - DNA, 864 bp, Oryza sativa
  unsure (1)..(864): unsure at all n locations
taatagaaaagcaactctgcacagggggaagcaggaccgggtctcctctttggccttcaatgctcgtgcagccaaccgccgctactctccatcatttcagttttctctcgagtcaacggcggttggaagcagcaatccgagcacacccacacgctcccgactcgttttgattccaaggatttctattacgtagtataatcaccaaacgcttcctctgaaaaagcggggtgtatgtgtgctcagctgaagcgctgaacgcttcggttcgcacacgtcttccgcatactaaaattctattctttttgcttgcttggctcggtggtggctcaaaaaagaagaaacctttcttgttcttgtccttcttccacgatcgatcgcctcgctcgctttcgcctgttgcttcacgtttcggaaaactttgggtttgggggaatccgtgtgatcgtgttgatgattaggtgaagaattcgggaagagctttgagagttttggcatctgatctaggtaagttagttaatctgttcgtttctgtggccttgtatgactcggttctttgcaatttctgcctaggagttcttgctcatgttcttgaattanccaggtaggaatgtaggttagggaggagattaggggataaccatcttgaattctagatgcaaatgagtttgataagttcagtagattcaccaatcgaacatggacacatagcgctgcaaaactgtagaacgcagaagaagcatggggattaagttcatggatgacaaatcttgaagctatcgtctctttgcagggcaaacgtgggcgtgggcgcgggcgcgtcgacggcgtcgtagcatcggcgacgtcgccggtcgccggcgagca

SEQ ID NO: 46272 - DNA, 1501 bp, Oryza sativa
agaccgactcccgtatagaaaaaaaagtccgactcctgaaaaagaagatttctcgtccgtaataaaaaaaaggaaaaaaacatccgactcaaaatccgtaaaaagaaaaggaggaaaaaacgtcccggccaaacctaaagtcgcctcttgttgtccgtatatatctctttaactctaatctaatctatcgatctaatctaactttttaaaaagagaagtttccatcatccgttaaaaaggaaaaaaatgcgcaagaaaaaaatagtttccaaaaaaatgcgcaggaaaaatacggtttccttcgtctgaaaaaaacaaaaaaaaatgctactaaaaactatcagaaagaaatacaccatttctaaaaaatgtttcaaaaaaccacacaagacaaaaaacaccatttatagaaaaaaaaagccgctatgaaaaaactaaccgatgaaacactgtttataaaaaaaacagatcaaaaaacaaacggactcaacgcgcgaaaaaaccgctgtttcaaaaaaagttcgagaaaaccgttgtcacaccctaaaaattcaaaatatataaattgttgtttaaatggaatttttagaaataattttaaaagcctagaagagaagatctaattttaattaataaattccaatataaaatggggccagataaaatttcattaaatactttgattaattctataattcctagattttttttgggatttatttgagctaaggaagtatttttaataaatggaattgcatttaagaaataatttaaattgaaaaaggttttaaaaagtctcttttggctttgggccgaaagtcggcccaaatctcttctctctctcctcggcccaagtcggcccagtccgccgcccacgcgcgcgccctcgctgccgctgacaggtggggtccgtgtcacaccccgaagttttcctcccaagccaaaattgtaatttttataaatgaccctaagaaaatgcagatgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaattttttttaattccagggaaaatcctttttctttttctttttcctctctttttcctcctttttttcgaatgggccgccggcccattccctccttccttccctcccccttactgggccggccgctggccgaggcccagccaggccgtcccgccgccctcctctcggggtcgccgacaggtggggcccacctgtcgggcccgtctccctcctcccgccgatctcgcgctcgcgccgccgcgccgaaaccgccgccgcgcccacgtccccgcctccccgggccacgtcgaccacgcccgcgcgtgcgccgcgtctcccgcgcccactcccctctctctcccgctcgcgcccgcgcccgaga

SEQ ID NO: 46273 - DNA, 1501 bp, Oryza sativa
tggagacgaacacggtggaggggctgtggcctccgccggcggccgcgtcgccttccgtggctgctcccccgccgccgcgctgcttccgcttacccatcgccgctcgccggtgtcgcgggggaggaggaggcgtgtgaagctctccagtaactcgacgagggcttttgtgggctagggtttaatgatgactagatgggctggaccgccgccacccagctagctccagatctctccgcacctcgctctcgcgatcagaagctcggtgaggcggtgaggccactagcttagctggggacgaggatgaagcgcgctcgccgcagctcccgccggcgacgacgagcaaggcggccggcgtgcgtgaagcctctacgtcagtacgttgcggtgcgttgattcgcaccggaactggaaggtccaggatggatgtgtcgggccgttctgtgggccgcttccagcccacggacgtgtttgcgttggaagcccatgacaaatacagccctacaggggagttcgagattctgagaactaacatgcaagaatgtaaaactggaaaacccggtttctaatcacttttagttagttttttggattctattattgtagatcttaaaaatctaggaaaaattttgaagctactccctccgtttcatattgtaagaatttctagcatgcctatattcacatagatgttataataaatctatacacatcattaacatctatataaatgtgggcaatgctagaaagtcttatgatatgaaaaaaatgtggacaatgctagaaagtcttatgatatgaaacggatggagtatatgttataggaaaaattgtgactgctaaaagctactccctccggtttcattttaattgacgttttggacaacgacactgtctataaaatatatctttgaccttatttttctattataatatatataataaataaatgcatgtttacttttattgtagtgttttcaaagacaaatttatatatgttgttctagtttctttaaactaaatatttttaaagttattgatggtcaaagttataaaagtttgacatcaatctcgtctaaagcgtcaattattattattatagaaccgaagggagtattcgaatagtgcatcggatcaagcagacgaactcagcttgtttgtggctggtacatggtcaagtctcattgtttccttatcagccacaacaaaaatgtgaattttgaaacgttgattttgagatttttttttttaaaaaaaatcagtattggcttctaaatcgctaatacacagctgtaaaagttttgcctataaattcttttggttgatttgtttgtttttctaaccgcttatcaaccattgagcaaacgatgagaggcttattctcatggaatttcccaacattacgtttcattcgattcaacagacacatcagacatcatgatattcttgtagtaactactttgatgtagttatagttccagaaacttgctcgtacattcttttc

SEQ ID NO: 46274 - DNA, 1501 bp, Oryza sativa
gcatgaagatgactttataacttcattcttacatcatcacactccacataacaccgtaatatgattactagtgatatgatgataagttcaacgaacaatataaacaaagttgaacaataattcaacattgataagttgaggagatcaaatttcaacaaagtctatatgccacaccctagagttaacattgtttttcctgaccacttccccttcctaatgggttgcaagctttcttcattcatgagcttttaatgggttgggttggctgagccgctagagaactttcgaaattttgatggaaattatcggacaaatgcagttacgagaaaacggtccgaaaaaccactatcctaattacgctaccatttctagaagatattctaataattactaataccgattgaaacggtcagtataaaccggtaacgacagccaaaaatctcggaaattttcgtaccgttttcacccctaaacagcatactagtactacatccgtcccaaaataattgtaattctctgttgtttagcatatattaaggtttgagaagaaatactatggtgtccctcgttaaatggtgtttatatctaccctatagttaaacaaatagtttcactcattctttcattcatcactcaatgattcagatcgtctgtgtaaaatcgaacgattgagatcgatcccacctcccaaaatccgccgatcccaccttctggtgaaaaccgaacggtccagatcgatcagcagcctcccacctccatctaccgcgtgatctcccccaatcacgcgactctcacgcgccgcatccccctccgggctccggccctcccatcctctctctctctctctctctcgctcgcatcgcctacctagacgctgccgccgtcgcctcgcctccctatcacgcccatcccctcccttcctcactctcgcgcctcgctgccacgccgcgccgacgccgtcgccccgccgccgtcgtcgccgtacgccatccccccgccgccgccgtgcatcatctggcgccggtcccccccttcccccttcttcgccctcccctcgcggcggcggcgtaaccggcgccagtatccccctcccctcgtggcggcgtcagagtcggctccggtgctcccctccctcctccatcccctttcgacggcgttggggatggtggcaacgccggtaggggtggcggtgtgaggtgcgggtagaaaggagctggtgacgggcggggaagaggtgtcccgatctgcaccgactcgatctgcgcgagccgaccccgcgccggattgagcagggtatgaggggagaggacggcggcatgggaggaggaataggacaacgccgatggagaaaggggtgaggttggccggcgggggatgctggccttcacccgcactttgatcactcgctcaaaatcaaatgcattgataatgaatgttcatgcagcaagaactgttgattactgaacactctgtcatgtttcttggttcttttgtgcttttt

SEQ ID NO: 46275 - DNA, 1501 bp, Oryza sativa
taggttgagtttctaatttaaaaatgttgtatatatccggttggatgtaggtacccttctctaggtctccagctcaattgcggttatcatcagctagttatatgatgttggcaagaacaatgttcctgcaacattagttcccctttcactcttaacagtttgcattgtttttcgcactattctattggattgatgaaatgtcttgattagagacagacgttagagacagacgttgatgaaatgtcttgatcaaagtgagcatcgctgatcactccatgctgactggagtaaagaacagtaccaaaaaaaaaacagtgatttggtgttcgcaggtgccaacgtctttattccctggtcactgcctgccaaaccctgcaagcactccacgcattatattagcgtgtgattactgatttgctggcacttggcagaattatcccaaaacctaatcagtacttgcaaccattactttaaacttgattacattacatgattcggtggtcggttgattgattgataccttgcggccgaaatcctcattactactactgcatgttaggaactgaataaagaagaggaggttccctctagatcctttacttgcacctttggcctttcttttctccttaatctacccacatggagggatccatgtggcccccagtatcaagttcaggtctccttgtgggccccaacggactcatttactcctcactcattaccatccaaactcctcttttaaccactgtaaatttattactccttgctaataatcctaataatagtcacattgcttagatttgtagtagtagtagtaataatttaacagtgtggtttgactgagaaaaccgcgagattggtggcagcctccacgaaaggagggcgtttgatatgattatatatatgcaggaaaaaaacgagatatccctgccgtgcgtcgcggcaacaaaccgccggcaaaccaaacgggcgtgaaatcatttcggaaaccccccatccctcctcccctttttcctcgtaataaccggacgccgacgcggccccccgcctaggctgccgcagctgaaccacggcgcaagcgcaaccaccacgccgcgcgtacgcagcgcggcagtaaaagttgcggtagaaaacggcaaaaacgccaccaccgccatcacggctgcgggctaccaccaccacggcaccaccgcgtggtttgactcgtcgccgactcagatcgcctcgtcggtgacacacacccacacacggcgagaaagagtgagagaaagacgaagtggaggactccccccactctataaatttactggggtttggttggtgcgtgtgcagtgcagtgtgcgtgagtcatcgcggagtcgtcagtgtttcatcgtgtgcgccgcgccgctgcgtgcagtgcgttgcgttcctccactcccgcggcgaccgcttcaactcgcgcatctcgaggaggccggctcggctgctgcgcctcactctcactctcactcacactgca

SEQ ID NO: 46276 - DNA, 1501 bp, Oryza sativa
cttccttctttcacacgagcacggggacctattcgcgtaaatactctatcctccgaggtcctggatgcaattttgactgaataaaatatggcgccaagggggggctctcctactaatccaaagtattttagcgcgccgcatgaagcagaagccgccattaataactccccgaattcgccaaagcacaaccttcccccaccaacccaccgcacccagagcttcgcctcgacctcgccttcgccttcgtcgctgtagctgccgcgatccaggaggaaagggagtggggtgcggatgggattgggggaggaatgcgacagctgcacgggctgaaaagttgcagcagcagtagtagtatatgtccccccgcgccgcgggggttgtcgctgtgggtgaaggtgcggtgctcgctctcgcctgcctttcccgagttcgttggtgagggcaatctccggccgggcgcctcgtcggctggtgctccccgatcggggggctgctgcaaatcgctgttcggattggagcggccggtcggtctgcgtttgattgcaggttcgcttcttcgattcctcgaggattgtgcggttggtttgttcaggatttgtttctagtgtgagttcgatcttgttgttttcttttcttggattgaaatttcacttcagattacagttttctcgctatttgccaaaaaaaaaagaaggcttggatttttttttttatccctattcgttgttctcctagcttcttggtcttcttcggctcctcgcttctcttctttgtatctgtacctttgaagctataaaagtttggtacttttggtgaaaatattcgacggagaaggtatgcggaaaagggcatatttgtcgccataaaaatttacctaacgttgacaaccattagtagctcgaagtcctgaaccttgtgtactgtgctcttgtgccgtacagtctgcaggcttagttgggaagtcccagttgctggttgtgatgtggctcttgctgtcagtgttaataggttgttttcaccttatgtggaggagcttaagtaacttgcaagctcgcttacttttctttagtcaagaggagagttgattttgattgtgcccgggccatattttttccatggttgttggtttgaacacaccatggttaggtcaggcgcgttaagcatcatatggagttgacacgctttcacaccttagatactggatgctagtcttctgtgggtaggataagcgcctccattttggactaatcgatcatttagaatggtagcaagcgtgctggatgtctggatcgtgcagggatgactaagttgctgatcacttgctcctgattctcttgtacagacatggcgaacttcagaggttttcggcgcgcagtgatcgtggttgttctgtgcatttgtcatgtgaatgtcgtaaggggacagagcactgaccctgctgaaggtaatatacagtaatctctagtaggacatgtgctgtactgcatttgcttgcttgctt

SEQ ID NO: 46277 - DNA, 1501 bp, Oryza sativa
gtggatggagagaacactactgtactgtgtgcgcatcgatcatcttgtcccaatcgagtacttgtgcaacaattataattattcttccattttaaattacttattgttctaagtttattatcccaagttaaactttttaatctttaatcatcaatttctataaactcatatagttttatatcataatatttatattgttatattcaccttaaaaatactttataatatataattcatgtgttattaaactacactacaaatttaatggtaaaaataaatatgtttgacttaggataatctaaaataaccaataatttaaaacggagaaagtgtacattaaaccatttacaactactgtaaggtagtctcacgctaccaattctaatatatacactactagttcggtgcactaattcaatagtagcatgtatctcagtcttaccatatcttgaactttatcaaaggttgccacatcttgtgttagatgtttgactttatcctcttgtttggttcatacttgtggaaagattctctcttattttttatggtcttatatatctacaattctattttgttagttaaggtgtgtctcactttttgctagctatatacatcttaaacaagtgtggcataaaagtatgacaaatggtgcaaaacttattagaggacgtttggatgtatatcaaagtatggcaaatgatggcaaacatagtatccgagctagctcttgtatgcttgacagtatgtgacctatattgtttctctcttgtcgtcaactcaagttacatatcatcttttttgcaccacatagcacaataatagatcatagcctatgtacatctcagttgtataaaggaataattgtgttatctcgatgtaatttatgtaattatctacgatcagtaaagttttttttaatctaaagtaatatggtactattataagtggagcattttgaatagttttgcatgttgctaatttatcaaacaccacacggtaggatattcattgcttgacactgaattattgtaattctgatgtgattatttaataagtcttcccctgtgtattactctctccgtttcacaatgtaagactttctagtattgtccacattcatatacttgtgtctagaatctagaatcattaacatgtatatgaatatggacaatgctagaaaatcttacattatgaaatggagggtgtactagcaaagtggaataaactagtgctcaattgcttcaacctgttggaaaatatgcagatagtggtgaccttttttcttgtttgttagtaaacgatatcgtctggcattcaacaaaatttggactgaatccaccataactcatattaattgctatgaaaatcctacagtaaatttcacattgagtcaccttttattactgatgttttgttttggaccaccctttaaataaaatttccattttgaactagctaatcttgcctttgttttactttgtaccattccaattcgtttctc

SEQ ID NO: 46278 - DNA, 884 bp, Oryza sativa
gcactcccgttttgtggcaagcccatagacgtgacatccaaatcggccttatcaccacaatagtggaatgtgatgaaagtcaactaaagtgtaacagtagttatttcaactaaacttgcaattaaaatgtctggtcattgtaattcccagtgggtggctgggtgctggtgtaattcagtttcagaaatttcacaaaagagttatagaattcatttgaactattgaaattatcctataatacgagccagtataaaacatcctaaagttagcaatgctatttgcctgccgaatttttttccctttccaatatagagaagacattacttgagatccaacgctttgctcttcaagctaggaaggagcccacagaccaaacaatacagtcacctacttgtctttgctgtcaacgaaactaattccctaactaaaccaagtagcatccgtacatggccaatcttaaaaccggaaacaatcgcagtcagcagaactcaacctaaatacaccaaatcatgatttccctgggatgacaccactgattcctcggataaacaagcaccattcattcacctaaccacaagcacgataagtataacgtcgtccaagtttaaccaataaaacgcccccaaaataaatttcaaacgcggcattgccaccagctactccaaattagagaaacggcttacccaacttagcacaacgggttcaccaattgcagcaaacatgaaatcgacgcaaaattcagaaaaccaaataagtaaggagaaaccagtcaattaccagtcgtagtcatgcttcccgatctccgtgtccagcaagtcctccatctcaaacccaccacttcagactcccaaaaccccccaaaccagatcgatgcgatacgacga

SEQ ID NO: 46279 - DNA, 1501 bp, Oryza sativa
tgtaatggccactgattgggcaaatgaggacttctctggactttactttttattactactgttaaatacttgtacgaaactgatggtccttgtccagcaggattcgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttaagattatgtagaacattcttcactacaattttacattttggcagcaaaccaaatatgatcaaatgcaattttaccttaccaaatatttggtagtgccaaaacttgcttatattttggcacaaacaaaatatttgtacggtaacaatccaaatatgccctaaaaataataaaattgtattttaccagtcttggagattttaatcttgtataattttcaatataaaaagatttgataactattgatatttattaaaaaatatagagcacactataaaatcgccctcccccagggcggcaagggggccgcctgcaaaattccatgccccctcgccgcccatttgcaggcggccccccgcacagtataaaatcgccctagcggagggcggcaagggggccgcctgcaaatttcgttgacggccgtcgcccgagagcgaacggccggctgccacgtcattttcgcctcgccctcccagagggcggtaggcgactactcccgtcaattttcaaaatggaaaattatttttgtaaaacttttaataaaaaaaattataaataaaaaaaattcctaccgaaaacgggtggaagcgtcggggattagtaccacctcgcggagtcgaggaggtgcgggtgggaga

SEQ ID NO: 46280 - DNA, 825 bp, Oryza sativa
cttgcataagaggataatgaagtaatataactctgaactggaaagtggaaatgatttttgatgtttgaaaaccctaccatgcattgcccaccaaaataaactagttgaaagaaaattatgttcgccagagtgattttccaaattttagaatgcacctagtcacattataattgcaataactgtttcagtgcacatcgcctgcattggtaggttgttaggtgctgcaactagcgctaagaacaatacttgtttgaattctgtttaggcaacaatagtagaaaggcatggtaatcctttaacttgcctttttattgacaactgaatgccaatcttacgtttcatgcaaaaggagttataagaaaaaggcttgatgaaccaggtgatctgtcaataccatcataggatgttgaaaacagatagtcaccaatgctaccgtgatttgctgtattattgggttgtaatcatgtaaatttggagtatttcacgttattacatgtttgctcatattcatatagtgcaaagtgtacaatctgcagtagtcagtaatacattttcgtctacaatgaattgtaatttgtttttgggaagcaatcaagttccatctagttagcaatataatattgtaataatattgcaccacttatcatataaccattgatacatgctttagctgtatgacctgtttcttcaaatctactatttgctcagccaggcatgtgttgatgctcataattaacagaaatgtgctgcatgtttattgcagctttccattcctgaaacagagaatgggcattccacagtaccaactaggccagcacggagtaa

SEQ ID NO: 46281 - DNA, 1501 bp, Oryza sativa
ctcgcgcgagcacgaggtgaggctcgattcactttcactataatcgcggccatggcggcgaaggttgggttgttcccctcgtcgtcactcaccaccagcccccacgccatcgcggctgcgccgaccaacgctccccgcccacgcggggctcgtggattggcgtctccaggtcgatccgcggcggcgatggacgccttccacgtgtcgtcgcaggccgccgagccgctcctccgcaccaccggcgccgccgccgccgcggcggcggcggcgacggcgacctccaaccccaggctccgcgtgcggaatcctgaccctaatcctccgcgccctaattatagccgtcgtcgcttcttctatcctggggcaaggtgctggtagtggtcgtggtttttgacgacatggaggtggatgtgcaggtgcggacacatgcgcagggcggcgaggcgccctccagcggtggcgccggagatggcgcggccgggaaggagttctcgtggtcgtccatcatccttccgtaagatagctcccctctccatctctttggtcagtgacatttggggataaaatcggacagtgataggtgataagaggaatgcatttctagtttggttctagcttcccaatgttgagggatagcattggcacctaatttcaattcaagggagagagaatgctttttaactgttcagtagatattgcttgtttcatcgtgttgatgagaacaatcatattaaattagggcagactgtacaatgcattgtaagtaagatgcaatataattctgcactgtcttctcttctctgctttaatgctagataagaacatattataattcaggagatgataggtttgcatagtattttgattacatactgaagacaaatgttatagttggatgtaaaccattggtggttattatattaatacggcttggaatatggataaaaaaacaaaagcataaaggggaaattggaaaatatatcaagctttaactacttgtgggtcaatgtttggaacctaggttcttgttccctgcattgggaggactcctttttggttatgacattggcgcaacctctggagcatgcatatctctgcaagttagtccctattttggttggctatgcaatctgttatagttgtcatgtattgattcactctaatggtgtttattcctccagtctgctgaactcagtggaaccacttggttcagcctgtcatctatacagctagggctcgtggtaattttttagatattttcatgcttaccaaactttttgttttcccaatcaagaacactactgtctttaatgtgattttttgtcatccaatttaggcaagcggttcactctatggtgctcttggtggttcgcttcttgcatatcgcgttgccgattttctaggtgattcgaaaaaaaatgtttttcgttttttttccttactgtataatctttagcaagaaaattgactgctagtctactactaccatccttggttcagg

SEQ ID NO: 46282 - DNA, 1501 bp, Oryza sativa
aagaataaaataaatgatgacttagctttgtaatattccccttggtgatggcagaggtggccaatgtaggaacaaagtcgtccattaataacaatgaagacaccagtcggcggcgacgaaggctgtcgacggtgaaagcgaagatgcccactaatggcggcataataggccagccctgtaggcggaggcaccaatcggcggcgacggaggcaagccggcgatgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcttaataggccagccatgcagacggaagcaccagtcggcaagagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcagggaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcgacgtttacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggatggggggcaggattacgagatagaaaccttaaccaatacggtatcggtttcctaaatctactttacaatattagccaaccaggactttaggccgttccgtaatatacaaggaaacgt

SEQ ID NO: 46283 - DNA, 465 bp, Oryza sativa
aaaaatttagggtttgtctttttttttaagcaagtaggggtgtccgtttctcgggatttgtggagggttgacggatctgcccctgaggtgaggaggctgagagtgaccgaccgacgtcgacgtcgacgacgacgacgagatcagccgctgctgcccctgcctggctggtggtggtgccctgcagggcattgactcagatacatatgggtcccacttgccggtgaagtggtgtatggtacgaacatcgttgaccaagcattacgtgatattagtccctcgaacgctaactgaaaacgaaaacgcagtgcatacgacttgctccctccgtgaactgtattaagatctaagtgtgattgctaactaatggtgagttgggtctggagtggagttgtggagtagcctaaacccagccacatctctctagtttattttgtgagcttcacccagttccgcttctattttagg

SEQ ID NO: 46284 - DNA, 1501 bp, Oryza sativa
gtttccaacactcccatctcattttctcaaacggctgaacgatgcgttttttgcaaaaagtttctatacgaaagttgtttaaaaaaatcatattgatccatttttttttaaaaaaaactaatacttaattaattacgcgttaatggaatactccgtttttcatgtgcactgttcaggttaccattctcccctagcgaacacagccatatgactctagaaaattctcatatgccatatctcattgttgggaaatgctaacccaaaagagagctgctcattgataatgctggtatcgataagttaagaggattagttcaaatttgtgctactactaagctgctggggcaaatgatcgaataattcatgaaacaattctgcccgacagcttacatttcagttggacagccatgtaaagcaaacctacccttcaaacaataatacacatgagccatcaacgagccccgatacactacatgtgccatcaacgagtcctggttttgataatcttccccctagatgccttcttctccatcttctcccttttctttcgggtcttctcatcctcttcttcgccctgcagacaggaggtacaatactgataagtcatatccaaatgtcggttgtgataataatgtactgccactgacaatcactctatttttacctctgaactaccaccgaaaaatgctcctctcaacagaccggaaatcttgtatccaccataagctggaatctgaaaatcaataggtatgtggttaataacaagttaacaatgattggcaatgcctcttggtattgtgcacaactcatcatatgtagctaccatctgcaatgcgcattgagaattttatttaacaacaaaaagagggggccatagttagatgcctgtataacaaaaataaatcgaaacaataattttctagagattttaactcattggccatgatgccatgtgcctacattcctaacatgcctgtgattgcgaggaaaaactgattgaaagtaagagcacaacagcttacagtagtagcaatcagtgacggtaatctaaattggtactgcagtgtggctgttattcaaatataccgctgtaaaaccaccttatgaaccagtggtcacaaaataagttacaagcatagatcagacggtcatggtatcatggataacattcctaggccattggcataattaggttgaatgataatatcaagttcagcacagaatcttcaccagacatgctggaacatcaatcaaataatggaaacatacaaacataggataaagaaagaggatgaggacaagaatttaaatagttttcaaccaagttttcatgttgtaacatgctacagaacaagcaggtttatgtagtttataaatattgactttattctatattgggggcatcccaaacaggggtgacaccaatagtgacatcaacaaaaagtaatcgccatagtaaacagaaatataattgaagtcaagaatggtgtgtgtgaatctt

SEQ ID NO: 46285 - DNA, 1501 bp, Oryza sativa
gatgtgatagaaaagttgaaaatttatgtgtgtaggaaagatttggctgtgtttagttcaatgtgatagaaaagttgaaaatttatgtgtgtaggaaagatttggctgtgtttagttcctgaaattgagaagaagtttgggaaaagttggtagtttgaaaaaaaaaagttgagagtttatgtgaaatgtgatagaaaagttgaaaatttatgtgtgtaggaaagttttggctgtgtttagtttctgaaattgagaagaagtttgggaaaagttggtagtttgaaaaaaaaaagttgagagtttatgtgagtaggaaagttttggatgtgatgtgatgaaaagttgggagtttggggaaagtttggtgtgaactaaacagagcctttaatgtgatggaaaagttaaaagtttgaagaaaaagtttaaaactaaacaaggctgtaatagatcaataactgaacacgctactagtctcaagtgcaaatcagacgtatgtacacatgtgtggagattatgggtaccccatacccacacggcatggttatctgactagttataggggataacttatatgtatgtaatatgtaacagatcataacttgggtgttacgtttccttgtatattacggaacggcctaaagtcctggttggctaatattgtaaagtagatttaggaaaccgataccgtattggttaaggtttctatctcgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggtaaacgtcgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgcctccctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagatt

SEQ ID NO: 46286 - DNA, 1224 bp, Oryza sativa
cgcaggttttgtttttttacagagggagtacgaatcaaaccgcgaatcaggatggatgagcccacagtaacagttctcgtatacccgaaatgatacggcggagtgtgcagttgaatgtcacgtcaacagacagatgcagtgcaatgcaaaagcagagacgacatggatacagtgctgtaatactgtctctcatatgctgcacagtgcactgccactgtaccagtatttcgccgctgctactttttattttgttttatttcttcatgttcaactttgaaattcatagtactatcaatcatctgtttcaaagtatttcatacaaaatttccttgcaatattaaatactccaaatttcatacgccttatttataaatcaaagagagcttaaatggattaaagagggagtcagggagagaatagagacaaagagccaagttatgttggtctttttaatggagaactaaaatgaagttgtatttaggtgacatgaaagtatttttgatgatgtgataaaaaaataataaagtgtcataccagtatttttttatgaaaccatgttaacattgttttcttacaatttatctcttacatgtactacctatgaaacaaaaaaaatgaaacaagaaagaaaagatgacattttcaaaaattttcatattcatattcaagtacctatgaaaaatcattttcatattaaatatcttattacctaacacttttaaaaatatgaaaatgatttctttcactgggctactcatggagcaagaaagaaaagaaaaaaaagaaatttactatgcatacgacctaactatccaactcacgtagaattgaatttgatcaacgtttgtaaacggttgcagtgcatatgacatattcttctttaattgatttatggtttagtacatatctctaattatatatgggttataaaattggatagtacatactataacattactcctacttgagaaaaaaaaatactactccctcctaactaataatacttgtcgtcttagataagagtgatgttaaactttagaatctttgattgtgaatcgtttttaaaatatttatcttttaaatattgtgactacatgtatagattagtcttaaaaatactttagtaaaatcatatatttgttaatattatatattaattataatagaaaataatggttaaagtaattttttaaaaaccgtttcgtttttcaaaccaataccagg

SEQ ID NO: 46287 - DNA, 1501 bp, Oryza sativa
tataaggttttaactagtacaacttattgtttcatacatatataaaaacacttcaacaacattaagtatttgcaaatataacatatttttcgtatgtcttttttgtttcactcgttagaacttattgtctcatataattggttgttgatgctccagttagcagttttaaatgttgtatttatgcagtggagtgaaacaatgttcttaatggagtgaaacaacgttcattttttttggtaaggtcttgtggtaaagattaaatgatataattaaatcataaatcagaaaattattttaatagaaaaatcgtttaaaagataagtgaaaggagaaggagtagccgcgagagagagagggagggaattagcgcgtgcataaaagtatatcaggcggcaggaaccacgcatagtagtttggggccctatatttataaaccacgcatagtagttcggggcgccatatttgtagtacatcgcatttgttccacactatgaaatgttttttcaacgccctcattgcggatcattcattagcaactagcctgttgagtcgcacgtttgtgcgaatataacctctctgtctattagatgtgcttatatgttgtttgtgttaatgagcctaaatgttttaataataattaaaaacaaatacatttttaacacattttgaagtatagctataacactaacagatatctatatctttgatttgtgattaagaatattattttaaaaaataatttatcatatgttaccgtgaccattacctccttcaatttctaaatttaataatgtaaatactcacatcttctacacattgcaattctgtcatgaccagttgagaagtatatatacaatttttaacgtaaatcttataagactgttcagattgtagccaaaataaatcttaccaaattttttcaatgccaaaattcaggcaatatggcaatattgtcaaaattttgacaggatttttttatttatttaccaaatttggcaacaaactaaacgcgaacatttttttggaaactttaaaaaaaattgtatggttgaaaatgacatcaatctaaagtatgaactgctccaatggaatgtcttccatgcaacatgatttgtaattttaaggcataatgaaataatcgatagcaccaggttaattagctattcatctatacattaatactcgttattttttatgcaatagaacttctatgaatattcattggtgatttttttgtcaatgtacttttttttcattctcatatctttcttaccacatactccctccatactcataaagaaagtcgtttagaacagtgacacggtgtacaaaatacaactttaacttcttgtttctataaaaatatttattgaaaagtgatatatgtatacttttatgaaagtatttttcaagacaaatctatacatataatttttacatttttaaactcaacaacttgagagttattcatgatttatattcccaagttttgacttaaaca

SEQ ID NO: 46288 - DNA, 1501 bp, Oryza sativa
ctagtgaatttccgggcgtgacattttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgatagaaggacaagctatatgctcaggggctcatcaactcaagcgtgaggattatatctccaatttggacttgttccggatacattccacatggattcatagttatgagtctattttctatgctcaacgactggaccaattattattccccgtaagggctatcaaccgaatacttgcgccattcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttataagtcaaggtgctgtttgggtttttaagcaattgattggatacaatattattgctttttgccacgtaagtgtgcatttttattgaccaatattatggcttaggctgattatatattgtgatcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccagtactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatctgctacatattaatattaagtcgcttggttgactacaattatcgaaaccactcggtgcatctagtcgatgcacctgactttattttttcagccctccacagtcttctgatttagaaaaagtactcgggagatcatggcgaagatgattgaagcactcggctttggagtaatctagttcgagagaagattatctttctgactgtgaaggtctcaggggctactgtg

SEQ ID NO: 46289 - DNA, 235 bp, Oryza sativa
ggtgttactgttttgttagcatcatctcaaagtctataaaaaattgcacattttcaacccctagtaccctgcatgtagagagaggagtatatgcagcaatgacaaccaattgaatgcactctgtcactctgtcagccagaagcttgccatgccatttcaaacccagcagaggcacttgaactgcctcacatccatctacacaatctcatgagtaatgccattaactgcacccagg

SEQ ID NO: 46290 - DNA, 288 bp, Oryza sativa
tcattcttttcttggaagtatgccatatgggattcctttttaatttttacctgttggctgttcttgaggaggtaccacagtttgttaatgtaaattttggtatctcttgatgaggtaccacaaattaatactaaaaactgtggtacctcttgctaccttctcaaggaccgtaaaatcagttatatcacaacctaattatatactttagctattttgagttcggagtctagtacctgatttcttgtataacttaatttgttgcgcaggttatttacatagtagtgagaa

SEQ ID NO: 46291 - DNA, 1501 bp, Oryza sativa
ccggcggcgagtaagggagaaggcgcgtccattggcgggtggctgggttgacgacgtggtggtcgagcaggatgaggccgttgcagtggtcgattatggtgagaagggatttttcgatttcgtcggtgtcgaggtagtccaggtggagggcgccggggatgggtggcctcgtcgtcttcgtccctgccgacggcgaggggcgggcgaagaagccgctgagagttggcacgccgatctggacaaagatgccgcggagcgtgcaggggaggagcgcagccgcggtgggaccaagaatctgtgttgacgagaaaatagaacacaccggcctgggagatctgtttagctcctgtgcaggtccaaatcttgattagatgcgagcggccagacagtttgatcctgcaactgacaagatatgcaaatagtagatccaaacagccgatcggctgacaagccgatggagtagttccagccgatagccgataatagccgatgctaataccagccgatagcgataggatttaagcaatcggctatatgtccaacgtagataatgatatgaaggcaatcggctgatgaagatgtaataaaataacaataatataatccgatagaaaccaatcggctagaaacaatatataataagcactgatctgaaggttaaagcatacatcggctggaggttgtcacgccccgaactagtaccgaccggaactagcccgtgacgctccaatttaacctgttaatcgataccagtcaaaggaaacagtgctggtatcacagggagacagaatatcacatcaacaggggtctctttattatagagtagaggtacagtcatgttgggctgcggacagatcccgagctcacaactgcattacaaaagggaaacggaagccaggatttggaccaatcaacacatgcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccagggaaataagtgtttaatgcaggcttcaaggaaaggcggctgtttttgcaattgattttatttgaactcttttctaaaaacaactaggtgagtgcttctcaaacgacacggatgagacagtgcatctcgtccggtcggagtatgtgcaatgtattagtctttagaattgaaacaagattggcacccggccaacagcttttcaaacggccacccgggccaacgactttacaaacggccacccgggcctagctgatcccgtcagctgctgatttttcaaacatcgaacccctttttcataacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 46292 - DNA, 1501 bp, Oryza sativa
gacggtcgccttcaaacttaaaatctgagtaacaacttgggtaaaactggagttttacaaaagacttggaaaacccaacacctgggtcggtgcttgtgaactaaatgaatttccaaaaccgcggaccggggaacgtaccgggtgtacggtttcccgctctcgcacttaaggaccgatttcttggaatttcatccaaacataagacaagtacgaccacatgggtggaatgggacacccctggctgagtaactagcttatcaggggagccttgatgccgagagacatgtggattcgccggggtggtgtcgaggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttatgaaaaaggggttcgatgtttgaaaaatcagcagctgacgggatcagctaggcccgggtggccgtttgtaaagtcgttggcccgggtggccgtttgaaaagctgttggccgggtgccaatcttgtttcaattctaaagactaatacattgcacatactccgaccggacgagatgcactgtctcatccgtgtcgtttgagaagcactcacctagttgtttttagaaaagagttcaaataaaatcaattgcaaaaacagccgcctttccttgaagcctgcattaaacacttatttccctggcttgctgagtactcccgtactcacccttgctctatataaataatcccccccagttgctgaagaagatgaagcggatcctgctgatgaggagttcttccaggagcaagccggctacgatgagttttagggtttcggcctagttcccaagtcgcgcatgtgttgattggtccaaatcctggcttccgtttcccttttgtaatgcagttgtgagctcgggatctgtccgcagcccaacatgactgtacctctactctataataaagagacccctgttgatgtgatattctgtctccctgtgataccagcactgtttcctttgactggtatcgattaacaggttaaattggagcgtcacgggctagttccggtcggtactagttcggggcgtgacaacctccagccgatgtatgctttaaccttcagatcagtgcttattatatattgtttctagccgattggtttctatcggattatattattgttattttattacatcttcatcagccgattgccttcatatcattatctacgttggacatatagccgattgcttaaatcctatcgctatcggctggtattagc

SEQ ID NO: 46293 - DNA, 427 bp, Oryza sativa
aagtgtagttttatactgttcatatccaacatttgattgtttcgtctatttgaaatttttttatgattagtatttttgttgttattagatgataataaaacatgaataatactttatgtgtgactaattttttaaaaaaaaattcataatttttttaaataagatgaacagtcaaacgttggacacggatattcacggctacacttatttattttaggacggacgtagtagttgggtataagcatctcagaaagaaacgatcgcatccgaatgtactgccgcgtctccgcaacccacttggccaccgccgccgtccgattcccgtggaaatcgaccagggccgtccgatctctctctctctctctctcgctgcagaattggagatcgtctcgtctcccctcccccctctccctcgcgtgcgtcgtct

SEQ ID NO: 46294 - DNA, 954 bp, Oryza sativa
tcctcgatgacttctgaatgctcacatgcatgggcagaaaaggaagataacaaaaacaaagcgaataattaataataatcacaacaaggtgatgttagagatgataaactagaaaaataattcaaacaaggaccgtagacactctaaccaaccccaataacattcaaccttaactagctgctttattaaaaaggacaattagcaggacgctagctagctgcaccttcatgaagagatggtgacccacgtttttgcaattagctagctagtgtcccggtggatatatggatcgtagcacgaagccctcgagatgcttcttaatttctttttgggcgaccatgtgtatgtgtactcttgctgtgatgtgtggtcgatcgagtcaatgtttaaaaccactagaatctaattaatatgaattcggtgttgaataattgtcataaaatcaaaataacataaaaagatactccctccgtcccagaaaacatgaagctgccatttgttgaaattcccaattcagacggggggttgtttgttgaacacatgaatttagctgctacgctgagctgctgacccagctacttggttccaaggacaaggagcgtgtccaaagttctctttgccgtcgcaacagtttttgatcgcttctgctgcacctaattaattaaatttccccgctataatttgtcctaattaacccgtcagtccacttctccttcttcttcttcttcctccaccaacgccaacgcgcttggtcaatctcccactccgctataaaaatttctctccccgcactctctacgcggcggcgtgcacgttctcctccacctccgtgcactatttacttcccagtttgagtttgacattctcgcgggaagaaggagaagaagttggtgagcctgtgagaggctgattgcgcggcggccatggccggagggggagggaaggcggcggcgg

SEQ ID NO: 46295 - DNA, 1222 bp, Oryza sativa
cttttttagaagccaagagattgtcctggaaattcttccagaaaaaacttgtgtatgtctgtgagcgcagtttatgacctataaaagctgtcagatgtaagtgggcccggcctgggagaggaggtgggatcttttccggaagccgatctctaaaaaacttgtgttggtctgtgagcgcagtctatgacctataaaagttgccagatctaagtggccccggcctgggagaggtgggatcttttctggaagccgatctctaaagaatgggagaggtgggatcttttccggaagccgatctctaaagaactttgaggttaagtgtgcttggcctagaaatctatggcctataaaagctgccagatgtaagtggccctggcctgagagaggtgggatcttttccggaagccgatctctaaagaactctgaggttaagtgtgcttgcctgggagaggtgggatcttttttagaaaccaagagattggcctggaaattcttccagaaaaaacttgtgtatgtctgtgagcgcagtctatgacctataaaagctgccagatctaagtgggcccagcctgggagaggtgggatcttttccggaagccgatctctaaagaatgggagaggtgggatcttttccggaagccgatctctaaaaaacttgtgttggtctgtgagcgcagtctataacctataaaagttgccagatctaagtggtcccggcctgggggaggtgggatcttttctgaaagccgatctctaaagaactttgaggttaagtgtgcttggcctggaaatctattgcctataaaaactgccagatgtaagtggtcccggcttgagagaggtgggatcttttccggaagccgatctctaaagaactctgaggttaagtgtgcttggcctagaaattctctgaggttaagtgtgcttgacctggaaattcttccaaaaaagacttgtgttggtctgtgagcgtagtctttgaccccgacatgggagaggtgggatctttttcggaagccgatctctaaagaactctgaggttaagtgtgcttggcctgaaaattcttccagaaaagacttgtgttggtctgtgagcgcagtctatgacccataaaaattcttccagaaaagacttgtgttgttttgtgagcgcaatctatgacctataaaagctgtcagatgtaagtgggcctagcctgggagaggtgggatcttttccaga

SEQ ID NO: 46296 - DNA, 713 bp, Oryza sativa
ttttttttccagtcaactctgtggttcttctcaaaataaatagaaatgaaactttgcactttgggacatgcatgacactgtcaagataatctggacctgaatgacatgcgacagttttagtatattatgtgccttctacctttgagtgcagatatatcattgaaaaattaggccaagagagaacatcaaaaatacatattgttgggaaagaagaggttgaaagaagcttatatggacaacttgttcttggtgaaggagtagcctccagtttggatgaacagctagttaaggaagcacaaaaggctggttagtatttattactgactgcaacaattgaagccttgctcatgtattttaagtgtctgtaatgttaaaaattttcccctgcgtgctgtgttacagcttctgcagaaaagcagaggatagcagaagaagttgcgtccattctgaaacttagtgttgatatcaatgcagcgtctaaaaggttattattgtttgcttattcataggttttgtactttgatgagaaatatatctgaacttcacactgtttactttgcatcatcagctccgagaagattattgtcactctacgcgctggatccgagtatgttggacgggacgtgcaaaactgtgttcttgtcgcaggtagccaatctggcgttcttgcagctgagcgcattggtatgccatgcatagttgttagaagcagg

SEQ ID NO: 46297 - DNA, 1501 bp, Oryza sativa
gcccataccatatcggatcggatattatctgatccgttttcacccctaccaatcagtcttgcggagatgctgatctgctgctgtgaaaagagaatgcctattcatgtgttggagccaacacatattataattcactgcaccctccgtcaaaaaaactaatctactattgaatttgacacatcatagtactataaatctggacatacatatatccagatcatcatactagaatatgtcgcatgctgtcttagatttttttttatgggacgtagggtgtagttctttctttgtcccaatttaattgtagtcgtgggtttccgcgtccaacgtttgaccgtccgtcttatttaaaaaatttaccaaaaaaaataaaaaagattagtcacacataaaatactatttgtattttattatttaataacaaaaaaaattaatcataaaattttttcaaataagacggacggtcaagttgaacattaacggtgcaaaactactcttttcgggacgaagatagtattaatttttttatggaacattattcttttttagaatatatggaacattactcgatgatttatattttttaaaactatgtgcattattttttaaaatctgtttgaaccattgtactgtacttaaagtatatgatgaaatgagtttaatattaaatttattcaaacatttaaaagtattttactcgaataataagtttgttatagaatacaatggttcaaacggatcttaaaaataatatatatacgtacaatttaaaaagatataagtccttaatggttaatttataggagtgttaattgtagtcaagaatatatagattgatgcatgaatcaatggattgactagctagctgttaaacaatattattgtgtaatgcttgtactggttgcgtgtggaaactagatcgatatcttatatagttgtacaaattccacaccatcagttgacaaactgatgatccagctcatcttatctatatatatatataaatccgtcagctgtgatcgaagttaatctgaattatttcgatgccattgccggtcggactaatgactgacggagtgcaccagtaacatgttgagtgatgtaggacggacacagcagcggcatatactccctatctcccataaaaaatcaatctagcagtgttacacattgtaatgctacgaatctaaacatatatctgtccagatttattgtattagaataagtcacattcaatcctagttttgtttttcgtgggaggagtatatatatatatatatatatatatatatatatatatatatatatgtttttccttcaaaagtagtagcgccgattttgggtaagtgggtcacccccatcgtcgaattggcctaactctttttgtaggtaccaagagtcgacaggtagtcctaaatccctatcccttttggcgcgagctaattcctttacgtctttataaagataattgttccagcaatatgtagtctttgcattgaat

SEQ ID NO: 46298 - DNA, 715 bp, Oryza sativa
actcagggtagtactgtggtccataccgttgggtggggcttggggcttgagtgctcggtttgtgtcactgccccagctgatagcaaaaactttcagctccctgcattcgtgtctctgactcttttgttatgtgatacacgatggcaattttccgatttcgtttgggcacctttaagctccatatgcattaaagtgtcttggcctaacttatttttacaactgatgctaagcactgtatgaggcattggggttgtagatataatttctcccaaaatcaagagaacatagatgtagccatgggttatttgtatcataaaatggcattaacgaactacaattttgttgcattgagccatcttgaagttcaattagtctgtatctgtcatattgctgccatgatctattgttgatctgtcctaatccatttgtttggtatgctgaattagaacttgaaaaatgtgaaatctttatatggtaggagtgagtgcaggctgcctcagaaatgctatgcaaaattttccaaggttaaccatcaacattttgttgaattaaaaggcaatgatctcacaaccatgtaagatactaaaagagtaaatgtaatgattgctgagtggttgggatttggggaaaaaaaactataacagacgctaaattttttttgtgtatatccttgaaattgcaaaaatatgtttgtatcttagttgctcgatttaga

SEQ ID NO: 46299 - DNA, 371 bp, Oryza sativa
ctggcttcaccagagtactcttatataatacatttctaatgcttgaaaaccttgtgccagctttgtaagctaaattgtggcttaacatactacttgttctaagccagtatgtaaatttaataccaccgtgacaaatattccttcactttattctttccttgcccttcttaggatggtaagatttatgttaagtatggtttgcttgggcctattacgttctcagacccctcgagaaccttgcctagtctatatatgtatacaactgtttatgtattgacactattgaggtactttgtgttctccaagcatagaagttttgctttgtgtaaagtaagattcttaattctttatttgatgacagactgatgagt

SEQ ID NO: 46300 - DNA, 1501 bp, Oryza sativa
accaagtactatagggtcccacctctcctccttctcccgcacatgtgtgggtatacgtatgtaccatggtatgtatgcttccttcccttctttttttccttttttcttattttccccatttatataatagatatatatatatatatatatttaaataatcataatttcaccaacaaagaatgctcacaggtaactaaattagctctacaatttttgaaaataaaatttacaccattatatgttaccattaaattaataatattatatattttctacataaacatgtgtactcattattttgtactattattttcacataatgcactattttaaaataaagtttacacaattatattgtgtacctatcaaataaataattttagatctatattaactgatttatatgtgcacttaaactgatggacccattatttaaatcatcggaactatttttttttacattggactattattctcaaataatgcactaaagtctacatcattatattgtgtacccattaaattaaaaatttaaaatctataataactaatgtacacttataaagaaccggtggactcatcatttaaatcatctgatatattatttgctaataaataaagcgtccgaagttctctttttggcccgctacacaatgcacgtctgcacctttaccttttgcacgcgtgacaaagcatcgtgtctgaggcatctaaggtgatcatgactgccgcagcactaacgttttgccacatataaattcatacatagagaagattaatttattaataacatgaaaagaaaattagaggtgtgatgcagcaagagcagaattaagcaatatgggttgtgttttttctaacacttagctctatttaagttaaaatcgagagttaattacagaataattataatgtattgtgttatgtcgtgtttggattttgtactatttgtagctctatttaagttggaatcgagagttaattacataataattataatgtattgtgttatgtcatatttggattttgtactatttgttggtataggtaaaagaaatcattatgttataatatgagcacaatattaacgaatatcaatagaactcttacaaagacaagagtgctataaggaagtttaagaccctctttttttccttgattctatagttggattttcgtttgcacgctttccaagtttctaaacggtgtcatttttaaacaacattttaactttctagaagtcaattcattcatgtataccctcaaatagctatcacataaatcagataattcatcaatttcagctgtcctaaaccctaagtagtatatatttttttcatgcgagtcatggtgatcattaaattagggatcaacggataatcaaagtcgtaagatgaatatgtacaaactactatcaacaactgtaaattggtgtcaaaattaattgctactaattagacatctaatggcttgctagccacataattaatttctctcgaca

SEQ ID NO: 46301 - DNA, 199 bp, Oryza sativa
tgctgtttttgtggtcttgtataatatgctatactgcaagttcaggtttaaatccatattcaagatcatcatggaccctaagtattttccctctgtatattttcactctcatcattctatttcatattcaacttatatgatgattgtctaagacttgcaggttgataatgataaagaaaagggagtttcatctggaaga

SEQ ID NO: 46302 - DNA, 1501 bp, Oryza sativa
ctaggaatcacctcacatccgcccatgaccgtgggcatgactgttcgaatagtttaataacctctgcagagggggtacactttacccacacgacattactaacccggatcacccagcccgtgcagaacggccacgtctagagaccttgaggctttcatgacaaggcatttcgaaagctgacacaggttcaccatatgccaacgagaggggtcccaaaccgacattaggttaggtcccagaccatactgtgccaggaagcccgggggttctccctggcaccaccccgttgaatccacatgtctcttggcataatggctgcctcgattagctaattactcagccaggggcatcccattccacccatgtggtcgcacttgccttatgttcggatgaaattccaaggaaaacggtccttaagtgcaagagcgggaaaccgtactcccggtacgttcctcgatccgcgattttggaaattcatttagttcgcaagcaccgacccaggtgtcgggtttttccaagtcttttgtaaaaccccaagttttacccatcgttggatattttaaatttgaggggaggtgtcccgatgcgcgtgcccgaagtcccgtgcatcgaagcacaacagtcgacaaaggaggtttaagtgttcaataattcaaggagggtaattgcaacaattagggttgggccggcaggctatctcgcaagccgcggccgatttacttgtgttaatcctattcatgcaatatttgtggaaaagaaatacttagatttaaattagggtttgttggaaccatgccaccctatatttgcaaaatttgagatatgccacccgtatctcaatgacatgtaggacacacatgagtcaatgacatgtgggtcagggtggcatatcacaaattttgcaaaatttgtgtggcatggttcgaattgtccctttaaattataggtgcaagatgatcaaagttgacttgccttgctcgagatcttgagcttgatcctcgaaatccgcgcactccgggtcttcgggctctgaagctacacgcgaacgagatgactcaacaaacggcgaaattaaagccctattattgacctctaagcgtgccattagatagatctcgagatttgaggaattttggaagttgaacggagtcaaacggatgtatggttgaaaagatattgaatttctaagatcatcggatttttggactaaaagaaaaggatttatttaaaccctttttgaattagcaacgaaagagggaggggaaacagacttccctcgggcggctagggcgcggcccgagagaagaggcgcgactcggccgagctaatgggccggccggcccgagaaggcggcccaaaggcacgcgggaggggaggagagagggagtcggtggaccgggctcacctcgcgtgatcccgagtgggacctgcttgtcggcggctcggctcaccgtgagcgaggagcacgcgacgcggcgctagggtttggagcggggcgcga

SEQ ID NO: 46303 - DNA, 321 bp, Oryza sativa
aatggttccttttccttatccatcgcggtccagccttccttggcattctttagggcttttcttagtgattgtgccatggtgatgtggttcaatttgcaaataaatgatagatataaaatcattattatgataaaatacacataagaaaagagacatttctttgcacccaccatatggtatttttggtatcttttcaattgtagatttgcagagttatcttatgttggttgtttttgacaatttcatagatcgtactctatgttttgttgcttcagtaaaaaaatatggtttattgcgtgaatttgtctaatggatggtgta

SEQ ID NO: 46304 - DNA, 230 bp, Oryza sativa
caaaagcaaacgttataagtttatagtatagttagttgattaggtatatgatgtcatatccaaagcaaaagtatacacgtgtggggaacttatgatcctacatgtgagtttaattatggcgttggaacggactcaaacatcactactagcatcatattatgtaatttaaaaattgaacaaattatatatgagttgagtcctagctactcttgggcaggaatcccgcagga

SEQ ID NO: 46305 - DNA, 892 bp, Oryza sativa
cagtaaaatgctgttcccttaactcgttttggtcagtagaacttactgatcttgttgagtttctcaattttgtgaactataataaatctattacagtaagattattgcactttgcctaaatcgtgatatgagtagagtttgcatcaggctccgttttcacttgctatggttcaactgtgtttttgtagaagctgcaccgactatagttattgatgagaacaaattattgaatatcattcaatttgcactgcatgatatattgttttgtaacaaggcagaaatgtaaaatgctatagtcgagaaaccacatcaccagaattaaacgatcaattttcataaataaaaattagaagattgactttggcatgcctactttctccaaagaaaaacaacaaacaacttgacatcctagaaattctaaacttagttttgttaacttgccatcttaacccccaatttttttccgatgcacctactactttgctggtcttaactttattcgtggacaggttctgaatgacatgattcaagatgactctgagcaaccaaagaaaagactttatgatttgaagatccaattgattgaggagataggatgggtccatgtatcggcctacgagaagcagtggatgcatgtccgatttcccccatctttgcctccgttttaattgttaggactatttttcactcatttttcatcaccatggattcagtattttactatttttgtcattgttggtagcaaacttgctggtttggtagtttttcactaggtattttatttcttcaaatggtaataagaacttaagaaggctgcctgctactgctaagctcatcggtttgtgcagttttgtctgcttgtcatcttcccattctaatttcccggtttagt

SEQ ID NO: 46306 - DNA, 1501 bp, Oryza sativa
ggccgacaggccagtcgccgccgccgtcagcgcctgccgcgcctgagcccgcgcctgccgccctgtagccgcgcccttccaaaccgcccccgccgtcatcgccgtcgtcacgacccggccccaccaccaccgcgcatgcttccaagggttggaggcagagctcctcctcccactgtctcgtcgccctctctctccttccttcttttcccaaagtggcaagaggcaagtctcctttccctctttcctttcttctttttctcccccgccggcgtcatcctccctgtcgccgttttggccgctagccggagcgctagctcgctggcttgaccgcccaatgtcggttccgccctcccaaaccgacattgtcgcccctataaatccgagcccctttccccattccaaactcccttgttttcgccttccgtctccaccgcaccattgtcgctccgccctacttgcacctccgccattcgttgccaaagcaccgggagagccggcgcgtgcgaaggacgcgtgaaggggactccgcgcgctcgtcttcttcctcttccccggcccgaggccggagagatcactcccgtgccgtcggcctctcatcacagcgccccgcctcgtctcggtagggcatccctccgttctccctcctcgctccatctcttccccttagctttgagtagcagctcgagtagtaccccagtagctagttggcgccgccccaagccgcgccgccgctcgcagtaagctcgccgccatcgcacccgcgctcggtagtagccgcccgtcgccggccttcctcggcgatgacccgtccaatccgacgctaaaaacggattcccggagtcacgtagatgctctaactcgcccgaatcgatctcccgtcatgccgtcgccgtttcccccttctctcgccgccggttgccgccgccgcaacccgccgccgtcgagccccctccggcgaatccgagccgttggctcgtctccctttgtcccgtgcaacctcccggtgcgctcgcccatgcctgcatcgctgtagatcgccccgccgctcgccgccgccgtccgccatccgttccggccgacgtcgtcgtcttcctctcaccagcccacgtggctgccacgaaggcggcacgtcggtgccacctcggccgcgaccgggtcaagcagacctcggtccgccgctcccctccgccccgctcgcgcacgcggtccaccgcgagccgtgaggctgcgcgtgggcccgccgcatccgcacccaccgcgagccgcgcgcgtgcatcgcgccccgctccaaaccctagcgccgcgtcgcgtgctcctcgctcacggtgagccgagccgccgacaagcaggtcccactcgggatcacgcgaggtgagcccggtccaccgactccctctctcctcccctcccgcgtgcctttgggccgccttctcgggccggccggcccattagctcggccgagtcgcgcctcttctctcgggccgcgccctagccgcccgag

SEQ ID NO: 46307 - DNA, 1501 bp, Oryza sativa
gtttgaagaaactagaacaacatatatagatttatctttcaaaacactataataaaagtaaacatgcatttatttattatgtatattataatagaaaaataagttcaatggtatattttgtagaccgtgtcattgttcaaaacgtcaattaaaatgaaacagggagtacttattaatcgtgacgaatatttgcatgtaacagtaacaaccaattaaggcagattaattagtaggactactgtacatggtgtatacaatttattaatgttgttctaggatggatcatttgcatgaatggcagcaaataatgaattaatcccctagctagtagctagctagctgcctactccatgtatagtcttttatacggagtaacaaattaagatgacccctaatataatttttccgttaaaaataaccatcttttatatgaaaaacttgacataggtcccaacacaagctatatctacttaactgtcaagtactgttcatcagccaatatatcattgcatttaattatatatattcgtgatgtgtgtgtacctttaatttgacgaacgtatatatgttgctttctagttgatctcctcgccattagttatgattattgagatattttaaaactgcctttactttactgataacagagttaatctatattgtttatttctttactaactactatcttatgaatcatatttatttatagcagatctatatacagtatagatatcgactactagtagtatagtagtatagttgtatgtatttgttgtactgtattatgtctcgtctcaattctaagaattttttgaacggtgagaatatgcactttcagcacgatgatcactaaaataaacagggaaaatatgtagtgcaaaactaactatgtatcgaaaaaggacgttcaagattcgtccacaccaaatcctggacgtacatttttttgattcagcgtgaattttcagacttccacaacatatatagtttccaccatttttccaaataagcagatactcgtcagtaatgatgttttgatgattgatagataaagagagcaaaaggctagctacatccaattcgctagctagctagagtatatacacgcgtaccgcatttatatggatctgcaattaattctacatggagatggatgtaaatgagtgcttgatcagttacgttaccaaaacgatcttttgataccatttggcgaattaaattaaatggagcagatctaatttgagaatgtatatatgaatggtcgagggacatgcatgcatatcattgtctaaaataaagatggaggtagaagcggtctatctcgggcgccctctgcctctggtggacaaggacgatttgaattgatcgatcgattaattattgaacttttgtcatgactcgagacggcgacggaaaaattgatctgcaggtacggtatatgtatatatctcgtctcagaaaattaattaactaattaaccgcgtatctatatctcattcga

SEQ ID NO: 46308 - DNA, 215 bp, Oryza sativa
tgacttacgatggtatacatttggcggtagcaccagccaaaatcttgtcgttgaaaagacgagacaagtgctccatttataaccatcgttttactagagcagtcatcctgatattcagctggcgtcgaccgtaagtttatgcgggaaggataaacgatgtcgtcaataactaaaccgggaaattagaatgggaagatgacaagcagacaaaactg

SEQ ID NO: 46309 - DNA, 715 bp, Oryza sativa
gctgtcaccatcctgaacatgcctgtgcaccacttctggaccttgtactgtcatccatttctctgtctcgaggttgaatgaagctatgctgcctggttcaacagggagcaccactatttcaaaataagtcgtgtaaaattccatcatgaaatacaccaccccatcgacgaccacgcatctcatctgtttactgcaacagatggttgctgggggcccctgcattttccgccacatgtcttggttgttgccatcaacggcaattacctcacacagctgcctttggtaaaatctgatgatgcggagcgccttgtacactccagtggaagagatttccccaaaagcatgagactcgactttgccatggtacatcatcatccctctcccagcagcaatttcatctgagtggttcttgggcaatgcgacggtaaccccggtggctgggttaagcacccagaggcacagagggtgtaacattctagtaaatcacaccatgtcgagatgggtgcgcaagcgcacgacagcatcatctcttatctggaatcgcaacaacctcgccggacttgtccctgacagcggctcgacggtcggtgacggccgattgaaaaagttgaattttttacattaatacccttgccgcccactgccagggcggcaaggggcctccacgcaaaaaaccagcccgagaagggctattatcaacagagctggaaagaag

SEQ ID NO: 46310 - DNA, 1501 bp, Oryza sativa
catgaaaaaaataacatatgtaatttggatttcctatcgtaacgcacgagcatctttactattcttaaaagaaagagaaaagagagagatgaaaggaaaatgttcacttgaggtctcttatcttgtcgttgagtttcaaaactgtccatgaactaaaataccagatataacagatccctaatcttgcaaaaccaggtcacattacgtctcaaggcactattgctccctggttttagtgatgcggtggctgagtcagcgtggggccatatgggtcccacatatcaaccgataatcttctcccacgtatctcccctttcttcccgtctcaacccaaacttccagggcagccgacaagaggtggggagaagagtggcgactgacggctgcatcatggacctacatggtgaagagcgcaaagaagcgaagtaggaagggctcctgacacgtcgtccccttgggttacactgtcacatcgttgcatggcagctcgctgcgcatctgcgccgcgtccgtatcgtggtcatatgtcagccacaccgttgagattggcgagaggatctccaagagttgggagatggagtatcgttgcgacgcctgagcatagtcgcgagcatcactgactccatgagtgttcgtgcatgcacacgaagaggaagccggacactgaatcgcgggagaggtgtgtggtggccgatgaccagcagggagaagggtggcggtcgttgggcggcggcggtaggtagaagcctgacgatgggtgggagaaggctggcagccaacaagaagcttggcagcggcggggagaagggcgcatgcgtcggggacgatgcgaccgcaatgtggtgtagatgaagttgacctcgaagacgatgtggcggaaccgcgtgtgtgcctctgcagacgagaggcggagctcggggacacctaaacacatcagcttttgagcagctcgacggggggcgactatgagctagggggataggagcttggccagtgtgatgaggcagaagcctcagcccttgtgcgtgcaggtgaagacgacattgcagttgtagttgagacccgcgcgcgcaaatccatgatgtgagcgctcccggccattgggagccacgtcagcggcggcctccgccgtcgagcttttccccaccgaccgacacccttctcccaacccattggcagatgccctgaaggtttgggttgagatgggagtagaggggagtgaggtggaagaagattgccggttgacttgtggagtccacgtgggacttagccgccacatcaataaaaccggaaaacaatactaccttgggatcaaaagtgatccggttttacaagattagaggagggtttaggaccgtttaaaactcgacgacaagataagggaccttatatgaacttttttgggagatgaaaaaattccagccccaggggcctgtgcatatgacccataggcaggcgacaccgcggcggcagagcgctgcacgacctccgcctccccaat

SEQ ID NO: 46311 - DNA, 1501 bp, Oryza sativa
ctcccggccattgggagccacgtcagcggcggcctccgccgtcgagcttttccccaccgaccgacacccttctcccaacccattggcagatgccctgaaggtttgggttgagatgggagtagaggggagtgaggtggaagaagattgccggttgacttgtggagtccacgtgggacttagccgccacatcaataaaaccggaaaacaatactaccttgggatcaaaagtgatccggttttacaagattagaggagggtttaggaccgtttaaaactcgacgacaagataagggaccttatatgaacttttttgggagatgaaaaaattccagccccaggggcctgtgcatatgacccataggcaggcgacaccgcggcggcagagcgctgcacgacctccgcctccccaatccgccccgtctccttgcccgccgccccccgactcccgtctcctcgcattcgctcaccggtgagcatcctaatccatcccatccggcctcggcctcgaatttcgtctcctcgcccgccgcttgcgccgatccccatcctgcgagcaaggtggcgcccggcgtcctcctgcttccaccgcatcgtctatcgccggtgaccatccctccctccctatccacacctcatcaggtattctgcgttatccctcaaaaaagtttgggggttcaaccgaaaaccgacccctcaaccgaaacagggttagatctgcctctgcccagttgcacctactttcaacttgttaattttgatttttgtttttagcacatgtaatttggttactgaatctcatccaaacacccttagaatagttgcattagaacggaaaatgtaagctcacataatttgtactcatcctaactcacataaatttcttaagaagaatctataccacaaactactcatagtcactcaaaaaatctttttattaaggtatatattcttataagaagttttcattccataaaattttctaaaggacatactgtgacacttggcattaatctaagggtgtgtttagatccaaactttgaatccaaagtttgcaaaattccatcacatcaacatgtcatacacacacaacttttcagtcacatcatctctaatttcaactaaaatccaaactttggatggaactaaacgcagcctaatttaacatttttttctttattaggttataaattttctaaaaaacatattgtgccacttggcattaatctaatttaacattctttatcaggttataaattgaaaccatcgaacgtactttgtcttcccgtttctaaaacattgcgatatatctataatattttaatttcaaaaataatttagactaacagtatagatatttaaattaggtaattaataaattcaaataaactatagtttagaataaaaaacaaaataatatatgccaagtacaatctaataacaatagaatgttagagacaatgtgaattcaatatttttataaagtttattttgggacggaggt

SEQ ID NO: 46312 - DNA, 1501 bp, Oryza sativa
ccagtatttggtcgaggaggtcaaaatggacgccaccgcctgacactgctcagggtaatcatgcccgattagttcacttggcccttgaaaacacaggtcttggatgcttgcttggctcgacgagcttttatttgttcaactgtgtgcgcgcgcttgttgctaggttatacacccctggagctgcctgcctgcatcagatacctccttgatcatggcgcttatctgcatcaagttcgctcaaatggaaatgtcactcatcttcacaccgctgcagtgaaaggtatgaacagcgtgcttagcctctggtatacccttaggattatctttttccaattacagttactacttgtctgccaacccatcctgctagacgcatgactgtaagaaacatctagtctagcggcctttgccattgccttgatttattcttctgtgatggatccacatatgaaatcatgctggagatcattatatggaaactagggagaactgtaaataataaaaagtgtgttattctaatagctattcgagcctaatttagaatactataatatggtgattaacttgcgatccctaaatcaaaatgctcattggtgcttctattttcctttttaaccataaattacaataggctctggtctaatctaatatgctctcatattgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggggattatttatatagagcaagggtgagtacgggagtactcggcaagccatgggaagtaagtgtttaatgcaggcttcaaggaaaggctggtgtttttgcaattaattttatttgaactcttttctgaagcaactaagtgagtgcttctcaaacgacacggatgagacagtgcgtctcgtccggtcggagtatgtgcaatgtatcagtctttagaatttaaacaaggttggcacccgatcaacagctttttcaacggccacccgggccaacaacttttcaaacggccacccgggccaacaacttttcaaacggccctagctgatcccatcagctacagatttttcaaacaccgaaccccttttcacacagcaatttcacaagcagtagtcaaaccaaactatgctaggaatcacctcacatccgcccatgaccgtgggcacggctgttcgaacagtttgttaacctctgcagagggggtacactttacccaca

SEQ ID NO: 46313 - DNA, 580 bp, Oryza sativa
atttttcctaacgtaggggtctcatttttgcagacggacataccccttagaaccaaacgaccgcctaaaaaatatatatcgggatgaatgtgccggtccgcctgcgaaaatagattttcgcaggcggaccggcacattcatcccgatatatattttttaggcggtcgtttggttctaaggggtatgtccgtctgcaaaaatgagacccctacgttaggaaaaatgctttttctagccgtgtatgtcaacctaataggagtatgtgacaaattaagcccggtctttgccacgcgagataaaaacaacggtgctaacctcatataacagtgttgttttatcacgctagtctgacgttgcgtcggtccaaatacagaggcgatcgatgatgatgcagtggatcacaatttatgtatgtacgggccagctgacgaggacattgtcacgtggccgcaccattaaaggcgtaccaagctatagtgaaaccactgtcactaatttgtcagccaacctgctaagagcatctccaacagtctacttatctcactctccaagctaaattttagtaattttaggccaaaaa

SEQ ID NO: 46314 - DNA, 630 bp, Oryza sativa
ccccccgggggcaatgaagtgcagataccataatgtgcgaatcaatcgatgatcaataatcaatggtggtgccattttgcattttgtagggctaactgccgaaaataggttcacgaaggggtctagttggtagtttttcaagaacttgtatacatagaacactgtaatcccaattcgtgtattaagatgttcttcctgggacgctgtaaagtttattggcaactgccagttgaaagctagtattagcaatctggcagcccgagaattttgtaaaagttggcacccaacaaagctcgagaatgtaagatactttggtgttggtattccaaaacatttgtagtttgtgtatttgatacgtggaaatttgatgctcatttttctaagataggaatttcgaaagacgcaccaaaaaaagggcgttgcagagtttgataaatctacgataattgataatttctcaggtaaaagctactccaaattaagcaggcgaggcatggaagcgcctctcgaggggagagggattacagttatctattgtgggtagagggattacagttatctattgtgttggggaaaaatatagctctattgtgggttactattaagatattatatgaaagtcgaatttct

SEQ ID NO: 46315 - DNA, 1501 bp, Oryza sativa
ggagatagtgctcacttaatcactcacttacgccaccctcgacgttaattactagctctctagcttgtcgccggatgacaaccaaatgcttaattaattaattagtaattaactagacaaggattagtgattgtttaagcgcaagatttgtcctgcgattattggctcgaggtctttaagctagcgcctgctgcatgctgattggattggattaggtagtaggagtatagattaaatctggggccagcagcatccagagatcgagttgatcatgcgtatattttacatgaccatgactactctgctcatggttagtgcagtactttgattaattagcttattatattcgtctccaccaattaatttaagggattcgtcatgatacgctgacgtgaccgattgatcgaatatgcatgtactccatgtatttgcagatgtcagtgtgtatttctttttacatatgtatatgtggacttataatttaattaattcatctcctttaattagtcggatcgatctgttcacgcattcattcgacgagatcttcccctgcttgtttttttctagtttattatataattcaaggcatcttgattttattggttaatgctagctagctgtatcgccaattaatcagttcttgaaaaaactgcatgaataaccaaagggatatggcacaagtagcttagctcatggttctcccaagcaaaaaatgttgggtgtgtttggctgcgtgttgcagtgctgtttggcagcccgctgctacttgcctactgcagctaatgaattactatactctgtcccataaaaacgtattctctccgtttcaaaatgtctgacgccgttgactttttagcacatatttgaccgttcgttttattcaaaaaaattaagtaattattaattttttttatcatttgattcattgttaaatatattttgatgtaggcatataattttacatatttcacaaaagtttttaaataagacgaacggttaaacatgtgctaaaaagtcaacggtgtcaaacatttcgaaacagagggagtaaactatatctactaatctgaacacgtatgtgtctaaatttatagttaggattagacttttttttttttaagacagaggagtagctctaaactatagcgcagcgctgtaacatgttgccgaacagttccattagtacatagtatgttactgtgagaactgaaaaagtaaccataaaagcctacaaattgccacatagtcgcaggacaaaagctgatatggacgtgagcggcctatatgctatacgcgtggcgcagctacatgcattagctagcaagatgattcacgtgcgccattgcatacatatatgattatttttagagatgtgcttctatgctaaaaaaaaaaaaaggttaattggatccgtgccaccgtaaatgtggcaaataaaaaaatgccacacatatttacgttattggctggatgccactgcaaatttttaaaataagaacca

SEQ ID NO: 46316 - DNA, 1501 bp, Oryza sativa
ttttacatactatttaaatttaaattatcataaaccacattattttacttaatatgatgttatctagctatttttatcataaaccataattttttattttccaacggagaaacggtttgggttggttttgttccatgggttgcacggtttgagcccaaaccgtgaacaggcccggccaggtgatcagtgatctaacgtgtgccccggaaactacgtaatggacacaagatacacctccataaacgcacggcattaacgcacgtcagtttccttttcacccctcccataaacagttgctaaaaaaagaacgtttgaagatttcagaaccggaaaaggcgcgcccctcgatctaccaacggaagcccagtcaggccaccccccgttttcggcccgcccgattcttgcgccaccacgagacgagacccagttttccgccacaaccgcgttgaatccgtggtagattaacggatccaccgtatcacgagttcatagagagagatcgatcgatcgatcgatcagaactctgatgatctgacaaactccgagtcctatactcccaatctctgatacacacagatacttcccatgaagagattccccccatcccccagcgtggccgcgcgcggcatgcacgaccggcgggcgcacctacgctacaaagacgccgcgcgctacgtgaccgcgcggcagaggatggtttgggttcttctcgcggtggctcgcgcggttgggcgcggatgccggccgtgatggaggagccgatcgatcgatctgtataggaggcagcgggcggcggcggcagaaggggaggagaggatacgcatcacgcgtgggtgggtgggtgggttgagatgggagggacggacggggcgcgagtgcgagcgggtcgcggagaggcgaccgctataagtatcatcaggccccttgcccccgcgcacgcgcacgcgcacgggcaaccccccctgttgttttctctcaagccctacgaagcggaggcggagcccctcggcgcgatcgagtcgacgccgcgcgccgtccccgcattgccccaggtaagcccgatcgatatatcgttgctccgccgtgcgtcgtcgaatcgaaacatctctttttttcgatgaatacattgatctgggtttctcttctcgacgaaactcgccgaaaagattgatcttgttttcggagaaggaatcgttctcggttgtttgaactgtatatatatatatcttttgttattctttactagggaaagattgtgccccccacggccccgtgatcttacgaaagattgaaactttattagggattgtgagttgttgttgaagagatggcgagctacgacgacggaaccaatgtaagtcgtaagatttctcctgcgcatcaatacgaagaattagcagtttactgcattgcagcattgctaattgctaacatataacattgatcgtaaatggctttttccagctcgtggacgatgaatacgatgacctggatgatttca

SEQ ID NO: 46317 - DNA, 1501 bp, Oryza sativa
tgcgtatacgatttcttggatcctttagtattgttccacctgtccctttctccatcagtgcattgttactcatgaatccatttttgaatatgaaaagtagtatctttttttggcgccaataggcaggcaacagttacattgaacatataagttggttgataacgatgtgaagctaactttgggatgatttgttacaggcttagggagctccatacgctcaaggggcatgtagaatcggttgtgaagctcaaaggcctcgacattgagaccatccagcagtcttacaccgtgtgatccagcctgtccataaagaaagaaaaaagaggattattttttttccagattttcctgtttcgctttaacttgactgcaattctgcaatcacctacgtgtacttgaaccgaattgctgtaatctttgtccctcctgctccagctttctactacatggtagtgttatataatttttggtcacctgaaaatatataagtgtttgaggtgaagcacaatggcaatgccagagtttttttgctcggttactgagaagcatgttttcataatcaatcggtcaattgtatggacatattatagatgaatttggtaactgtttgtgtgggggcagctggcagtatgtaacatgtgggcttcaatgtatccaaccaagaggcaatgaatgaatgaatgaatagcggtgactctggtcctggactggaaacggatctgtttgttgttgggttccagccagatctgtagtgaggctctggctggctgatattgttgtctgccatgttgcctgtcaagtttgcaaaaactgtgggcacatcacatgagatgagttgagagcttttattttctaagctgcttgctgcgttgcatgcaggatctcgaatgatgcacgcttgcttgagctgtgcctgtaccaaatgtatgtagtactagattgtgtatgtactatgtattctccagctgccgtactgtgcacggataattggtttgtctcgtctggtctggtaaatagagaagtccaagtgttcaattcacagaatcttgttttgtagcaaaagtaatcaaatgtcatgagatttttcctttttcttgaataacaaatgtccgtcctagggacaatgtcacatcagtttggtatatgtagaagtgtagtaagaatcaatagattacagcacattcagaaacggtgatcccaacttaaaagaaggccacggcccacggcccacgacccactgaaatggcaaagcccaaagaggaccaaagaggcccaaataaagatgaggcccagaagcagaagcaaacaccatggttagctcagctggaggagagccaacaagcaaaaatgccgcagtggccgtcactccagctgcccgccgccgccgccgcccgccgcgccactcccttcgccttgtgcaggagctcgtcgtcctccgtttctgcgtcagcgtccaaccaggacctggtagcgtgttcttggcaaaaggaggatgaggccg

SEQ ID NO: 46318 - DNA, 891 bp, Oryza sativa
ttcaatgctatttgtacatggcatggcaagatatacaatgtactcatgctacttctccagtagtatacagtgctatgtccagtcttcctctttcacacacaaaagattcttaaatcatgcatacacacaaaaacatagtatcattttcacaagttacttgtcttctttttaatataaaagggtatcattttgtgcactatacaaaaagataaatagctttcttatcattttacaatttgtttgttgttggtgtaaaacacatataatcgtatatctacacaaaatcgtgtgtaaacatcattttacattctctacatgtacactagtcttctatgtcagtataagcaacgcggcaaagtgaaaagatgtgataaatgtatctgccaaatcttatagctgtataaattagatggacagtggacatgcccagagatgcaacttcacatatctgcctttagtttttgccttagactttaaacatgtggaaatagtctacacgatccatatgttactttcgattgaaatgaagcatataatccatttgcatatgtttatctgacattcataacctattatgacatatgcttatctgacattcataacctattatcagtaaggaatgtaaatcctagttgacatttgaagttttgaacacatgaactttacaaagttttcattcttctcacatgaaaaacctatgcaatacattgtcctaaatctcaccagtgttaatgttgtgaaatatattctagaccacaccttttttcatacaagctatgcattgcatctttctttggtacaattaatgaatgatgtttatcatacctctgtaatccgtttagttcaacaagtcatgagatgcgcctcatgttctgttctacatttttcaga

SEQ ID NO: 46319 - DNA, 1501 bp, Oryza sativa; identical to SEQ ID NO: 46302

SEQ ID NO: 46320 - DNA, 1501 bp, Oryza sativa
gtcggccagtatcaggatatacacatagattagtcaaaacggtgttagtaattttttggccggaaactgtatatggatgtgtatgtgtacaacgtcattttcagttaactttatttgaccaaaggaaaagaaggcttaattggtacttcctccgtttcacaatgtaagtcattctaacatttcttatattcatattgatgttaataaatctagatagatgtatatgtctagattcgttaacatcaatatgaatgtgaaaaatgctaaaataatttacattgtgaaacagaggaagtactagcaaatggtggttagtttgagtatgagtgctactgatcaagtgtggagtcaagatgaccgcagctggtgaatagtacgtagggatggatgtattccggcggcaagtgtacattatttattaattactactcctattatcaatcatatatagtatactccagcaatgacagtcaaaacaagttgcagtactagtagtagacagagagagatattactacgtacagactagctagagagtaccgatggactgcagattattctgctttcagatttcaacgtcaatgcaaagcaatttactacagtagctatactgtatatactgtcaattaatcagctgattttgttttcccggccggtccttctctagctacgatttctttttttttaaaaaaaaatggacgctaccttaattaaattagcttgctcgtgaagctagatacatacttctactcattacaaaatctcagtttctgcacatgtgtttattagttactctagttactactcaaactggcttgctaattactccagtctttagccgcctgcggatatatcggtcctgccggctgctaactgggtagcttagctagtcgatatcatcaacttgctgcagcgagcgcggcaactgtacgtatatatacatacgagtgcttcttaataattaattaaattagtttgactttgctagcactgccactatatatggagtatacagtgcaactggatagtactctcctccgtttcaaaatgtttaacaccattaactttttgatatatgtttgatcgttcatctttttcaaaaaaatattgtgaaatatgtaaaactatatgtgtacacgaaagtatatttaacaataaatcaaatgatatgaaaagaataaataattacttaaattttttgaataagatgaatagtcaaacccgtactaaaaagtcaacggtgttaaatattttgaaacggatggagtagctattaagtttgtcgcatgcatatatatgcggcggccgaattaagtctgacgctagctgatccatccatcgacgcgactcgatggtcatcgatcgatccgatgagtcctctccttcctaacttaattatatactgctacagtacttcttcctctttatatttgccaattacaaacaaaatttgaggtgaagaattctacggaactcttgattgagtagtaatttatatcat

SEQ ID NO: 46321 - DNA, 212 bp, Oryza sativa
tccgactgcatcacctggaacaccgtgtacgtgcccagctgcgtcagcatcacgtagtacacgatcgacgacgaccacaccgggatcatccgcgcaagcaccttcacctcctccacctgctgcaccgtgcacagccgccacgggtcgccgccgccgcgctcatgccgtccaccaccgcgtcctccgccgtcaccaccgcggccttgtccagc

SEQ ID NO: 46322 - DNA, 1501 bp, Oryza sativa
atccgtgtggatttgaccataggcgtatctgattttcctttgaattgaatttctctatttttctatccaaaattccatgatccaaaggagtctgaaaaggtttcagggctctggttgcattttaaagaaattttcaggattttggtgttgttcatgtgtatttggaacacaggaagagataaaattaaaaacacaggaattttagctacaccgatcatttcacgggataaaacgtgggaaaagaaacacatccggtcaaaacctctttctttttttttttttgaaaagagagaatatattaatgactgaaattggggttacattctaggttgagtagttcagtgagttctgcaggagaacttaacaaccattcaccgcagattcctgaacttactactaatctaggtagcttatgcgctactccgtttgattctctctttatcttgtgcacctgcacctgttgtagacactccatccatcttagtgcctccctgatcgtcccagcccactccgatctcaactgagtattgtttgctagtattacaacatactccctctaaaataagttaatctaatattagatgtgatataacatatatataacactctctctgttttatattataacttgtttaatttttttaagttaaatttatttaagtttgaccaagtttttaaaaaatataataacatttccactacaaaataaatgttgtatcaaaatatattgaatattaaaatttaatgaaattaatttgatattgtagatgttactaatatcttctataaacttagtcaaacctaaataattttgactaaatataagctaaataacctacttcctccgtcccaaaatatagtaatttttaactatgaatctggacacgaatcccaaaatatagctaaaaattgttatattttaggacggagcagcataatatgaaacgtcggtaatcaacaactaaaaacatgatttaatagaagtagataggacagttctcacttatacattgtcgtgctattttttatagtcctaacatcacgtcaaccacgtcaaatgagtgatgtgcagggtttacagtaccaacggtagccggttgattaccacgaaaactattggctaagtaggatcgagagcataaaataggcagttttctgattaagtttaaataaattcaaattgaattttaattcgactatgagttttcacttctatcattgattttctttttgttgctatgaagttaccgtttcagcttttagccacgcgaatcatcgatattgctttgtcgtaggttttcatgaaaaccgagaattcttgtctcgacatcggtttggtgaacctttggtgatgagatcgttggctcaccatatttgcaagggggaaattgctgcatgccgcacggccaccgtgacatcatttgattaagagatccactttaatttggtgcggtacagtacatggtgcaatgagaggattggagtgggtgatgctcactca

SEQ ID NO: 46323 - DNA, 380 bp, Oryza sativa
ggggcggaggcgcaggggcaggtgaggtgggcgtggaggagagcggcggcctgagcctgggcgtgttggacggcggcgacgaaggcgcgggtggtggtggcgcgggccatgaggtcggcgtcggggtgggcgaagggcctgaggtcggaggcgcggcgaggggcgtggtcggggtcggggtcggcgaggtaggagacgaggccgtcggggaggaggtgggcgggccaccagggtcggcgcttggacttggcccagacgaggtccccggcggctagggtttggggggttagggtttccgccatggcgcggaggagcggagaggagatcagggatcgcgggtgggaaggaatgggagtagactccgtttgtttgtcgtggaa

SEQ ID NO: 46324 - DNA, 1501 bp, Oryza sativa
aacatactaataaagtgtgacttaactccaagtgtaacacacaatcaaacactgtataagaaattacgctacacctaagatttgacatggtaaaattcgactatcaaccaaacagcctgccgttcttctcgagctccatgccaactaacctagctctatgacgacctggtcattgattcatatcaccgtcctttaacccatttctgaaggatgtaaatatgtgatgtcgacgaggataaatagaatgaaccggcaaacaaaagtatgttgatatgcaatagaataggagttctaacagggcaagcaaaagagttcgtatctcgggcgttgctagtgaggtttgagccagacatatatgctaccctctttgtcacgcgtacatatgaggtgcacttggcttggaccgaatgccatgagctagctgttccgctgtcgtgtgaccaatgttaattaagtgtgtaaggcggaagaaacatgattgttgcccttcttgtaaaatgagaatttctattagcacgacccatgactattattagtgtttttacagtgctccaatcctcttgcccctcgaggtactaggagttgttaatgttagttgttcattgactaagactatatttggcaatagtatgcataactctacaaatagcaagccaattataagtaggaagggtatcctgtgcacacgggagtacagctgcactcgtgtacacgtgcgtccggatccgttcgatcgacatcctacggccaagtctcctagcgtggcaattttacgaatacacgcccgcctcctccacttctgttttgcagaacagcccatctggtaccgcctcttcagctgatctcgttaatcacggcgctgatatgctacgcctcttcagctcctcttgtggttccatgcgcggcgcgccgccggcaaaatatttcatcgaggcgaaggggatcgttgttttgctctcagatgtcttctgttcatccgaaccttgtgactacttcgaatcattctacaccatcaagagacgaatcattccactacttcgaacctgatgctacggtatttttagtttcttctcattcatatcgttcatatacaggctagttagggatagctggtgctggcgtgcggctgctccatattgcatacatcaagagacaagattagattgcactaattttcgttcagactagctacagatttccataacctggcaagtacactgtattgttgttactgcatattaaggtaggtaactccaacataattgttcactcaaggaaattaaaggtttaatctcagttgtttgctatctgtttttttttttgcagatggaggcaataaatagattggatgtgcgagataactcagatatttattcaaatgatgatataacttctccagtaatagaggatgacaacaccagtacaccaaaaaaaatatcaagaattccactcaatgtaagtacactggcaatttaaaaattatgactgaggtgctttaaaa

SEQ ID NO: 46325 - DNA, 1501 bp, Oryza sativa
  unsure (1)..(1501): unsure at all n locations
ggccgacaggccagtcgccgccgccgtcagcgcctgccgcgcctgagcccgcgcctgccgccctgtagccgcgccctttcaaaccggccccgccgtcatcgccgtcgtcacgacccgggcccaccaccaccgcgcatgcttccaagggttggaggcagagctcctcctcccactgtctcgtcgccctctctctccttccttcttttcccaaagtggcaagaggcaagtctcctttccctctttcctttcttctttttctcccccgccggcgtcatcctccctgtcgccgttttggccgctagccggagcgctagctcgctggcttgaccgcccaatgtcggttccgccctcccaaaccgacattgtcgcccctataaatccgagcccctttccccattccaaactcccttgttttcgccttccgtctccaccgcaccattgtcgctccgccctacttgcacctccgccattcgttgccaaagcaccgggagagccggcgcgtgcgaagnacgcgtgaaggggactccgcgcgctcgtcttcttcctcttccccggcccgaggccggagagatcactcccgtgccgtcggcctctcatcacagcgccccgcctcgtctcggtagggcatccctccgttctccctcctcgctccatctcttccccttagctttgagtagcagctcgagtagtaccccagtagctagttggcgccgccccaagccgcgccgccgctcgcagtaagctcgccgccatcgcacccgcgctcggtagtagccgcccgtcgccggccttcctcggcgatgacccgtccaatccgacgctaaaaacggattcccggagtcacgtagatgctctaactcgcccgaatcgatctcccgtcatgccgtcgccgtttcccccttctctcgccgccggttgccgccgccgcaacccgccgccgtcgagccccctccggcgaatccgagccgttggctcgtctccctttgtcccgtgcaacctcccggtgcgctcgcccatgcctgcatcgctgtagatcgccccgccgctcgccgccgccgtccgccatccgttccggccgacgtcgtcgtcttcctctcaccagcccacgtggctgccacgaaggcggcacgtcggtgccacctcggccgcgaccgggtcaagcagacctcggtccgccgctcccctccgccccgctcgcgcacgcggtccaccgcgagccgtgaggctgcgcgtgggcccgccgcatccgcacccaccgcgagccgcgcgcgtgcatcgcgccccgctccaaaccctagcgccgcgtcgcgtgctcctcgctcacggtgagccgagccgccgacaagcaggtcccactcgggatcacgcgaggtgagcccggtccaccgactccctctctcctcccctcccgcgtgcctttgggccgccttctcgggccggccggcccattagctcggccgagtcgcgcctcttctctcgggccgcgccctagccgcccgag

SEQ ID NO: 46326 - DNA, 1501 bp, Oryza sativa
tccacatctagtttctttcaatttaatcttttttttcttcgatggatcaacaatctccttatcattcacatgtttccatccttgccttgagcacacaaagtgcttgcactgaaccacgccatccaacttcttttgctgcccaatacgcactgagaacccaacttggtgtgcatatgacttgtaaaatttttcaacagaggcaatatcttcaaatgtcatccctaccgcaggccttatcttatcatcacactctggtgtaaaaacggagcactgcaaaatcacatatacattgcaataagcattttaaagcacctcagtcataatttttaaattgccagtgtacttacattgagtggaattcttgatattttttttggtgtactggtgttgtcatcctctattactggagaagttatatcatcatttgaataaatatctgagttatctcgcacatccaatctatttattgcctccatctgcaaaaaaaaaaacagatagcaaacaactgagattaaacctttaatttccttgagtgaacaattatgttggagttacctaccttaatatgcagtaacaacaatacagtgtacttgccaggttatggaaatctgtagctagtctgaacgaaaattagtgcaatctaatcttgtctcttgatgtatgcaatatggagcagccgcacgccagcaccagctatccctaactagcctgtatatgaacgatatgaatgagaagaaactaaaaataccgtagcatcaggttcgaagtagtggaatgattcgtctcttgatggtgtagaatgattcgaagtagtcacaaggttcggatgaacagaagacatctgagagcaaaacaacgatccccttcgcctcgatgaaatattttgccggcggcgcgccgcgcatggaaccacaagaggagctgaagaggcgtagcatatcagcgccgtgattaacgagatcagctgaagaggcggtaccagatgggctgttctgcaaaacagaagtggaggaggcgggcgtgtattcgtaaaattgccacgctaggagacttggccgtaggatgtcgatcgaacggatccggacgcacgtgtacacgagtgcagctgtactcccgtgtgcacaggatacccttcctacttataattggcttgctatttgtagagttatgcatactattgccaaatatagtcttagtcaatgaacaactaacattaacaactcctagtacctcgaggggcaagaggattggagcactgtaaaaacactaataatagtcatgggtcgtgctaatagaaattctcattttacaagaagggcaacaatcatgtttcttccgccttacacacttaattaacattggtcacacgacagcggaacagctagctcatggcattcggtccaagccaagtgcacctcatatgtacgcgtgacaaagagggtagcatatatgtctggctcaaacctcactagcaacgcccgagatacgaactcttttgctt

SEQ ID NO: 46327 - DNA, 1501 bp, Oryza sativa; identical to SEQ ID NO: 46307

SEQ ID NO: 46328 - DNA, 1501 bp, Oryza sativa
tttatatttacaaacaaaacgtataatgacatgacaattataataaactttacaggcaagactcttaatatatctgcataaaaaataacttattttcctaggtgggcttcattcttctttattcaagatagtccatgtatcacaaacccacacaaacctcgaaaaaatgttaagtcatattggaggacatgtggcttcttcatgggcaatggggaatggggaccttggttcccaggtcatcaactttaaattttctgaaaatatcaagtgttcttctgttgtaatcaaataagtatatatcttctgttcttttaagtatatatatattaagttgataaatggctatagcgattgagatgtatctttccattttatcgactaacttttatagcacgcatgatataaattactactcaatcaagagttccgtagaattcttcacctcaaattttgtttgtaattggcaaatataaagaggaagaagtactgtagcagtatataattaagttaggaaggagaggactcatcggatcgatcgatgaccatcgagtcgcgtcgatggatggatcagctagcgtcagacttaattcggccgccgcatatatatgcatgcgacaaacttaatagctactccatccgtttcaaaatatttaacaccgttgactttttagtacgggtttgactattcatcttattcaaaaaatttaagtaattatttattcttttcatatcatttgatttattgttaaatatactttcgtgtacacatatagttttacatatttcacaatatttttttgaaaaagatgaacgatcaaacatatatcaaaaagttaatggtgttaaacattttgaaacggaggagagtactatccagttgcactgtatactccatatatagtggcagtgctagcaaagtcaaactaatttaattaattattaagaagcactcgtatgtatatatacgtacagttgccgcgctcgctgcagcaagttgatgatatcgactagctaagctacccagttagcagccggcaggaccgatatatccgcaggcggctaaagactggagtaattagcaagccagtttgagtagtaactagagtaactaataaacacatgtgcagaaactgagattttgtaatgagtagaagtatgtatctagcttcacgagcaagctaatttaattaaggtagcgtccatttttttttaaaaaaaaagaaatcgtagctagagaaggaccggccgggaaaacaaaatcagctgattaattgacagtatatacagtatagctactgtagtaaattgctttgcattgacgttgaaatctgaaagcagaataatctgcagtccatcggtactctctagctagtctgtacgtagtaatatctctctctgtctactactagtactgcaacttgttttgactgtcattgctggagtatactatatatgattgataataggagtagtaattaataaataatgtacacttgccgcc

SEQ ID NO: 46329 - DNA, 484 bp, Oryza sativa
ctgcagccctaaaatagtctcttctttcttctatcataaaaccatacaatttcaatcgtttttttcttcaaaattcatatgtatcaattatataaaatatgttcaccttgcattatatttgcaatcatgtgtaaattatataaaacataggaagtcattttattttcttttacaaaatataatatagcttatttgtacatactatacaacttaatttcccgcagcaacacggcggggtaatcatctattatttggagaaatttgggtcttaataaagaaatccttggtggaataattaatcctgacatattggtccattgagccacctgataaaaaacaaagtttattactcaagttcatttacatatgtttggtttgtgggtggggtgggttggatcaaattcatcactgtttttagggtggggtgataccgtctatccgtaaggcacgagagagttgatgatcctatgttttatattgcagc

SEQ ID NO: 46330 - DNA, 239 bp, Oryza sativa
tatttttggttgaagtttttggcgagggttagttttcaaaataagttttttaaaaggaccaaattgtcaaaaaaaaaaaacggtaacaacctcaggtccacggcatatgatccatatccatgttccagctcttggtcagcacatacactgtttaaacgcttgcacaatcacggccaaatccataacaacaaacgctagcactacgcttgagctcgcactggtagttcacagcatggagt

SEQ ID NO: 46331 - DNA, 1168 bp, Oryza sativa
attcctgcagcccctacttattatgtaccacgtccacaatcaactctgctagcgtggcaaattttagcgtcgtactggcgctgagacgttggaccatagcaccaacgggattgacgctaagtccacggtctatttttagttgaagtttttgacgagggttagttttgaaataagttttcttaaagtaccaaattgtcaaaaaacggtggttgttaagagtgattatacgtatgaaaggtaaagttggtcgtagcatcacaaattagaataaaaaattgatactctctccattcctaaatatttgacaccgttgattttttagcacatgttcgaccgttcgtcttatttaaaaactatatatgtataaatataagtatatttaacaatgaattaaatgatagaaaaagaattaataattacttaaaatttttgaataaaacgagcagtctatttaaaaaaatcaacagcatcaaatatttagaaacggagagagtatttagctttggatatcacaaaaccgaattcaaaattgcgttaactttgggataactttccaaatgcaaacttaagtttagaattgtgggctttaccctagttagggagcccttccagaaattctctgaggcccggatgggccgcaaagggggtttggaaatagttttcaaccagcaattgacgcgcctcggtataacctcactagctgcgtcattgccccaagcgcaaagatgagttctaacgatcgctcacctcctcgttttatagcgccttccgcatctataattccccaacataatcggtatggtactaaacaagccaacaagaagtcaacaaccgaccttcgtaatcccaagagtattcctccccgttctttcgcggcccacggtctatataatcatgggcttttaattcggcccagttaggcaaatttgcctcccgtattatttttccttttttttttcttgatgaaatgaaatgtccccatttctaaactgcagcactgtgacccgattcgattcctttgttctccccttcactttgccccgatccgcacccaaaccctagccatctaaaacccccgcggctccgatggccgccgcctcgccaccggcctccccgcctcaccccaagcgccgcaagatgtcctcctcctccgaccccgaccaggagc

SEQ ID NO: 46332 - DNA, 596 bp, Oryza sativa
attcctgcagcccctacttattatgtaccacgtccacaatcaactctgctagcgtggcaaattttagcgtcgtactggcgctgagacgttggaccatagcaccaacgggattgacgctaagtccacggtctatttttagttgaagtttttgacgagggttagttttgaaataagttttcttaaagtaccaaattgtcaaaaaacggtggttgttaagagtgattatacgtatgaaaggtaaagttggtcgtagcatcacaaattagaataaaaaattgatactctctccattcctaaatatttgacaccgttgattttttagcacatgttcgaccgttcgtcttatttaaaaactatatatgtataaatataagtatatttaacaatgaattaaatgatagaaaaagaattaataattacttaaaatttttgaataaaacgagcagtctatttaaaaaaatcaacagcatcaaatatttagaaacggagagagtatttagctttggatatcacaaaaccgaattcaaaattgcgttaactttgggataactttccaaatgcaaacttaagtttagaattgtgggctttaccctagt

SEQ ID NO: 46333 - DNA, 1501 bp, Oryza sativa
acatgatgccgtcctggctaggctagggtttcgtttgttgctgctgcggctgggttgtgtttgggttggggaaaggaggagagaagggaagaatggtccaagaattgaagaagaagaagaagaagaagaagaagcgcttctctgctgcaactctgcaagtgcagagagagcagagaaagagagagagagagagaggcgaggaggcgggaagtgatcgatcgagtggggtcccactcccagacgcagaggcagaggaagtggagcaatggcgggtcgacatggcagcccccaatccccggcttttttctgctccgattctccccatctttttccatgtctttgccttcttctcctctcctatcctcttcttggcttcttgcttgttcatcctgcacaccacactagcagtggagtaaaactgtaaaaagtatttcagatctttgatttttgcttggtggtgagagataaataaaagacaagtcgtctgcaaccctgcatcaataacctccatacagataaacaaactgggccttgagtagttcccaatttttttttctaaaaaagtcgcatcgaatctttaaacacatacatgcagcattaaatatagattaaaaaatttaattacacagtttacatggaaatcgcgagaggaatcttttgagtctaattagtttatgattagtcataagtgctacaataacccatatgtactaatgacggattatttaggcttaataaattcctcgcagtttccaggcgagatatgaaattagttttttcattcgtgtccaaaaaccacttccgacatccgatcaaacatccgatgtggcactcaaaaattttcttttctcaaactaaacacaccttgggcctcctaacagcagaattactactagtactccagtatgtaaatcattctaaggccgacttcttttgtagattatttttaccgattaactgtacctaaaacgagaaacatgattattaactaaatattaattattgaaatttttaaaaatagattttatttgattttttaaagtattattgtcacggcatgcactacttcaggaccatctcaggaaggcgaagagcaaggcaggagacaagattcaaagcaacccttgttgcggcgatcgacacgtgaaaagcggcccaacagcttgtaccaaccgagtgtgtggacccagtagaattgggctgggccacagtgagggagagaggtccatagctcatcgctataagagaccggcagggaagagaacgaatcaaacattgtagaaacaaatattcggaaatcaattcaaatctctccctgttctattgctgcctctacctgttcttagctgttcttccccaaactctcaattctctccctaaatcctcaatttcttcccttgttgtggcacaaattcttcagagacgtaacaatttggtatcagagcaatcatcctggagaagccacgctatacatctaggttgcaattgcaagtggaggcga

SEQ ID NO: 46334 - DNA, 1501 bp, Oryza sativa
atctcaaccaagatgctgctcgtcctaggaagtaaatggttgctatcctcacccataaccccgggaaagtattgttaacatcaaaatagtgctcacacttcatcctccactcctgagagtctgaaccatcaaattttgggaagtctaacttaggcacccgatgattgtactgtctatcaccatgctcagaatcaaattccccagactcccaacctcccccatcaaatttagaagtaaaattcggggtgaaatcaatcgtacccttgcccggggctggaccctgagtcgaactgaccaccggtgtccttccccggaaattcatctgaacgtggtggcctgcagcccatttgcttcctccttcggctgcggcgagttgggtggaagtcggcggcgtcggaagccgcgccgccttcgcctccgatggagtcggcagcagcggcgccttcctttcctcacccgtcgatgggactcaaggggaagacgcagccggtgcagattgctgagatttgccgacgaggtcgagttactgacgaagttcgctgacttcctcgcgcaacccctgaattgctgattccacttgaggtctccatccactcactcccgcatccaacttcaccacggctgcttgcgtctccgcctgcttggtgttgagcgatgcgagggattcctggatgtcgccgaggattttgccgaagtccagattctgcttttccatcgcctccacttgcaattgcaacctagatgtatagcgtggcttctccaggatgattgctctgataccaaattgttacgtctctgaagaatttgtgccacaacaagggaagaaattgaggatttagggagagaattgagagtttggggaagaacagctaagaacaggtagaggcagcaatagaacagggagagatttgaattgatttccgaatatttgtttctacaatgtttgattcgttctcttccctgccggtctcttatagcgatgagctatggacctctctccctcactgtggcccagcccaattctactgggtccacacactcggttggtacaagctgttgggccgcttttcacgtgtcgatcgccgcaacaagggttgctttgaatcttgtctcctgccttgctcttcgccttcctgagatggtcctgaagtagtgcatgccgtgacaataatactttaaaaaatcaaataaaatctatttttaaaaatttcaataattaatatttagttaataatcatgtttctcgttttaggtacagttaatcggtaaaaataatctacaaaagaagtcggccttagaatgatttacatactggagtactagtagtaattctgctgttaggaggcccaaggtgtgtttagtttgagaaaagaaaatttttgagtgccacatcggatgtttgatcggatgtcggaagtggtttttggacacgaatgaaaaaactaatttcatatctcgcctggaaactgcgaggaatttattaagcctaaataatccgtca

SEQ ID NO: 46335 - DNA, 1501 bp, Oryza sativa
accactaagtatatctactcagcttccagagattgctggcaactttgacaagcaccaccaaaaacctgaagcatacaaattcaagagtcccatatatacaagtgcaattgaagattatgtattgtttttaattgattgcaaacacacagtcctccacattacaacttataattcatgctttattggatagcaattttactgttctcgtcaataagaaaattactgttcctatcagtcaattcttctcaccacttcatcacttgtacaacatgccttgtcagcatccacaaaaacactgcattaatttgggcatgcaattagctcctgtattcatatataatagattaatagtaaccttgtttagaggtcagtcagtcatcatcaagattaacaaactagccaacttttttccatatgtggcgaaccgtgttgcttatctatgtttaacagagaattagtggcctgatgtggttctggacctaactaactaatgtcaatagcaatcaattgaagcaagaaacacatgagtgtgtatgtgaaaaaatggggatttttttggcatgtcaaaatctccttttccacctccccacaatggtgagtttttttatctaatcacaaatgctcccttttgagtgagcatctatgtgtgttcatccaccttaccatgacaccatggcacacataacatacctgcttatccactatggattcctccaaatggacccactgccacacaaaaaggattgttcctgttcatttttcaccaaaaaagtaagtggagaaactcatttttgaattttttaaatatatgtgaaattccttcaaatgtttgtacacatcaatataatgggaaatgtcatttactcattttattcggtgctatccaaatacctatattcctaccaaggaaagatggaagataaaagaacagagtggagcacacgtgtgccttcatacatatgcttgtgttgttcaagtgagatttttaataactgtgcagaatatgtgccaaacttctagaaatgatctaggtagcactaatgttaagagtggataaatcaaattacttcttttacatttttacacattccatgttgcaaaagaagaatgttgactatgtgactttgaatgaaattcccaaatctctctgaagtaaaattccccctcaaaagatttcttacatatctcccgaacatgcatgctttcaggctttactcctctacttttgtgaatataataaaactagatggagacccccatgattaatttatgagcaagtacacactaaacggaaaaagatgcagattggcgtatgcgaccattgttaatgagctacacatcatcattcaggccactaagcacagatatgcagtagctgcttagttgctactactactcctactttctgatgcaggtgtgtgatcactgatcactgactgtttgttagttactactgaattgttttttaggaagaaaagggcctcagatttgtcagctcctt

SEQ ID NO: 46336 - DNA, 1501 bp, Oryza sativa
attaaaaattatttcttaataaaataagtcgaccttctttctcgataacgtggacagataattactcgtagggatgaattaaatattttgttgcataaaacaaacaaatagcttataaaaattatcaaagcaatatcgttgaaaaacattcatagagaaatactacttttgaaatttgaagcgtagcatgtactatctggttaatatttcaatcttataagtttctttaacacatattacgatacatacccgcgcatacgcgcgggctaccttcctagttacttaaatttgtttgaataagacgaacggtcaaacatatttaaaaaagtaaacgtcgtcaagtatttagaaacggagggagtatgatttttgctcgaacatgtacgcaagttgtttcgaaatgttcccagcagttatttttttacttcttagtccgagatgaagtcaagaaagatacacaggtgctcttctagtcatttatcttcctaatagacacaagccaggtcaaataactgcgaatatgactttgaattgagccttctcgtgtattttgaatgatgctaaagggtatatgaattagtcaatggttgtcaaatctccaatcaagaagatatgtgcattgaaggaagcacaaagatgagtgccaaagttcagtgggtcacactttatgtacttagattccaatttaaagatcacttcagaatatctcattttcccttgctcattgtgacatgctaaagctcatttgagagctcaatcaagttcattagacgttaagaataaaagtggttctaaacttaacttttcactgcaaggacatagatctctgtactctactacttcaccgtaataaacattgtcctaaaaagtttatgacttgacttccactcaaattagcttagatctctaaagaaacacgtgaattctggctttgtgctacaaatttcatgagtattaatcttgggctaaaaaaaggtttgaatattactttatccaaaatttcgtgattttaaacctttggcctaaaaattcttgattttaggctttggctaaaaaacacccataaaggattagccttagtcataaaagagcgtgattattagacttttgctcaaaatttcatgattataaacatttggcctaaaaattcattacttttagacttcggcccaaaacataccggtatttatttagcgttggactaaaaaaaatcatgagtactgggcccaaacgagagtgaatattactctcctgtccgaaaatgaatctttatcttcggcccaaaaaaatcatgcatattaaccaagagttgaaaaatacatgtgtattgaccttgggtcttaaaaaggcatgaatatcagggtccgctaaaaaattcgtgattattaacctttcacctaaaaattcatgcattttagactttggtgctaaaaacatatgagtatataacgccctgtttggggagcttaaaattatgagaagcagctactgagaagctagc

SEQ ID NO: 46337 - DNA, 1501 bp, Oryza sativa
caatgagtaattatcacatccaccatgtgacaaaaccaataaattatacacatgcatgcaaccaataagtattaagatggtttcttgtgttccgtcaacaatttaatttagcacataaagatttttttaagagaaatttagcatgtaaaggttacaaataggtcttagacttttgaaataacaaaaaataaaatatatcttagacttttggatatgtaaaggttacaaataggtcttagacttttgaaataacaaaaaataaaatatatcttagacttttggatagagaatagtaaggaataaaaaaacactattttctcacctatgtgttgactctctcctttccatccatgccattgcacaccgttggatttttatatagtcatgggaccgccttattgcctcacacattatgaaagttccaacgacaaaaatctacatttgttagaccccaccttacttactgagtatactatactaatgcccttagacatattactttcattactaagattaagaaaaaattaactcatcttatatgtaacatagattaaaaaatacatgcatgcaaccaatgattattaagataacttatcgggttttgatcaaatatttttttatttatatcctagatacttgaatactacaaatataactaacatattaagaaaaactgaaatataaaataattctaacatttttgcagaggggtactccctctgtaaaaaaaaaataaaaaaaccaattctaggattgtgttttttttttttgaacagaggagtactctttagctgccccttcaaccttttcttcattaccgacataaattttcagttatagttgcacttccacaaactagaggtgcaataatgaagtagcattaccaaagtcaacaaaaactgtcctgcttgctgccttgctgccgctggtcctatccctaccagcttgaacaaattggtgccataccgtctgaagaaagagttgatcttttctttagttttggcataatctgtatgtcaatgttgataggagtaagagactggaacagataagtatcaaatccggatttccggaatagaacagaatcagattagtgaattatctgcatttttcagacagtagcaactggcaagacagcagagttcctcaatgctgaagaatatccatcataaaagatgagattttgggaattggggatttggataggatcatcagactttgggacaaaccatcgcagcaaaggtcaatatcatgctggcaatttgacgctgaaccaaaacttttgtcaaaattatctcaaaccgtgtactcaatcagtgaagtggacttgagtgagtcacatgcatcttcaacgattttcctctcctcctactgctacaagtctgcaattaatgcgatctcaccgaccgtacacactcctatctatccaacaagctaattaagcgaggagcttggtagacggcggcaatggcgggcgcggcggcggcggccttcgcggcgc

SEQ ID NO: 46338 - DNA, 239 bp, Oryza sativa
agggcccgaaggcagatccagcttcaccgtcacaccctccctgccatggccctccttgtcacgtgtggaactcatcgttggtgccttcccatctcgtccgaactgcgacagatggctattgtggccggcatcctccccatcccatgccacctcgtgatgtctaggctagtggtcggcaggagaggagcaaggcagcgatgacaatttctagagtagctcccggttgatcctaccccagc

SEQ ID NO: 46339 - DNA, 1501 bp, Oryza sativa
cttgctatattcaaaattctaagacatttcatttgtcaccaagaccaatgagtaattatcacatccaccatgtgacaaaaccaataaattatacacatgcatgcaaccaataagtattaagatggtttcttgtgttccgtcaacaatttaatttagcacataaagatttttttaagagaaatttagcatgtaaaggttacaaataggtcttagacttttgaaataacaaaaaataaaatatatcttagacttttggatatgtaaaggttacaaataggtcttagacttttgaaataacaaaaaataaaatatatcttagacttttggatagagaatagtaaggaataaaaaaacactattttctcacctatgtgttgactctctcctttccatccatgccattgcacaccgttggatttttatatagtcatgggaccgccttattgcctcacacattatgaaagttccaacgacaaaaatctacatttgttagaccccaccttacttactgagtatactatactaatgcccttagacatattactttcattactaagattaagaaaaaattaactcatcttatatgtaacatagattaaaaaatacatgcatgcaaccaatgattattaagataacttatcgggttttgatcaaatatttttttatttatatcctagatacttgaatactacaaatataactaacatattaagaaaaactgaaatataaaataattctaacatttttgcagaggggtactccctctgtaaaaaaaaaataaaaaaaccaattctaggattgtgttttttttttttgaacagaggagtactctttagctgccccttcaaccttttcttcattaccgacataaattttcagttatagttgcacttccacaaactagaggtgcaataatgaagtagcattaccaaagtcaacaaaaactgtcctgcttgctgccttgctgccgctggtcctatccctaccagcttgaacaaattggtgccataccgtctgaagaaagagttgatcttttctttagttttggcataatctgtatgtcaatgttgataggagtaagagactggaacagataagtatcaaatccggatttccggaatagaacagaatcagattagtgaattatctgcatttttcagacagtagcaactggcaagacagcagagttcctcaatgctgaagaatatccatcataaaagatgagattttgggaattggggatttggataggatcatcagactttgggacaaaccatcgcagcaaaggtcaatatcatgctggcaatttgacgctgaaccaaaacttttgtcaaaattatctcaaaccgtgtactcaatcagtgaagtggacttgagtgagtcacatgcatcttcaacgattttcctctcctcctactgctacaagtctgcaattaatgcgatctcaccgaccgtacacactcctatctatccaacaagctaattaagcgaggagcttggt

SEQ ID NO: 46340 - DNA, 287 bp, Oryza sativa
aatcttctctctcaatcatacaatcgaatataatacatccctgtcttcaaaaactggtgcaaactgattggattgggaagtactttttgctgaagtaacaaactaaccgtgattgacccattgagtcaacatggggcaggtgtctagcttggatttgccgctcttagaaaaatataaaaaccgtagcgtcggttgaggaggagctctagcaggtgctagtcatggtcatccatcagcaccttagcgccgaaagagaggcagtagatgatgagctaagggacccaagg

SEQ ID NO: 46341 - DNA, 549 bp, Oryza sativa
tctaatgaccatgctcattgtactaatgtttactgaaaaataatttatgaagcaccgtactgttcattagttaggtatagaccttgagctatgcggtgtgccccattacctggtggagtggaacctgatcatgaccaaaactgcaagtgcaaaagcaaaagaattgcctgcgaaaaagaaaagagaaaaaggagatttgactgctgttgtaccctcacagctttcagcatagaagtgtaaaaaagatacgactggtgtgccctttgatgccaccttcttaaatgtatgtttaatgttttcatctgaaacaaaagtgtccaaaccctacaatgctgcttcatgtcgatgaactccagtaccataccatctcttttgattggttctagaagcagcctgttctgctctgttggcaagttgtattcctcatgttatctgatatgtcatgcttgagtcttttactcgggcaatatgatctaggtgaacgtatgtaatccacacctgagttgttaagcttatcttttgctactaggtgaagagaacggtacatca

SEQ ID NO: 46342 - DNA, 953 bp, Oryza sativa
caacttccaaaattcctcaaatctcgagatctatctaatggcacgcttagaggtcattaatagggctttattttcgccgtttgttgagttgtcccgtttcgcgtgtagtttcggagcccgaagacccgtagcgcgaggatttcgaggatcaagctccagatctcgagcaaggcaagccacccgaacatcttgagcctatatttgaaatttaattatattgcttgcaaaatattatgcattgataggatcgcacttaatcttttatcccgtctgcaaggcagattggcggacctacctgacttgttgcatttgatccttccattgttaattgctatactatgtccccttgtaaccacccagttgcgcctcgatattcgtgcactctgtgcgagtatcgacggtcgccttcaaacttaaaaatctgagtaacaacttgggtaaaactggagttttacaaaagacttggaaaacccgacacctgggtcggtgcttgcgaactaaatgaatttccaaaaccacggatcggggaacgtaccgggtgtacggtttcccgctctcgcacttaaggaccgatttcttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtca

SEQ ID NO: 46343 - DNA, 1501 bp, Oryza sativa
agcttgtacggtacaaaagagtctttgcctgagacaagtccatggtagcacacacccttgaggctagttatggtagagacgagagatggggacatggggtacatgtacagtaataatattgcacagagagagagagagagagagagagagagagggcatgcatactccattttactcccacgagttaaaattgttggagtggtccacatgtcgatggcctttgctgtgttgacagcctggtaactggaaaaagggtagtacagtaagcaggcagagtaactgtagttcagattttgggacccacaatctgaattgtgaagcgaggcatgagacacgcgtgaaagaatgattggacggaccacatactaattgtcactagctagggtgtgttattcttcacttcttagtggagtactatgaaatactcataacttctatcgtcggtttattgtattaggagggatcacatccccttctagaatacattttctttaggcggagggtttagaactttaaattagaaagcaattcatacaggcatgatgagtattaattccacataaaaaaatcaagggacagaattgatactactactaacttctcgttcaataaaagaacaacttttagaagcgattgtaggacgagtttgtataagcatttgtttagatttgtctgttaataaagttgatttttttttcgctaaagcacgattaaaagagctataaggaatcaggccaaccatgcactgacctgaccttggtaaagcactcttgcagttgcccttgctgtcgtgccggaggcgtcgatagttggtcgccggcgtgatctaagcctaatagggttagagtcaaactgagttgtgatgtgtttgtgttggactggttcgtcatgggctggacgtatgtgcgctagctttggtgggcctgcagccgaccaaggcccggcccactatgtacgttgtgtttcaactgcctggtactactagtatagataggtgtacatttactgcaaccgcgagatcagcggagttcgtttctcaatgtcgatcatctaatctcatcgatggagataagaagatgaaattcagcccttccttcaccgaaaagaaagaaaccaatcatataatatactgtatcttcgtcgttaattaattcgttatctccatatctctctctctatatatatactcgcagccctatgctctgcccgcgcactgtaaacaaattactaatagattctccgacgatcgtagttgattgttcgtcaccgagatccgacaaacgccatccatgggtcgcggcggccgcggtggaggttagattcttcgatcgaccttaattttgttcttcgatcgatcagtcgtgcattatttggtagatccggccgaccgatcactgggtcaatatatcgctaataagtagtagcaacagcttaacttttgtgaattaaattattagtataattaagctagccagtaactaaattgaattaattaattggt

SEQ ID NO: 46344 - DNA, 322 bp, Oryza sativa
cctgcagcccggattaattgaatagcacggaacgaaagaattcacatctccggtggctaatttaaaaaaacacacggattgaatggtaatttttgaaggtccagcgtattaggtgagtgagtgaaatttctcgctgccggatactcaggtactcaggtcagccacccagccaggtattcaggtccaacctgcttccgtgacacaagtcgaaacctaacgcgacgcacggttcgccccgcgccgcagcgctgctcacgcgcatacgcattccccctctcctctcctttataaatcccccgcgcgccggcggccggccggtgac

SEQ ID NO: 46345 - DNA, 1501 bp, Oryza sativa
atcccctcgaggaattagaatagtttcccatttcctttgaatgaaaggggccttagctagtagtgagctactagtactagttgccatcgagaggtcatcttctccttatctttctcttcttcttctcctctcaattaagatacatgcatcatgtgaaagcctcatgataataccaggtcaagcagggcaacaactttatttctgttgattacaagttagtacaatgcgaactaaagaaaatttaggcattacttattcgagtcaaagcttgcccgtccacgacgccgatagccagtgagcttgacacgcgacctgccattgccactgccaaattttatggcattattcagaaaacttatactatatgctagttgattcagggaatgaaagtagctagactgctcctaattcagagttcagaaagttaagatgaatgggtggtcggttttcaaaaaaaaaaaaagatgaatgggtggtagcttattcagatttcacaaaagggaagagcaattgtggtattttaactcggatcaaccctctgaatgatgctgtcagttactggcactaacggttttacacagaaattaaacaaaagtagaatctataaaggtgaatctgctgtctagtgcagcacataaaacgatatgaggcaatcattttgggggcaaatctgtgaacaagtggttaccaaatcgaccaaaaggtggcagcatgcttctctgtggcatgcttttggctagatcaagttgtgaaattgcgatctcctagctagctttttcttcaaggccaccactgtgtttcaaagatgtagcgagtgatacatggatgggcaagtaacagtatgtgcattatactgaattctactagtaaaaaagtagagagctaagtttcctttgttgaagaggtctgaatgatatgatatctttaacatatcttaacggaacaaatataaattgtgttatgcttaatatcatctggaatatactggcatatgataagcagttcacattacatcatttaaaacgatatccacgggtgatgtttcgacaaagaagaactgcaagcctgcaatgccagcacacatgtcgcaatcttttgtgaattggtggtgtgttttgtcagtcaaagtaggcgcccatacaaatcagtagaaggcaaggcaaagcgatgtgagatttgtttgtccctcccttgcttggttggttgtacatgctgcgaatcgaagaataaatcagtagggatagaagagtacttgtgttcaaagtcaacttgcaagtccttaatctccaagattgatccgcatctccaactaaaccctctcctaatctaatcacggtctaatggcaccatctatggatattccccacaaaccattcagattagttcaagtcaacattaagatgcacgcaacactctcctatttaagagatgtatcctttcttgcttgtccaacgaaacagagtagcacaagaagcagagtgcggctagctcacagtcacca

SEQ ID NO: 46346 - DNA, 171 bp, Oryza sativa
aattcctgcagcccagagttgtcgatgaggaagtgaagccgatctcgccgccgccgaggaaggaagaggaggaggaggagccgatctcgccgccgcaaccactgaagcgggagatctggcaggagaaggcgagtgcgttctcgtcggtgggctcctcctcctcggggaaga

SEQ ID NO: 46347 - DNA, 1501 bp, Oryza sativa
ataacaaatactactagcagagtctatcttgttaagccgtgagataattaatccccaaatgggacacttgccaacacatttggctaccaaattggatataattaaaaatgtttatattttggagcaaagagagtagtacaatctaaaagggagtcacaaaaggattggtttctttggaatatttttcatgtggctttgtttgtaacaaaagagattgcatctaaagttctcaaggaaagttgagaatttttgtacttcaatggaaataaacagtgagattatccagaacagagattttcttctatttgattgatttgattgttgtctcccttttctctattcttaagtttcctgttacttttccaaacagagacaccatatataaaaaaaaattaagctgaagttttactaaattttagtgataacaaaaagagaaaaaaaagtctttatgcagagaaaaaggagaacaacctaacaagttcttatctgtaaagttctctcttgaaagttgctatttatgttatgtataaggtgaagaaaatattattttaatctttttaatccttttttctgcaatttttttgctttccttttttttgcgcttttttattacttttttaatcttcacgcatgtttttcaaatgttttgtattgaaagtttttaaatcttgacttgaatcaaatcttaacttttaaaaaaataaatctcaagttgaaagttttcaaaattgagttgaaagcttttaaaatctcgagttgaaagttttcaaaccctaattgaaagttttttaaatttgagatgaaaagttgaaagttttcaaattttaacttcaaaattttgttttcaatctgttacttaaaaaaaatcttccaaaaaaagaaaaaaattatcttaattaccatcgtgatctaaaactaacatgttagttacgttagatatactcgtcttagggaaaaaaccacggaaaaaatccaccggtatacgcgataataaaaccacagagaaaatagaactccggaaaaaaaataaatctactgtggtgaagaaagggaaaaaagaaaacccacccccaggctacgtgcgtgttgccggtgtgcacgcgccaagcggcaatccctgcaactgcaactagtggaattcgagaaacgcgggaaggttgttgatggatgaatcgttcattccatccatcgtattcgtgaatgccgttgcatgatccagtgcgtgacccgattatcgtgaaaaaaatgcagcatgcatgcccctcctctccaactgatcgatgtggacttggactaatctatttgctgctcctccgtcaagtggcaatccctgcaactagctaagctagtggaattcgagaaatgcgggaaggttgttgatgaatgccgttgcatgcgtgcgtgatcgatcccgattatcgtggaaaaaatgcaccatctgcactatatatatactcactcctcatctagaacacaacaaattcattagattagattagat

SEQ ID NO: 46348 - DNA, 1163 bp, Oryza sativa
  unsure (1)..(1163): unsure at all n locations
tattcaggttgacattttctaggttccaattgtctatgcgctatcaaggagcctgcccccagttcccttgagcattcttctgagtgaattctgagctattgttctaccaacagtttcatagggagttaagcagaaaagtttgctgtttcatggtagtggacataaagcacaatacataagtcactcatccgaaaaaactcaaaagtcatccaacttacctttatgagtgccatattttctgtttcctgccttcttgcaaggagccgcagtttgttcattccttcatactctattccatcttcttgtttcacccactggaactctttcttgattccagggcgaggaggccgatccagaaacatttcatgctttgcatagatagctcttacaggccttggctttccaccgattatgaaagggaaattattcatcaagtcgatagcagccttagcttgtatttcatcatctagttccaccaacgcagcagaaggaatatcatatgggattgtgtaattaacaatgaagtccacattgacaacgcgtgcacactgggaaatagctgcttcaattactgagcttgtgacttgaggagaaaggtgatcgatatatatcgttctctttaccctctcctcaaaatcagcataccccttcttagcatcttcatcagattccatgggaaggccaaatctgtggtaaacagtaaatggaaaccgttattaagagtgccaaggtttcagtgcaaacaataagctctttttcaacttctgtttacccatgcaaaaacctcagaagaaattgatgattctattgacagggtgtcaaactgagcaatataatagatgcaagattttgtcctatcctgaacttgaaagggccatgctggaanaaagaacttttcagcaattaagctgcagtgtcttctattcaatagagatttgcttagatgcggtgaagataagtttgtaaattattcatgaagaggctgcatgcaactcttttctgatattgttggatttagaaactccgtgaactggcaacgtacacaagcatgtggtgctccttggcaatagacacaaatcatgaatgatattacatcagagtatcagacctatatcagggacaacaaggaggattagggatcaaggacttaagaacacataaca

SEQ ID NO: 46349 - DNA, 1501 bp, Oryza sativa
tttctatacaaatttgacatccaaaccatctactttgattttgactattttcaagagatgtaaatttttttttcacaccagttaaagaatagctgcacaaatttatttggtttcaagatttgctatttgacattcgaggatgctcagctgacttcttttgactataagggctgtaaatgcaacatatattgtaggagattcctgttccgcgcatacgcgccgccaaacgaaatcgtgcgcacgcggtttcaataccatttgctataggacttcttttattttctgggagatgcgcacatctaacgtaactaagcttgctagctagtttagatgtaattaaggtgacattttcctttttctcgaaaggtttttttttactaacagaatgaaggaaatctatacgtgtaagaaactttcaaataaaatttagaactttctattaaaaagttaaaagccatatacctaataaattttacaaatttcaacttacaatttaaaactctaaactcaaattttgaaaaatttaaactcgaaatttgaactttcaagttaaaatttgaaaaacttttaactcaaaatttaaactttaaagtcaaattttgaaaactttcaactctataattgaaactttcttcagattggaaaactttcaagttaagatttgaaaacttttacctaaaaatttgaaaacatgtgtgctaacaataaaaaaaaatcagaaaaagggggaaaaaaagaaaacgcgcgaggagaggcaccaaaatagggaaaaagatagcgagaagaaaaagaaaatgcgtgcgtggggtgccagctgacgtgcgcaccagatagcaacccccatattgtatgttttagatacaaaagaaggcatcaaattcactatatagatgaaaaagaagatctaaatcattttaatcatggtacagatctactgataatatagttatatatataaaatgtaactaatttctatatgttgttgtaacacgagttatacatcaaatccatgaattgcattacccgaggttattttctagacactaataacagtaatatagagaaatacaatagtctttgctaaatagtatcatattggctccgttcaacagcaaattctttttactgtactgcggccaacaaaaacattgttttgtatttgtagttgcggcagcacaacggccgaacagacccattactagcaggattttagacgtggtttcatgagagatagatgacacgtcagaagccagagcgaattggattctttgtaaaagagaaactagaaaatgatgcaaagaataataataataatgcaaaaggaaaaaaaaagaaagaaaaggtagccgacccgacgtaaaagagaaggcgaatagccgaccgagcccgagcgcccttcctcccctcttcttctccttcgactttgttcgactcccctccttcccggcagaggagaggagaggagaggagaggactcatccatcatcatcaatcaacgcca

SEQ ID NO: 46350 - DNA, 1103 bp, Oryza sativa
  unsure (1)..(1103): unsure at all n locations
gtttttgttgaccatattggctttggtgtttaatctgtctctgaatgccagccagaggaaaaccttgcaattttgcgggatggtgtggagccaaatataatctgctggagtccaaagtgacccatggaaggacatcatccgataggcatttgctgttgagactttgggttccgggtatgaaaactctcttgcgtttgtgttgtctgggtaggggtggtggttttgcagtatttgcagcagttcatgcagctctgactctgcttggtaggataggtttggatggagctggatgtgccaggaattgtgcctgtattgcgattcaaccgtgcaatccttgtgtagggcaaaagagaataaaactgggaaagcgaactctatgtgcgctgggatagccacttatctttccaaaagagggttgttttgccgttgccaagttttacctgggtcgagtagcttagaatctggaattgcgactggatgagtttccaagttggtgtatcactggctctggggtttagctgtattgcgttttgcagatatctttctctaaaccagatagccattggatcatcttctgctgagagtaccttgtttgctagttttaagagtaacgctgtgttatgtgttcttaagtccttgatccctaatcctccttgttgtccctgatataggtctgatactctgatgtaatatcattcatgatttgtgtctattgccaaggagcaccacatgcttgtgtacgttgccagttcacggagtttctaaatccaacaatatcagaaaagagttgcatgcagcctcttcatgaataatttacaaacttatcttcaccgcatctaagcaaatctctattgaatagaagacactgcagcttaattgctgaaaagttctttnttccagcatggccctttcaagttcaggataggacaaaatcttgcatctattatattgctcagtttgacaccctgtcaatagaatcatcaatttcttctgaggtttttgcatgggtaaacagaagttgaaaaagagcttattgtttgcactgaaaccttggcactcttaataacggtttccatttactgtttaccacagatttggccttc

SEQ ID NO: 46351 - DNA, 455 bp, Oryza sativa
gtgaggaatttactttttgtgatatgatggcttttgttttgtgacaaaccaattatcttttctcttgatcatctggcaaaccatgaaatcgtttgtcttgaacccaatctttatttttgaccaatggtcctttcctgagatctgctgggaaagtataagctttttctgcctttcacagaagctatttctccctgcgcattttactctctttatgatagctcgatttttttttcatcttacaaataaaatgatgtaatgtgcattccagggtcgaacagtactctctttatgatagctcgatttttttttcatcttacaaataaaatgatgtaatgtgcattccagggtcgaacagggttgaaatgttgttgaggaaaatgacaaagcaaaatagcacgtgaaggcgtgaagcgataaatcagggagatggcagccccactgcacgtttttctagt

SEQ ID NO: 46352 - DNA, 534 bp, Oryza sativa
ttagctatctacgagtaacgtgggggtttctaaaaaagggtcctggagtatagtgtaaagaaagccaaagtttcactttccagttcttgctatcttttgcttgaactctgaaatttgtcattccaagctctttgatatgcagagcatacttcttatgacaatttatttagcatattcctaccttttcttaaagtgtaaacttgtaggaggttccaaggaaattcttttcaatgcccgattccagcatgtttgtctaattcgtccaacttgacaagcttgtaagtacttctttcttaggtgacattttccccctgatggttggcaaggccaagcttgtcatgataatttgtgttctaaatacacatatgcagacgaattggtgatattgtaaacgggagctcttcgctggcctttatcagtaacctgacgtctttgaatatcctgtatgtgacatgttttaaagttttattaaacatcttacagctttatacattgaaaacttgaatctaagtggggatcttttgttctttcaga

SEQ ID NO: 46353 - DNA, 187 bp, Oryza sativa
tttttttttatgatgattgatggagcactttctgttgcactgtcaaatagttgaacagtatttttgcagtaaatattgatccaatcccatgttttgactaatcaattttcagttagcaggaaaaaactggattaatagtaatcatacctcgtgtgtttggctaatttgtttgatgattcttgtgttg

SEQ ID NO: 46354 - DNA, 257 bp, Oryza sativa
catatttgatctgttcatgttttactgcttagtttacatgtgtagatctaatgatgcgttaatgctagtatacatctgcaatgccatgatttatttatggaatatattaaattattatatgcctataatctcaacagccccaagtgcaaaattaaagctaatccaattatccaaacaagctaagaaatggatttaaacccattctgaaaccgtcgtcaaaccaaaatcaaaattggatgctgttgcctgcttgctga

SEQ ID NO: 46355 - DNA, 292 bp, Oryza sativa
taaaagggactagtggtggtggtggttctgctaccaccccacaaccaattcctaacttttcttgaagagaaaaaagaataaaatactcctaacaactctctaatttttgcgggaatgaaaaaaggacaacgtggggccaaagggtccacatgtcagtaacagatttgtacagcaattaagagatgataataacgggttaatgataattttctttaattaaaaataccgttacaatgcacgggcaatatgctagtgtttactaaaagcaaaaacagaaaaaaatatttactgg

SEQ ID NO: 46356 - DNA, 182 bp, Oryza sativa
agctaggagagaggaagaaaaatttatctggaactggaagaacaaaggaagtgaggtggtggaggggagcctgatcccctgatggcctgatttagggttggcgtaggctgcttgagtggtttcgtgcttgactgcttcaatcggtgtgtttgccaccttccattgatggcaaggatgaagga

SEQ ID NO: 46357 - DNA, 1501 bp, Oryza sativa
aataaaatggaaaaaaacaccacagcggcacctataggcgcagggcgcggcatctcggcggcgcggcgtgtgctgctcttcggctgacgcaaccaaaaacaagtgttcgtacaagtgttatggcattttgctttcaccattcaaacaagtatgtcaaggtaacagaggagagagcatgagtgaaaattaacctgtggagattatgggtaccccatacccacacggcatggttatccgactagttataggggataacttatatttatgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggtaggaggccctctagggggcatatgagacaacctgatcgtcagatcaatacacacccggcggattcaaatccccaaacaggagtagggtattacctctcattgagagggcctgaacctgtctaaatcctttgtctctgcatccatccacttttaggtctcgtgcgctacccctttttattattgccgaaatcatgtttcgacagttggcgcgccaggtaggggaacgccgagttatctatcaagaagtgcgatggaacttatctcaggaatcaccggcaccactgttgctccaagatccaatcctgacagggagattgatctcggcgaacttgatagatttaatcttcgatgtcatcagctttttcttcccaatccgttatttattggattaattctagtcactgcttgatgctattcttctttttattctctattgcttgatgctggcgcaacgtgctcaattgggcatggtaagccgcagctacgcaaggcgaagccgtccactcgtagcgaatccaagtcgtgggctggcaggacatgcacgaaagttcacgagacgagatcgctggagatgtacaggacgtatcgattcaatcgccatgcatggattaattaatccagccatacatgcattcaatattgctggatacgtacagggcaaattgatccatatatagtcattatctctctacttgctaataacaggctaacgataaactttgtcgcttgttttgcatatattcgggagctgtacgtggttgtttgccggacatcgatcaaaattaaacagccatctgctgccgagaatacgggcaatatgtacatccataactttatacatgacgagctatggatcgcttgatcagtcctagcaacacagtgcaacaccaatgactaattttctccgtctcggagtcagtccgatcaaggagatcaatctcggcgagttcaacaatttaatctccgacttcgccgggttttttccctttcaacttattgttgtttattagattgatctttaaatttcagattaatctcttggtattttctgctgtttgcatgtaatgctg

SEQ ID NO: 46358 - DNA, 714 bp, Oryza sativa
aacctccggaacaggcaggcaggattaagcccctagcagcagggcaccaaccttctgcaatgacatctcgactaccgggccgcagctcgtgtagccttcatttgccctggagaatgtccatcgacccccgacttcatccatctccaatccgtgtacttttgtttataactagactgagccacaaactaagccttacccactagacatgtgaaagtacggtagtgctttgcaacagaggcccgagcttaatccttatagtggccggggtgctacttcccacaactggcatgcacccaaaccccaccgaaaacaggtttttaggggttttgaaagaggaagagaggtgtatgtcaaattccaccataaaccaacaattccatagtgtccagatgatatgagtattcccaaagtctagagttataaaaccacctaatattgcctaattaatcagcgaagcatctacctaaattcatactagtggaaccatgaatagaatacccactagttggggttttgtttatcctagggtgaacaaggtaataatatcaatagcaataataataaggtcataacaaaggtaaataggcatggctaaataaaacagtgacaacgcgggaattttaaataaagcgataatgcattaatttaaactaaaataattttataaactgggattcaatatgctcaaggatgatgtgacttgccttgctcaga

SEQ ID NO: 46359 - DNA, 396 bp, Oryza sativa
atgattatgaacaatgagtttgctatgtttatggatgattcatgttgaggatacaatgtaccgatgttaagcaccttccctttttgtttaaggcagtgccttgtattcatgtaataagggagaaatgtgtaatacagacaagttctatgaggattctttcggaagatgctgatatgggattatgtgtataattgtttactgtcaaaggagacctagggtctcatttcggaggaactatgttctaacctcgagttaataaacaacctgttgagggaaaagaaaatcaagcgattaaccaaagagacatttgtttggacaagagtttcagatgtgtctttttcggatgtcagggttgaatgtgtaaaggaatgctttgaatgctaaataatgacaaca

SEQ ID NO: 46360 - DNA, 320 bp, Oryza sativa
ctccctccccctctctcatctcacccgcggccaataggccctcacagcgcgcgcgcgcagatgacaggcgggcccgcccgccactctcgctgacgggtgggacccacatgtcatctccctcctcgcgccgcgcccgccgccgcgcccgtgccctagcgccgccgccgccgccgaatccgccgcatcacgccgtccccgcgcgcaataaagagggggaaatcactccccgtgattccctccctctttcccccctctttcccctctctctctccctcggattcgtccgaaatcgcgcccgcaatcctcgccggcgtcatcaa

SEQ ID NO: 46361 - DNA, 391 bp, Oryza sativa
tatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtcttcataaaatggctttgggcaactaagtgacttttaaatgctgctttctgcaaaacttaacccctatattattatccccttgtaccctcccttgcattaattatgcatctccggtgtggctcgctgagtactgtggttgtactcattcttgctcaacctttcccctcttcagt

SEQ ID NO: 46362 - DNA, 184 bp, Oryza sativa
tttttttagggtttttctttttataaaacctttttaactttgtttatttcttcttaattataatttgtgctctgaaaattccactaaaatttatttatgcattttaggcttttaggaaatatacaaaaatcctccaagcctttttttgacttttaactttgcacattttaattgttggaggctt

SEQ ID NO: 46363 - DNA, 207 bp, Oryza sativa
taaaatttatttacacattttaggcttttaggaaatatacaaaaatcctccaagcctcatttgacttttatctttgcacattttaattgttggaggctttcacatgaattttaattattctttgcacaattttgaggatgtattttagagtcgttttgggacgcgacactccatcacgcccacccttgcctggatgcgtcggctaga

SEQ ID NO: 46364 - DNA, 1501 bp, Oryza sativa
gaaaaataaaataaaagaaaagaaactaggaagaccccacctgtcagtcactatagcttgtggataaggttgtattaaaaataaatgaattaggaacagtaccatttcacaattattagaattaattcaaatttgaatctttaaactagcgtaacttattcgttttagctccgattcgagtgaaacttgaacctaaattcatctaaattcataagatttccaatggtatataattcactatttacgaaaatatatttaaattaggaaatagttaataccaagatgatgtataatagttaacttaaaaatgtgctcataaataggattgatattgtacagtagagtagatgtcaaataattgtctttaacatgctttctcgctataaaacctatgtaaactaattaggagcattgtttcaaattaattaaagcataggaaatactagtgccatttattaatatatgtgaatataattatactcatgacgtccaaattgtataaataatgtttagcctcatactttgtgactaaatttgaacacacgtagatgagtcttcaacttgtttatgagggataataacatgtttatgagagataataacagagctagtgtgactaaaatcacccgcatgaagttagttaacggcatttcctatacaatagtatatgtttagattggaaatcaacccttaagttgatagacggtaactcactcataaatccacttaaaatcacatgtactatatagcctatagtaaatagcaactattcagtaaatgattcaatattaagatattgtgcacacatatatactgcacaacccattatagctatacggtgtagtattaaattgcttgattgtacgtattaaaattaaagagaatatatgatgaacatgtatggtggataaatcctaattatagaccttgacctaatataacctaagttcaattgtaaattaagattattcattgtaaaattatgtgatgggataatctgtaactataatattattagcctcacaagtgtaacatatagagcatggataattattaacctttcataatttattgtgacaaataaaatatgttcataataatagaaatgattcacagtaattatttgaccgatccaaaatccatccggcaacagaacctctagtgtataaccgttctatttagatagatgcatatatagccatttgctagactaaaccacatattagccaaatatgtatcccataaatgctatgttggttaactcctgaaaagaccatgatgacaacataaagattaagaaaccttatttcttagcttgattagaatccattagcaaacacgagtagtatgagcaaccctaggttcgaccccaacaactatattttgtttgtacatattcgattgttgtttgaatatcggtttttctcgcgtattatagaatttgtatatcggttagtcgtgaggcaacgtatgtagcttccaggaggtgaaggttgatcac

SEQ ID NO: 46365 - DNA, 739 bp, Oryza sativa
tgcaaagttttattataataatccgcaaatcgccatataccagcattaaacttcggatgatcatatcttggtcatacgaactccgaatcgacccgttcaagtctcttaatgtttgttataacctaaagaaccctgtgctttgtttttatgtattgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttcttatgaccttattattattgctattgttattattaccttgttcaccctaggataaataaaaccccaactagtgggcactctatttatggttccactagtatgaacttaggtagatgcttcgctaattaattaggcaacattaggtggttttataactttagactttgggaaatctcatatcatttggaccctatggaattgttggcttatggtggaattggacatacatctctcttcctctttcaaaacccttaaaacctattttcggtggggtttgggtgcatgccagttgtgggaagtagcaccccggccactataaggattaa

SEQ ID NO: 46366 - DNA, 1501 bp, Oryza sativa
ccggctgtacagatctaactacaaaccaggagctaaacaaattattaccagttatagcatcaataattattgtgagaggtgtgagactaatcacgaaaaacattgctcaacccacccataaccgcgggcacggctattcgaatagttttactctggccagaggtgtaccactgtacccacaagacacagcctcaacatcatgtctaccatgcgtcgcgatactggaaagtacccgaatagaggctgtgacaataccctccgcacaacacaactcaccacagtgcaccattcctagatcataatcacccccttataaaacaaggcatggactccccagcgacccccgtgggcttatctccgccacttctcagtctggtgctctgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattaatcatattttaattaccaattaattatcataacacgattaaccatcgtgagctaccattaaatataaccataaataataatgtagtacatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaataggttcacaccacccggtgacattcgaaaataaatgcacagttgaaataaatagagaatttaaatataggatcaacatgctcaaaggattgtgtttaagatctgtgtgacttgccttgcaataatcggtcttcaattaatcttcttgattacttccgacgcactcacgaaccttcacaacgacggaaacgacaagctaacacgccaaaacaaggaaaaagactaataaaaaccaaataaacagtacatataaagtaaacaaacatgtagatcatgattttagatgaatttagagacttgaacggcctcattccgatttcatatgaatttattatgaattttacaagattaaatctaattaaagcccatttaaaaagaattaaataaatttaattcaatttatggataattttaatatgtagatatttattttatataatttttgcaacttgaaccacattaaactaagttacaatgaattagttatgaatttttaaagattaaatcggattaaaacacttatatggattttaattgaattatgacgcaataatgaattattttttaaaaggaaaagaggtttattgcgtcagcggctagggtttgcggtgaaccgggtgcacggcgacggctcacggaaacgaacggccgagatcgatccatccaaaacggacggccgagatcgatcggttcacgacgggtctacgggacagcgacga

SEQ ID NO: 46367 - DNA, 790 bp, Oryza sativa
tttgtgtggtgtaccccggcttttcctgggacggggattaatacactagcgttcgggaaaaggcaattttcccggtcgcgacaaaacgggcgcggaagatccggccgccattgatggcgccggcgaggttaggggagaggtttccaaacgaatccgagggagagagggagagaaaaatggggggaaagagggagggaatcacggggaatatttccccccactttattgcgcgcgtggacggcgggaggcggcgggattcgcggcggcggcggcgctagggcacgggcgaggcggcgggagcggcgggaggaaggggatgacgggtgggccccacccgtcagcgagggtggcgggcgggcccgcccgtcagcggcgcgcgcgcggggagaggccggatgggccgcggggagaggagagggagggggagggagctgggccggaccggcccaagagggagagggggagggaaagggaactttttttagggtttttctttttataaaacctttttaactttgtttatttcttcttaattattatttgtgctctgaaaattccactaaaatttatttatgcattttaggcttttaggaaatatacaaaaatcctccaagcctttttttgacttttaactttgcacattttaattgttggaggctttcacacggattttaattattctaggcataatttcgaggatgtattttagagtcgttttgggacgcgacaaacctaccccccttaaacggaatctcgaccccgagattcggaagaactggcgaagtgatcg

SEQ ID NO: 46368 - DNA, 308 bp, Oryza sativa
aactatgtcacgtcttccgtccgtataccgtggtggtatgtggcacgtggttacacgtgaggaagatgtgtcttgtgggtaaagatgtacacctctgatcagagtataatctattcgaatagccgcgccttcggttatgggcaagccgagcaatgtacccaagtcagtgttttattctttaaattttgctcaacaactaaaatgtggaatggttggcctgggttggcttgggacgagctgggacccagggtcgggttgccagttcggtctgaatcatcgtaggccttgggttaaggcaggttcgtgag

SEQ ID NO: 46369 - DNA, 343 bp, Oryza sativa
cttgaggcatcaatgtcctgacttatgaccttattgcctttcttattgtcagccatctgttgcaaagatttggagagggagagagggaaaacaaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgactaacaacactaccctatagggcggcttaggttctgcgacgggttttccaagatcttcactcctgcttcacagc

SEQ ID NO: 46370 - DNA, 1398 bp, Oryza sativa
cttgaggcatcaatgtcctgacttatgaccttattgcctttcttattgtcagccatctgttgcaaagatttggagagggagagagggaaaacaaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgactaacaacactaccctatagggcggcttaggttctgcgacgggttttccaagatcttcactcctgcttcacagctggcttcactacttcctgcacttcgctagcggatcctgcagtcttccggagcttcgggaaacaactgacgacatcttcttcttcgcaaagctgaccatctagtacttagttgaaatccgaagaaagaaaagagtaagccttttgcaaatagcattaggggaaggagaaaaagaggaactttcgcaaataattttacttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctatggctccatcttcacaggcgctcaactggggtataagccaggactccacctaagacttcttctccaaagcttctcttactgaagaggggaaagattgagcaagaatgagtacaaccacagtactcagcaagccacaccggcggatgcatgattaatgcaaggggtgtgcaaggggtaataacatagaggttaagctttgcagtaaacagcatttaaagacatttagttgctcaaagccactttgtaaacgcgatcctagaacgctacaaggttattaatcaaggccgtgaacccacacgaacctgccttaacccaaggcctatgatgattcagaccgaactggcaacccgaccctgggtcccagctcgtcctaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtt

SEQ ID NO: 46371 - DNA, 493 bp, Oryza sativa
cttcatcatttaatctttcaatctctgtttataaatgctcgctttatgcaaatgaaccactttagctcttctttgataactccctgcatcatacccctattccggtatgacttgctgagtccagggggtagtcctaagcctggttttatttccccccgatccaagagcttgagtatgtgtccgatggcgggttctccgagagtaggcttgcttcgtgccatcaaggatgcctgtggaggggtgttcccgctgcaattcaagtcaaggttaagctccagttttttttggtttccggtgcatttctgtaagactttatgatgtttgtaagacgtggatctgaatgtcaacatagccgtttgtgtacccccgccggtcctggacgggggttttaatgcacattctgcttggaatcctattcgggaatttctgggcgtgacagcggctgacagccgggccccacgcggcagccgctcggtgcgcccgaaggcggcca

SEQ ID NO: 46372 - DNA, 824 bp, Oryza sativa
tgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatataaatattatcgaaataataaagatgtgtcttttatatcatgtttgtgtggtgtaccccggcttttcctgggacggggattaatacactcgcgttcgggaaaaggcaattttcccggtcgcgacagcagcatcagctcaagatcgcccagggagaggtctgtcgccccaagcgccgccgcgtctgccgcagccagaagatcaccgcccgcaagagtacctccaggcccgagcttgttcgccagtccttggcatggacctgcttcgtggagaccccttgtgccgagcccgcgcccgtggttcctcaggagggggaagcctccggcgttggtagcacggaggatgcgctgctgctcaccttccgtcctggcccatcgcagcggtagacgagcagttagtaggcttgcgcgtgtgttctttcttgtttgtcttcttgttggagtcgtgtggggcatggttatgccggtgtgtggtataactgtgtcggagcctgtctttattttatttgcctaagcaacttgaactttaatgaaccaatttaatagcagtaataaattcaagaattatggtagtcgtgggtggctagctttaattgtcagctctctctgtttgctggttctgtgtggggttttc

SEQ ID NO: 46373 - DNA, 310 bp, Oryza sativa
ttggtgccttgctgcgaggggcccagttcggtctgcatgtacagggggttccggccgtaggcgaaattgggtcggtactcttgtctaagtctaggatgggttggaaattatgtcacgtcttccgtccgtataccgtggtggtatgtggcacgtggttacacgtgaggaagatgtgtcttgtgggtaaaagatgtacaccttctgatcagagtaaatctattcgaatagccgagccctcggatatgggcaagcctagcaatgtacccaagtcagtgttataattcttaaaatttgctcaacaactaaaata

SEQ ID NO: 46374 - DNA, 270 bp, Oryza sativa
agctcggtaccccaaattaagctagttcaaattaatgaagtttggagccaacagttgatcacgcacaccgactgggcaactgacatgcatgcaatctctactatgggctccttcagaatttattccatcaattttccccttttgttgaatttgttggttggctggttatgatttttagggctatttttcgcaccattgactattgattagaaatacctggcaagctaagtaatcaatttgcatttgacgtactgtaaatctgtaatcagg

SEQ ID NO: 46375 - DNA, 217 bp, Oryza sativa
cacattcttccccttagagaataactctcaataaacccgaagcaaaggggagagaaagggaaggaaaggtgcaggcctcgcttctagctccaaggaagctagatctgggcaagggccaggaagagactaagggcaaagaggtcaagaagaaatacgttgctccacaggaagttcaaactaggcatgccattggttggagatgacgtgcttgccacaa

SEQ ID NO: 46376 - DNA, 496 bp, Oryza sativa
ctattgttgcagcattttttttctcataaatttaagacgacgtgattcaagtaattttactttacaatttttaacaatctgtgctctagaataacgcagcctagcccatccaatcggcacgtccacttataaatatcacctcacatacatccttagtatacaagaaaaaaaatactccatccatcccaatataagcattcttagaatagtggcaaatcaaacttttaaattttgactattaatagcaaacgaacaaaaacagatcaatcatgtaaatttgatgttactagatttgttattaagcaaattatcataatgtgtaactttttttatttaaaacatcttacttttatagatattgttgatcaatgtagcatctcgaagacattgtcgaagtccaacaatgcttatattttgggacggagagagtattacttaaaattttaaattagagaaaatccataaaatgccatcgtacaagtctttttcttccaga

SEQ ID NO: 46377 - DNA, 1501 bp, Oryza sativa
atcacccctttccctcgtgttcatcctggatgctctggagtctgcagggcgagtgacagctcgtccttctctctgtcgggtcggaacgtaccctgagaagaggcttccactgcgtccgttagtcgacgcgtagcctcgcgtatctgatcgctgaagaccagggagccatcaactgggttgagcgttccaaagtgagcatagtaccagaacttcgatcgttccggttaattagcggtggccggttcgatacccctctcaagtaagctagcctccatctcctcccacttcggcatcgcgacgctatagcctcctgaccccaagtggtgatggtacttcttcttggcggcattttctttgtttctttccatcatcgcctgcccttgttcacatgtcttatgtgcaacgaactcgtcccagtgatcccttagctttgggaatgtgtcgaagttcggtgtctgccccttcaggatatatttctggtacagatctcccttgaagctctgaaactgttctgccattttatttagagtccaccttttcactttgtcctctgtacctgtgggaagggtgaatgtctcgagcattgtggtccacaacatctctttctccgaatatgggacaaagctctcatgatctccgtgtgcccttgttctgcgccagtacaccgtactgacaggcacgttatcccacacaacccaaccgctgtgacgtatgtagttcttggtggcttccgcctaggcactaggtcggccgtcttcgtccacttccgttatgatgtgccaaccctcaagcttcttcgcggcacctcgttgcccgcgtgccctcttctgtccagcggagggttgacttccactagcctcctcctcctggttcccctccacatccctctatacgtgcccctcctggttcccctccgcatccctctccacattcccttcctggttcaagtactggtttggatcctcgttcccctcttcttcgttcaagtactggctgcttccctccgcaattgtatcttacaatatatgttcctcatcgcgatcagctatctgttcatacaagaaatagttcctaagtcatgagacatttttgctttaacaatcttatatgctaacaatcatatatgctaagtctaaacacaaatctaataatcttatattaaaactataataatcgtatacgaaaactcaaataatattgtattaaaactgtaatagtcaactatgctaagtctaagtgacgtatattaggaccctagctagtcaataattatatactaagtctaattacaaatctaataatcttatattaaaactcaaaaaatattatattaaaactctaattataatgctaagtctaagtgtcgtatattaaatctaatagtcttaattgcgttaaaaatctaacaatcatatatttacatcacttgcctgcgcgaattccttcgagggctagcaaccactccggcttgagggacgacgacgacaacgtcttttctgca

SEQ ID NO: 46378 - DNA, 551 bp, Oryza sativa
gcgttgcccctcagatttcgcttggggttttatatctatcttactttattgctgttatatatttgatatgacatagtaggatggattccctcagaaaaattaagtgtaatttatgctcttccaataattgcacctattacggttgtgatcataagtgatgggtttgccatagcaaagtgtcactttttatcatgataaaataggatagatctcggacatctgtatgcggagattattggtttacttgacaaggttatcaaaacggttttgaaccttgggacataggttgggttggatatggagatgtcaccccaacagcacaagagtcacatatgatgtgattagcaaggtgttgcttacctactttgatagttgtctaattgtgatgccaaaactccctagacactaataaaatgaggatcttgactcactatgttactagagggaattttgtttcacaatacatagtgggagtatcttttgttaaattgtttaatgaaaggttaaatgtaaacatgctgctgattttgtatacatatatttctattgta

SEQ ID NO: 46379 - DNA, 511 bp, Oryza sativa
ttaagcagatctcccaggccagtgtgtgttttttcgcatcaacagccacccctttatatttacaagttgtaacttcctcttttgattgcattcagttgactctgcaaagtactgcatcactaacgtctgtataaacctaaagttgcattcaagtgtagtgtttttgaacttgttgtggtctatgagctttattctgaaggattatactgatgacgatatattggtgtgctttggatcaggaaggctgtctcatcctactggtcagtcaaggggaatctaattggtagtataaatatcagagaattaggtgatgatcaggttcaacatcacagattcagatattctcactttctgtgttctttaaccagtggcacaatgtgtgctatcaatgtaattaaaatatggatttctatatatgtattgctctttggattatttcagcatttcaacgagttcttaatagacctttttttttcatctgtgcatgcaagaggaggcaacctacttggga

SEQ ID NO: 46380 - DNA, 489 bp, Oryza sativa
gccgggcgtggccgcagccgctccccgcgctcgcgacgtcctcgccggcggccgcctcgtcttcttgccctcgccgtgcctacgtgagattagaggatgacgacgtgagagagaacgacagaaatagtgacggagtggcatggtttcaattttaaaaatttgtagtggcacctagccaataaaacaaatagtagtggtatttttctaatttgccacatttacagtggcatggatccaattaaccctaaaaactataacaaaaatataccaaaaagctcatagctcgtgactaactcgactcggctcgtttgtatttattaacgggctaagccagggttagctcgtttgctataacgagcgagctcaagctggctcgcgagctaaatgagccatggaaaaacaaagcagcccaggagtgctgaggtggatcgcattgttatttgtaggcctaaggcccatcagatccactgatttccactaaaccctagt

SEQ ID NO: 46381 - DNA, 1501 bp, Oryza sativa
cgatactcgaaatctatgtaagagcagagattaataaatgatgcgctaccatagatcatggttgagatgataacaacatttttcgtatgaccataacaggataatgtttacaacaaaaaataatactgatattattaagcttgatatggccatacagcgaagcttgaaattgaaattaattaagcacaaggtggtacaatgatattagtgtgctaacccaagataatgtctattgataaaaaggaaaatagccaaaacaatgtagcttgcagatcaaaagcggacaaattggataagtctagtgtttgatcatgccatacgctagttgaattctagtggacactactaaattaccgacaagttgaaacgacgctgctactgatacggataatcaatatttatcatggatataaaataaaacgagagaacatgaactgagcataactttttttatagtcaaatctacacatttagattcaaattcttaaacagtacgggtgttcgtatttttttgctaattattattcatgtggaaggtcacaagaataaaatgtctagtgataaaataaccagtttctttagacataggagtgatttatgccagacattttgactagaccttaacataaacataattagaaatggaactttactacaatgccaaagcaccacgggctttgacgctgaggcccaacaccttaacaccgtggaatatactacgaaaacaataataggcacaaatgcgggggggctcctagttagcgcagacgcgccagataattttgtagcgcgcacttccgtaacttcctcctgtttcgtcgttttgtatatttttctgttccgcatcgcttcaggggaggttaagcgtgtgggtccactacagccacgcgtcattagcactaataacaacgctaaccatatggattaatctagttatagtttttattatcaaaataatacataaatagttaagttgaaagtttcgaaaatatgatgaaaattttcaaaatctgagttgaaagttttaaaaaaaaatcttgaaagtttcaatttcgagttgacagttttgaaatttgagttggaagctttcaaactcgagttggaagttatcaaatttaggttgaaagttttcaaatttgggttgaaagttttcaaatttgacttgaaagttttcaaattttgagttgaaagtcttcaaattcgggtcgaaagtcttcaaaactcgagatgaaagttttcgaaattgatttaaaagtttaaattttgagttaaaagtttttaaattttaaattgaaagtttaaattttgagttgttttaaattatggttgtgacttttaatttttcatctataaaaagttttaaatttcacgtatatattttaaatctttagttaaaaaatacaacctcatgaaaaaaaaggaaagattaattaaaaaacataattatcggaaactaattccgtcaactaatataatcttgattattttctccgaatctagc

SEQ ID NO: 46382 - DNA, 283 bp, Oryza sativa
ttgtgcagtttggtgcaatcatttcgcataggccaaaccaactctaaatctctgtagtcgattaatttagtagcttcaatcaatgtagatcggcatgttgcgttgcatatggactcttagctatgttactatgtagtagctgttgtttattttgtccgttcttccgacgattgggggatgacggcgtaatcgatgctttcatacaaagtggcgattgtcggttcacgtgttgttagtgactgctggcaaacttacaaagtttcctgttgtttgtatacacaga

SEQ ID NO: 46383 - DNA, 1501 bp, Oryza sativa
catctgcttgttgccctcctccaaacctatggctagaggtgccaccatcccaagtaggttgcctcctcttgcatgcacagatgaaaaaaaaaggtctattaagaactcgttgaaatgctgaaataatccaaagagcaatacatatatagaaatccatattttaattacattgatagcacacattgtgccactggttaaagaacacagaaagtgagaatatctgaatctgtgatgttgaacctgatcatcacctaattctctgatatttatactaccaattagattccccttgactgaccagtaggatgagacagccttcctgatccaaagcacaccaatatatcgtcatcagtataatccttcagaataaagctcatagaccacaacaagttcaaaaacactacacttgaatgcaactttaggtttatacagacgttagtgatgcagtactttgcagagtcaactgaatgcaatcaaaagaggaagttacaacttgtaaatataaaggggtggctgttgatgcgaaaaaacacacactggcctgggagatctgcttaactccagtgcatgtcctaaatcttgctcttgggttcaaaggcgtgccagttgatttgatcttgcaatcaacaagaaggaaaaacaagaaagacgaggttaaatccataaacgataaccgatcggctaagggccgatggcatatcgttaatcattgaaccgatgttactggcattagatcgacaatgaagaataaagcaatataaagttaaatctactcgattggctatagatatcaacgatatataatcctcttctcgagatatatttaagccaagtgattgggatagatcgaacagtaagtcgagacaatataaatcacttatgcttaaaggtactttaagatgaagattatatatacgttcatagcatagccgatcaaatagatctaacatgtatcgactaatactctgatatcactctttattaagatattaaaacagacaaaatatatcaaacgacaagtctaatatactttaatgcaataagatcttaatataaaggacagatttagcatatcaagtgaacatgtaagcattaaaggtaactaaatcaggtaagatcggctgaaaccccgatactatatctattgatgatcataagacaagctagatattgcaattatgaatattacttaatagatcaaactcaaccgatgcagcattaagcataaaaataaatacaagatctaaacaggttgatgaaaacctctgaaagatggtagatatgctatataatctagattaacaacgatatctaactctatcagctgccttccaatgatagatgttggccggtttagggttagattatgatattaataaatattatgaagcatatatgataactcaatgatttacataaccaagattagagtgtcataaagatgtaagcactaatcccgagaacacaagtcgtcatgacaagttttacctcttgttgaaga

SEQ ID NO: 46384 - DNA, 1501 bp, Oryza sativa
gatcctattgttgtgaatacctgttttgcctattgcattgtaacttgcaaatttgttttgctaatgtccaagtgtacagtagaaatgcgaaaacatatttctatcttacaaataattttctgtcttgcaggagtgaatttgaatatttgtctgagttgttgttatctagaacggttgggtccaaattattgattccaggagttggtaatatgaagaaaatgcattttcctgagaaggcaagtcgatctggagacttacctgttgatttctcctttagaacattcaacacttctgttaatacgcaagtcatgttgctcactaaatattcctgttcatatgatgaaattgatttcttttacaatcacccatactgtactgtacagaacataatttaaagtgttgaagcaacaatataatttcttatttttaagatactagaaaaaatgcccgtgcgttgcaatgggtaaatgctattttaattttattgttgttatatggtttagctagggtaaaattcactgtgggaattcgcttggatatttttttttgaaaatcataagctgcaagagtccgtatatcatctcaagttagcatgcgagtttttttaatgatatttcttatacgactccttctgtatttccaaaagcaaatgagcttaaaatccaactcaaacacggatctgtatttctaaaagtgaacgaacttaaaaaccgactcaaacccggatgacataccaaaataccggcaaaaacatcttcaatttttataatagtagagatatggcatattgttgagttaaaacccttgaccagcagaatagtttgttatttttttttcgaagttgaggaaagcatatcataggtcccccttattccctaaatttttgcaggtcacttgggtctctggatttgagtgggtacataaaattgtataagtgggtcaacaaagtcatcctacttttttttttggtatacttgtataagtggtctgtagttgcttattaggcatggtttaaacctgtacttatgcacatacacatgtttaggggcctatatgtgcaattttcgactttagaaacccaacttttagtagtccctggtacacatacttcttttttctattcctacatgagtttcacttgcgattctatctacatttgccacaaaatagcaaagctcgtaccatgaactattttatctcctgacacatttgttgtttataccattgatatgccatatgttccgtgactacaagggtaacataatctcatgctattcattcctgcaggatcaagttgcttcacctgcagaacttgcaaaggcatacatgggttcaagatcttctaagggatcaccattacgtcttagattgcatgacccctctgtactttccaaatcgatagaagctaatacaacacaaataacgaggcctcccaccctctctctgctcgcgagtgcaagaaatcatgctccaaccacctctgatcgtcttgggagcaact

SEQ ID NO: 46385 - DNA, 1501 bp, Oryza sativa
gcctcttccctccaaccacatcactcccgggttaacccttttacacgaagcaaggacgaaagtgtaagtggggtggtgtgtgtaagtgggcccgctcatcggttgggctgggctacgcggatctggagggagggctgttacaaatggtatcagagccgaccctcgcggttgcgcgtacgggtcagtgtgcgggcatatggcgcatggcgcatgtgcgcactgtgtgaggcacaaggcatggcatatggcatcgacactggacgtacggatgtgcgctaagagggggtgtgttcctggacatttgcctgtgtggctgggtaagttggaccgacggggacgtcgggtcctttgagggggggtgtatgcctgtgtggcccatgtgagctgtgtgcgtatgtttagtaccaccttactagattagcacgagtggaaccgacttataaggcatcttccctccaaccacatcactcccgggttaacccttttacacgaaacgaggacgaaagtgtaagtggggtggtgtgtgtaagtgggcccgctcgtcggttggggtgggctacgctgttctggagggagggctgttacaatagaccaatgcattttttttattgctggagctgaagcaacgaaacttcgagcccagaccaaagccttatggttttgaccccattccatatttctctcctctactcttggctagtcacggcaacgaaatcacgtcatctctcctctgctagtcgtcgcagtggaccttgctcccacctctctccaacccacaactttactcgagtggctgcccttatcatagcactgctagttctctaatattctgtgaaaaatgttaagcatattacgatgaatatattctgccaagaaaaatatgcatgaatatattacgatgcaaaaatatttatgtttgtaaaactacttttatgatatatgtaagttacttttatcatatatatatatatatatatatatatatatatatatatatatatatatatatatatatatatatatatatatatatattacttttagatttgactaagttacttcttaaacattcataatgctctaaaatgattatttttattatttattctagtcaattctataatttctggactttaaatttaatttttagatagaccatatttttctccttccaacgaatttacttctaatggtgtaataacttacttccattttatgtttgtcaaggttatggataccatatacctaatagtagttaactaaatctcggcaggacccaccacataccatgtcttatacggaaacaaccttcggatataggaggagttccgcataaggaaggatgaatagagttctacatggaaacgataaggactactcggattgtatccatattggtttctctagttctatttggacaagaggacacctatgggtataaatacaaggccccctaggaagagaggggacactgaacaatagatcaagacacaaaatgaac

SEQ ID NO: 46386 - DNA, 1501 bp, Oryza sativa
agtccggcgagaccgtccagacaagctgcgacttcgtcgtcaccggcagcagcagaacactgcaccggatccaaatcccaagctctggcatcagtggcggagccaccatgattcccgggtattcccgggaatacccaacattttttatcaaaaaataagtatacttctagtatatatacatgtacacatatttgtacacctaaatcctcaactcttttatccaaacacagcctaattggtctcttgcgatgcctccaaccaacccgacccactccgtcatgacccatcagacatcagttgacccacttagccaccactcttccagacagccccctctcgctctccctccatgacccatcccaccctggctcggctccctcgcgccactccccatttgcaaaccctaggtggcggcgcagcgagacggcaatcggcggcgggagctggaccgtgctaccgtgcagggggaggccattgccacggcgggcggcgcccgacactccgccaagctaaggcggtcaggtcggttgggtggccggcggccgcgaggggcaggggcgggcaacagcttaacgcttagacgggaatacccaactttaaaatcctggctccgccactgtctggcatgcctcctcgtggcaacggtgtctttgaggatccaagcttctgtttcaagatcaaatcagtacaagcttggtgtagtagtattttggtacttgtactgatgcaacaaccagaaagcagagacggctctgcaaaattaatgcgcataatatgttttgggctgtgtttagttcagtgcaaagtttggattttggttgaaattggagatgatgtgactgaaaagttatgtgtgtatgacaggttgatgtgatgaaaaaggactgaagtttggatccaaactttggatctaaacacagccttggtcagaagagctaggagaagcaggctgacaccaatcccatgaccatgggcactgggtatagggcctgcttggggagcttctggcagctagagagatttttcttaaaactaccactgtcaaaagccctccaaacaatccagatatttactcaaattttaagaagctgcaattgtaaaatttagaaaataaactagaaaccagaagccgtgttcccctgcttctctaaattctcaccagttacttttcataattttaagcttcccaaacagcgccataagcattttgccaaaaaaaaaaagaaaaaaaaagcaaaggaggctggtggagttcggagtatgagaatgtgttgtttctgaccgattggacatatgccatgcaggttaaacacttattaacggatgttaaacatttcattatggttaaagcaattacaggcaaaggatattattgcattcattctacttcccttatcgaatcaccaccaattagttacagcttatgacacgccattgccgataataaacgaaacaaggggaaaaaagaagcaaaagcacgcaacacaggtgatacaaagct

SEQ ID NO: 46387 - DNA, 1501 bp, Oryza sativa
taaaatagaccgagatttcagagcatattgtcccacatttccaattggtgcttcaattaaattccttgcttccttctctgaatgtatgcactttgttgccctacacaacttcaggtagaggcacagtgtcgttacgatcccttgcttacgtgctaagttttcttctacagctcccattcttcaccagtaaacaaaccaccatgtgcagcaaaacggcaaagtggttcaggcactcgctacgctttaccgcgttggttttctttttgctgggctacatatagcgatggccacttctggcccatacagattgcaggctaggcctttttcctgatgggctaatcctggccattcccaggagatgggccattagtaatttataacaaggccttacacactgtggcccaaattactaatggaccgttcagaacgagttgctgatccggcccagtgtactaagctgctccccaaagctgttttttctcttcttcttttcccctcttgacacatgtttttcttcaagttcagcactattttcaaggttcgaaatcttaatatctcagtagaattcatcagttgagacgtccaaactggtcctgcaaacagtttccaggagaactgcacatctcgacaagtttgtacgtggcacgacccaagtgacagagactgatttagaacaaaaggaacataacgcagcagcacataaggctttggttttggttgttctgggaggagacccgttccctgagtggcttttggttcattccaatcattcccaatggcttaatctaactaaacaccaacattttcgtacaaagaatatatgccaaatgtaatgtggttccttctggtgagaaatcaaaagagcacacactgcacataaacctacttgaaacacatttcagttagtgcaaaagagaggacaagtagggccaggttggtgcatacttaagagccaagcagcactatgaccatacaaagtgacagattccaaaagccatcttctgttggtagtatccactacttctactattatcatccactgaaaacaaggacatggatgcataaactgcttctgaattttattttaattttttggctctcgaccaagggggtccatatgcattggagcattattaacaaagcatgcaacaaagttgtgaattatttttgtgctggaatatggacatggaaggatgttgactccgcctttgtctctgccacgcaagaggaatcatttcgtggataatggatttggagagaaccagcagtgtaatctatatcagtggataatattctcagtagtggagataacaaaagaacaattagtgtgaggaacaaagcaactaaagggaagggcgatgtgaaaagaaacctgatgagaggtattttaattttcttatttagacggtaatgtctcttttttgtttcttcctcatgaaagttcagtggccaagtacatttgagtcgctgaaattgcttcagtaaagcgccactgccgcca

SEQ ID NO: 46388 - DNA, 1501 bp, Oryza sativa
acgaaccgggcgttgagcaggagcgacccggcgagccgcaccacggcggcggcggcggccggcacgcgggaagaagaccacgacaagaacaccacgagcgcgaggagctcgcccacccgcagcatccggtagaggaggcgcagccgcaacgctgctccggcggccgccatggtcgcagcacactgtatcgtgcacagctctagctagctagcacacggcgtggccggcggcgacggcgacggcgactcttgccttcttggagacttgggttagtgtgggttttggaagagagtgaagctgagtgtgaggagaggagagctgtctgaactgaactgatgaaatcttctctttggttggggtgaggtggatgtgagcttatatagcctcaatttcggtggctttctctgtggccttttgtgtttaatacatgcatttgtcttctagtctactgtagtggtgggtcttaataaaatttttttgatgagtatattggtttttaaaattccaggagaatatttttgaaagatcaatttataggagaatatatttgtgctactgatggtagcatataaagttcttgaaatggagcgattataggacaaaatatgataggtgatgtggatagaacattagaaccaccaacttttgtatactgtggacctgtgggagttgtagttattgaagtcaatacaaattttagaatacataatctttttttccttctacaaggtgtggttcatacctaaatcaaagtggctttagagcgaaagatgtttcctacaaaaattcacatgttgatatgttgttagcatcatgttctattgatttttttatagatatatagcgtattaaaatggaccgaaaaaagtttactccgatcaagctttaagctggcaactcaacagtagtaaaccacaagttgtcttattatttttcagcctattcactgagttattaaaatacttcacgactcaaaaagaatacgttttttcaacataattctttttcactatagtattgggatcacttgttttaaactacagtatttgtttaacttttttttttcaaatatttggttttagataatccacactaatagttcctttaataatctaaaacaaacaaacaaccttatattacccaaccgcttccatttacacttgtttggcaacatattatatgtacaccagctctcacgtgtacacacgtacacaccaactaccaaatgtcacaaaaaaatctagaaaaattcatatatgtattttcaacagtattatacctagggataaaatattaaccctaaattcattatattttagccgtaataaaaaaattaaaaaatataacagttttaaggttataattctattagaattttgtctctttttttactttctatgtagaatgaatttgaacgtacgacattgcatgcttgtatgaatttttctagaattttttgtgataatttttagttggtgtacatggtgtgtacgcgtgagga

SEQ ID NO: 46389 - DNA, 406 bp, Oryza sativa
gattttaaaaatcgaacttaattatcgtttgggttcatttttttcactctctataagtcccgccaaacaattaactgctttgtcactatagtcatttacggctcacacgctgcctcccctctttaatgtcatcgagattttaaaatcaaacatgattattattttttttactttgtagcaatcccaccaattgccatgaccatattgcttaacgatgtgtttatcgtccctccttttaatagtatttgggattctatttgtggttttgttaattaatttttttaacataaagatagaactttattaatgattaagataggggatacattcctggtttaacaggtccaggatacacacatgtgcacacaatctccactcagtgcttgatcttgaactcatgcctagt

SEQ ID NO: 46390 - DNA, 1501 bp, Oryza sativa
agttcttagtctaacctgaatttctacgcttgggtgttttctgaaatttatatctcaagtataatccaaattgtcatgataatgtttgaagaaagaaaaacaatagctagaaatcctgagaattttggcaatctcttgtgcacgaagccaaactccaacaataatcagtagcatatctgccatgattttcatttttacctttgaaagcagctttccgaatggttcccagttcgttatgagttggatcgtcggaggcaaggcaatgttcacttagaccatagtctagacggtctagaccgcgtctagacgctagacgacgggttatcgtctagtttaggacctaaactgtgaattagaccgtttgaccgtctagtcggtcaactagaccatctagaccacacaattaaacaacatttagatgactgtagaccgtaaacctatcgtttagattgtggtctaagcaatagatgtgacatcccggcccaataaggattaggcctgtgtagcccatgtgagctgtgtccgcatgtttagtaccaccttgctagtttagcacgagtggaaccgacttatgaggcctcttccctccaaccacatcactcccgggttaacccttttacacgaagcaaggacgaaagtgtaagtggggtggtgtgtgtaagtgggcccgctcatcggttgggctgggctacgcggatctggagggagggctgttacaaatggtatcagagccgaccctcgcggttgcgcgtacgggtcagtgtgcgggcatatggcgcatggcgcatgtgcgcactgtgtgaggcacaaggcatggcatatggcatcgacactggacgtacggatgtgcgctaagagggggtgtgttcctggacatttgcctgtgtggctgggtaagttggaccgacggggacgtcgggtcctttgagggggggtgtatgcctgtgtggcccatgtgagctgtgtgcgtatgtttagtaccaccttactagattagcacgagtggaaccgacttataaggcatcttccctccaaccacatcactcccgggttaacccttttacacgaaacgaggacgaaagtgtaagtggggtggtgtgtgtaagtgggcccgctcgtcggttggggtgggctacgctgttctggagggagggctgttacaatagaccaatgcattttttttattgctggagctgaagcaacgaaacttcgagcccagaccaaagccttatggttttgaccccattccatatttctctcctctactcttggctagtcacggcaacgaaatcacgtcatctctcctctgctagtcgtcgcagtggaccttgctcccacctctctccaacccacaactttactcgagtggctgcccttatcatagcactgctagttctctaatattctgtgaaaaatgttaagcatattacgatgaatatattctgccaagaaaaatatgcatgaatatattacgatgcaaaaatatttatgtttgtaaaac

SEQ ID NO: 46391 - DNA, 1501 bp, Oryza sativa
tccaatcctagaacgtgctcaatcaatgaggggttcatatatagattatagcataatcatagaagatacctgcactctatttcttcaccaataactaattcccgtggaaaattgtcttctgccttaaaggactaggatttggctggctcatattttggattgcagttttcggtccccgtatagaatattctttcggctaattaataaaatttttgaatttttttaaaaatttcaaggtggaattttttccatccgaatttgtcttgcccatctgcttacccatcttgaattttggattgcattttcggtccccgtatagaatattcttttggctaattaataaattttttgaattttttttaaaaatttcaaggtggaattttttccatccgaatttgtcttgcccatctgcttacccatcttgcctatatggacgtgactaggtagagtgcgggttcagatctcctggagttgtggacgaccccaccaggtggatttggccaaatatagaccctccttttcttctacggctgagatcatatctcttaataattattataaaaaaaatctaagttttgcttctactccctccgtcccaaaatagctcaatctaggataggatgtgacccatcctaggtaagttatttttgggacagagggagtacgtccttaggcgtgtagcctggcgcagcggccatggcttgtcagtggcacgcggtgccgacgatggccagtgcgtggcctcggggatataccatacggttctcctgatgaaatgtgttgaatgttgtcgctctgaattgctctaacaagtcatgttgtgtgtggagaaagagatgcatgtttgattagtttattgcactacgtattgatttgttctttgtggaaagaatgtgccttgtattctgtttagcgagagcgtgatcataattatggaggaacacctgaaaactttccctccaaatcgacactaataaatgcaggggaggggggggggggggggaggatgccagctgtagaagcaaacggagggttcagatttagccaaacctatctggtggagttggcctcaactccaggggatctgaactcgcatggtagtgctttagtcctaacagtagaccactccattccatatataattctccctttagtatatggtgcatgtctttttttaacatctttaataacttatatcttttaaattacatattatcttcaagatatatttatattattgtactctacataaaatatatgataaaacaagatccatgttgaatatatttaaacattttattaatttaaaagtaatttatttaaattgtaactctctatagattagaagcaactaagttatgactgagttgaaataagaaattatatgtagagtaaattcacgagaaaaatgtagagaagatttttaattaaatgcatttatgaaagtaaattcaataaagtcttaaagtaatttacataaatcataaaagcaacttaacat

SEQ ID NO: 46392 - DNA, 167 bp, Oryza sativa
acgtgataaggagtgggtccaggtggctgggtgggttggatccaggattgtaggattgcaggattgtggatgaactcatactttttatattagtagagatgtaccaaacattacataagtttgtttggtgcgcggtatctccacatgtgtacttatctgattgcagg

SEQ ID NO: 46393 - DNA, 920 bp, Oryza sativa
accgggactaaagatcaaatatgcccgttaccctttttaaccgggactaaagatcatttttagtgatctttagccccggtttttattgcaaccgggactattgtggaattcggccgaccgacgaaagatggtttctccaccagtgagcagacgactccatttataggcagcaaacgagagttcgatgccactatattgctactagctacttattctatcaccaatttgcatgtggaagtaacatgcatcatggatggtaggctttggtttaggagtaaagaatctcacagaattgtgtttcgattcattcctcatgaccccatgcatgtagtttaagctagatcttttgattcatttaagccaacatgtctgctgatctgctctgacttttggatagtccatgccagtgaagcttgggaactagatatagttttatgattacacatagctagcgcactactggagagatgggcatctctgccggttcgcaaccccctttactcccgggtaatgaaccgagacgtccaattcgggactaaagatacccatctttagtcccggatgaaataacccagagtaaaaatggatctttagtccccgggactaaagattctagcgccattttagtccggtttcctttttttgtttttattcttgcatttattatcaccctcaaatccccacaaatcatccccaaatcacacaaatcacccccaaatcatgcacaacaagtcatccccaaatcatgcacaattctcagcccatccacgaaatcatccacaatccacaagtcattcagaaatcatgcacaacaaatcatcctcaaatctaaaataaactacaacaaaaattacaaatcattcaaaaaaaaatcagaaaacacgccaccgccggccacccggccgtgtgccgcctcccgg

SEQ ID NO: 46394 - DNA, 1501 bp, Oryza sativa
tcaataggcttatgagcaataaaaaataattcttaatgataatatgtttcttagcaatttaaaagaaaatgttagaaaataaactacaacgaaagaaaacataagatcaactccaaactgatgtttaaaattcaaaatttgaatgtggcgtaattataagccgaagggtaatcagtgggtggctagctaggagcatgtcaccattgaaagcccgttaatggagagatattgaaagataacctattatcgtaccctgctgacaaccaaattaagctagttcaaattaatgaagtttggagccaacagttgatcacgcacaccgactgggcaactgacatgcatgcaatctctactatgggctccttcagaatttattccatcaattttccccttttgttgaatttgttggttggctggttatgattttttagggctatttttcgcaccattgactattgattagaaatacctggcaagctaagtaatcaatttgcatttgacgtactgtaaatctgtaatcagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgcggtaaccgcgccaaaccgcgcggtttgcccgaatttttgaattcaaatttcgatttgtaaatttgtcgcggttttgcgcggttaccgcggttaccgccgtaccgccgggtggcggtaaccgggcccccagcggtttttgaaaccctgactgtaatcgtatatctgttattgtaatggagatcaacatgaatgtatcggagttgacttgactcattgcatttagacttgcaatgcaaggagaatatatatcacatgcatcatggatatgattaattaaaatccttgtgctgcactgctggctaagctagttgctgggccattttacttaatttggtacgtacaaactgcatggagaaaattatttaatgacgttgtctcaggtgatttatatatgtgtgtgtttaactaaatcagaagctatatttgaccttacaagcacaagaggaataacggcacatagtttgaatgaactaatatattatgtcataccaccctccatctttgaagtcaatacagagatatgataaacgacgaatacggtgcatgttacctgcacgcaaaatccagtgatcgatacacacagatatatacaagtacatatattagcaagcttcagcatcagttgcct

SEQ ID NO: 46395 - DNA, 870 bp, Oryza sativa
tctctatagaaaacacatactacaataaataagagaaaatttcatgagcatgagaaaacttcatgttgaagaaactatgagtgtgtgataggcaaggtggccattctaacataacaaatggttccatttcaaaacctaggacaatatattggacaataaaactaaatactagactctctttcttgaaagcaacccatagtatttgacaaacactttgatttaacaatggaaagtgaacattttgtgtacacttttagaaagcatgtgcttaattactcaataggtgttataatacattaatactatggatgttaatataattaaaacaatatttaggaccatggtagtatgatacacttaaaaatatgatgatatccaaatattgcatttataaacaagatcttaactggcagccttatttctttcttggtgtaggagatgaatcctatttttatatattcttttcactgacttgtaatacactactatgtaaatactatactcttaaattaagagaagaacaaacatgtactcacttttagttatacacatagggagaactacagtacttcacattcttttcttgatctcttaaaaaaggaagctctataaagaaagtaaagctaaggataaggataaaaagaaagtactatgatgaatagcttggaagaacctagtatatgctaatattagttgaattgaaaacaactattaaaacaagaataaaatgttgcattaatagtcaaaggctgagacaaagcacataagcatactctagaatatacgaaacttttaggaaatctgaaaaattttcaatacaacttctatgttaaaaaaattatatattgtgttttcttttaattgtgtagt

SEQ ID NO: 46396 - DNA, 1501 bp, Oryza sativa
cattatattccagaattccatttggcattttttcaaattaataacagctcatatcattccatccatatactattacttattgaagtaaaaaaacggggcacagcaagttcaagtgtgtgtacgcatgtatcagtacgacattattatcattattagattattatatatgaaaaatatataagtagtgtacatagtacactacatgtaaacattgaaacgcattattacattatatagtgcacgtacgcatgcagcaagaaaataaacaaagctagcagtgaacagtcactctctagatcttcccatacatatcgatctcagctggagatgatcaagctagtaattagttgatcctgcataaaaaaggaaagaggaaattagcttaattaggccaacacatggatggagcaaatgaagatagagagagagaaaatgtagaatacttggagcagtcgacggaggtgctgatggggaaggcgacggagacgccgcatttgctggggatggaggcggcgttgcccatgttgaggttcctgaaggaggaggccatgttcttgaggcagctgcaggcggtgcggcggtcggccgacgacgaggccttgccgttgagggtcctcaccccgctgcagcacgacgacgacggcgagctctccctccccatcacgtacgacaggcacggcgcgatcgacgacgtcacgtcgccgcagctcaccgccgccgacgccctctccgccaccaccgccgccgccaccaccgccaccaacgcaaccagcgccatcgtcctgcgagcacccgccattgtctcgatcgagatctagctctagctaactagcaacaatgtacactggtagtgagctgtaagctagagcttgtggtggagtactggagtgagcaaagctgtcgaggaggggtggtataaatagctagcgatagatggaggtggagaagaaagaaattaaggccgggttaattaggttagcttagctggttagcgataggaaacttccagatcggccggccggccggagatgggagatgatctactgtgtttagctaatagtatagagcgtgcatgcatatgcatatgtaccagccggtggttgcgtattgggaccctcgggatctgtcgatacgtgcgtgaatgcacgcatgtgatccatccatctttgtttgcatgctcaggaacaaccttcttaattgccaccactgttatcttgcgtcttttcactccgcgaatggacttcaccattttttttttgacaaattgatctttttaaaaaacttatttcgaaactagccactgccaaaaacttcaactatttccgtcggctcagcgctgaggttgtaaatagcagcgccactggacctgacgctgacctcgtgccagcgtggcggccgagccgacccccctgccgacgtggcaagaacctcagcgccaatcgcttcggcactgtgttgcccaacctcagcgccaaccgcttcagcgctgagatgcccaccc

SEQ ID NO: 46397 - DNA, 1501 bp, Oryza sativa
  unsure (1)..(1501): unsure at all n locations
tatcaaacgatgagagttgaaattatgatttgaggtgcaccagtaaattgaaataaattcttgggatgtccttacgaatatatgggctagggttttttttccatcccaaacaagtcctttaatctttttattgggttgaaactcaataaatatatgatagatttattacaaaatgctagctagccaactaggacccaggtcaatgaatagaacacaagtagataagaaaaataaggggagaaataaaaaaagcgataagttttattttagcggtaaataacacattgagcctcatagttgcccacctatccctcttccctccctttccctcgtgatgtaaaaaaaatatactctcacaagcattggttttgtcctacactctccaaactcccctcggacccctcctgtccctctcgttcctaccctcctctttggcactctctaacctcctgacgaaaaaaaagattactctcaacctttctagagtataaaaattatcttgtaactccccttccccacacccgctctttttttttgagaggccacctcatcctcttacgatgaaaaaagaagtatcccttgtttatgaacataaaaagaatataaatcttggtgacaaaaatattctttcacattaagaggaaagagtggggcatagttattaggaccggactggcggtccgaccgggaaaaaccctaaccatggcctcggtcggtctggtccccttaaaagatcgactgcgcaattgaaccggggagacccattgaatcgtgcagtttttatataaaccgagctttgaaccggagtggtaagacctcggccggtccagtccccttaaaccggggaaaacccattgaaccgggcgatntttatataaacccggctttgaaccgaagtggtcagacagggtaacaagctactacgcttttgttgatgggctgatgcgaggcccaatgagcaaactccatcaaaagccttagcccactgagcaaactacataaaaaatggaccttgggtggcatcgctgagaatagcatccactaccacacactttatctttacactcttgaaggtacccagcatttgcgctatattgtacattaaaccgcggttggaccggcctaaccaatggtcgaaccaccagactagtgaaccgagagctcgactggttaattctccggtccggtcttaataactatggagtggggagtagaggggacaaatgaagagcctgctatacagaactaatgtatcacataaaggtgagagtagtttttttttcataataattaaggcgagagaaggggagtgggtatacacaaacttatgtgaggactactacttacaataaacatcccattgaactgtgtacaatagttctttgttttgttcttttcttcttctttttttccattttacccctttttttctgattaactaatcaaattttgtgtggcatgggcctggcaaaaggaggtaaaaggatatagagcattctcc

SEQ ID NO: 46398 - DNA, 317 bp, Oryza sativa
catctttaatcggtcgaccgaaatttacaatagtctcggttccactaaaaaccgggactaaagatttagtcccggttggtggctacagcggatatatttgatatcggttctaaacctatcataccttgtcaggcccccggatctttagtcccggttggtaacaccaaccgggaagaaagcgcatgcaccagcccacgcttctctctctgaatcatgtgcatgcgcaacatctctccatgcttatctctttttcttctccttccatcctccccttgctcttctctcaccccctctcctcctcccctcccccttgcaga

SEQ ID NO: 46399 - DNA, 1501 bp, Oryza sativa
actgtgacacctacttcttcctaccccttggagcacgaggttgatcgggagtgtacctccagttgaaacatgagctatcttgtgttgtggtcgagatggcccctgcaacgactgtggagcgtcctacagctaggagggaccgagctccacttgctcctcctcttcctcctcctctctttcttcctcctcctctccctcttgtacaccctcttgagccactcctcgacttgtcccctgctcagcccgtcgaggtggttcgaaggcatcgtcggccctgcatcccagacatgccgccaacttctgcatcgctgtcatagagtctagcaccaacagaaggaagcagttagttccaattatgtgtgcggtgcacgaattttacaaatctacctgtaatgcattccgaagaatgctgctctcttgttgcgagctagggggcatgccaagtgccacgcccgcatcgttgactgtcctgatcagctcccgtgtctgtaggagaagttataagcacgaagtacagaaattggaaaacgagtaaatagaacccatactcaccactttgtctcgaaccggacccatcccgaccgtgctacctctatgggtacttgtatcgtacttgttctgctcctccacctcaatcaggtcatccagtatgtcggttagcgtccaagccagacgtagggcactgcggtagttcctcgcgagccaggctaagtacgcgtcgaactcttacctgttgtgcatcgcgttatccggcatgcggttggcttcgaactggttccatcgatcgatgtgtgtctgatgataagcagtccaatcggtggtcttcttgtttttccttctgtccaccctacacgcaagacatagtaatatgcaattttttaatgacaaatgtgtaaataggaccgactagatgaattatccaagaattgaacctgatttctacgtatggttatcggaggcaactggacttacttatgaagttcgatacttgtagagaatctttgcgggatcgttggcgctgagggtgggcatctcagcgctgaagcggttggcgctgaggttgggcaacacagtgccgaagcgattggcgctgaggttcttgccacgtcggcaggggggtcggctcggccgccacgctggcacgaggtcagcgtcaggtccagtggcgctgctatttacaacctcagcgctgagccgacggaaatagttgaagtttttggcagtggctagtttcgaaataagttttttaaaaagatcaatttgtcaaaaaaaaaatggtgaagtccattcgcggagtgaaaagacgcaagataacagtggtggcaattaagaaggttgttcctgagcatgcaaacaaagatggatggatcacatgcgtgcattcacgcacgtatcgacagatcccgagggtcccaatacgcaaccaccggctggtacatatgcatatgcatgcacgctctatactattagctaaacacagtagatcatctcccatctccgg

SEQ ID NO: 46400 - DNA, 1501 bp, Oryza sativa
atttatttgacatctactctactctactgtacaatatcaattttatttattagcacatttttaagttgaccataatctaatcatttgatattaatatattttattaaatagtgagttatataccattggaaagcttatgaatttagatgaatttaggttcaagtttcactcgaatcggagctaaaatgaataagttatactaatttaaagattcaaatttgagttaatccgagaaattgtaaaaatgcactgttcataaatgatttatttttaatcggaaacattatccaaaacccactgtggttgacatgtgggaccggccctggttgacttagggtcaaacctgcttgtttaattaccattgggtcccgcctgtcataggaataaaatatataattgtgttttcttagattttaactatagggaccccacctgccattgagtgggataatcaccgttagggataggattactgtgcgctaatgacatgtgggtcccacatggtttctctctctcctcatcttcttcttcctctcgcccgttaccgagcgaggcagaggcgtgactcggcgcagccggcgtggccggcccgagccgggacggcggcgggcggctcggcgagggccggggtgaggcgcggaggagctccggcgatctcccgccgatggcagccggcgcgcgaggagacgggggcgcgcggcgccatcaggcgacgccatgcccgagctcggctacaaggggcttcggtgctagggacatcctccggccgaattgaagggtgcgggagcatctacggggtatggggattcgatttcacgaactatatggagaggggagctgccgggatagcctacccacggagagctcgccggcgacgaaacggcggccggggcggcacggccatgggcgctaatcgccgattttggagccggcgctagcaattagatgtatggaggacgctacgggcgcgagggtgtaccgcgagacggcgagatggcgaaacgcggcgaagtggagctcgacgcggtgcaggacaggggcagacagcggcgatgtaaggtgctcgacggcgtttcttgatgtccagcggctacctggcttcccccatggcgacggcggcagcacggctcttcctccactccctccaacctccagctccggccggggagcctcacaatggtgatctctagcggtggtgagagggtgattgcaaggtgttcgatgaaatgcatacgagaagaaggctgagagggatggggattttgttgagggcttcgcttaggatgcaagcaaactatggggataagatcaccagcacatgcctaggcgagctagagtactaatggtgatcggataagagcaatgaggtggatgacgcggctgagattcatctccttctccattaaggttctgtggcttaatcatcacacctataacctatagactgcaggtctgggtgctagctggaggagagggctccgttttatccattgggcatgga

SEQ ID NO: 46401 - DNA, 241 bp, Oryza sativa
gtatgccatatggaatgtccatcaaccacgtgcatcaactctagcctaagtatcccgcatgatctctgaccaccacggacgtcatcttatccccaagccgactcccggtccatcaccgcaaatactctcccgagacatcgagtcacctacacatgaaataaacaaagaaaccatattctgagaccaagctatctccaacttgactcattagtagcaaacaacagtattacatacgtatagg

SEQ ID NO: 46402 - DNA, 334 bp, Oryza sativa
attaccaactcctggaatcaataatttggacccaaccgttctagataacaacaactcagacaaatattcaaattcactcctgcaagacagaaaattatttgtaagatagaaatatgttttcgcatttctactgtacacttggacattagcaaaacaaatttgcaagttacaatgcaataggcaaaacaggtattcacaacaataggatctagcaaagaaaacatggcattgcacttcaactcatacagaagcatggaagtattaaaggataaatgaggattgaactatcaagaagatgtgttcccccaactgcattgctactccatacaaatca

SEQ ID NO: 46403 - DNA, 345 bp, Oryza sativa
tatgttgtgcttcctgtggtcactagcttaatacggtgttggccttggtggtgtgtccaacagtgtaatccagagagaactccattgacaattgtgtaactgtcattatcaaatagtggaatttttggagagggccgagtagcgtcccgtggttttttactcctcatctcgaggatgtttttccacgtaaatcattgtattatttgtgcaagttgctttgatcctttataattacttctgcagcatccttcacttctagagatgggctaagtgaaaggtttggaactgtcaatgtcatacatgaccgtcttccaaatcatgcatggtcgtgtgtatgtgttacac

SEQ ID NO: 46404 - DNA, 1215 bp, Oryza sativa
gctgatatgatggcacttggatccaaacatcatgaatgcgctcaactacttgcatgttccaagtgtacaacatgcatgctagctgctacaaacgactagctctgttaggccgctgctaatcattttctcatcactaatactaacactgtgtgactagctagctaaaccagccctaacaaccaaccaccctgattcaattgaattgaattgaataacattagacgcaccgacgactaagtgcagtcccaaccctccacctaaaatggtgtctatatatggcattaactaaattgtcatgtatgacttttaacttatgtggcactatattaatatattaattaagaaggagagtgaagagaggaagaaactgggtctcatgcaagacacagcttcaacacgagaatctatgcactagacactatcaagttttgcattggaagagaatagtgtctttataatagttgaagaataaatatgattggtagagaagagagatgatgtatttattaatggcccactttaagaaatcatgggttgtggagtgtagtttttattgtgatgtcttattgacatgacaccatagacactgcttatggacattatgggttggaactgccctaagaacggtgcctaaacactagcactccaagcttaattacactatgtgtacgccaattagaaaatgtcatgaaacattctataaacaaattagatatttactcctaatagtattatacatatctggaaagtctcatactcaaatttaatatattttagctgtaacataaagtgaaaaaacccgacagttttaagggtaaaaatgtcaggattttatctttcttgttatggctaaaatataatgaaactaaagataagatttcacatataggtgtaaaactattggaagtatgtgtctaattttttctagaacttttgtggcatttgctaattgatatgtatagtgtgtacataagtaaagcttctgtgtataggatatgttctctaattataattataggtggactatatattccacgtagtaactacatttgacttggtcgatgcatcggcacagatgaaatcatagctacttaaagccccctacattcccgggaattctcatcgatcgatctcacctgcagcagcaaacgagcaccacacaccagcagcagcagcaagtcgatcgatcgtcagcacacacgaccaagatcgaga

SEQ ID NO: 46405 - DNA, 1501 bp, Oryza sativa
cagggattggtactgataaacacagaagatttccgatttacaaaatcgggggtcgacatgccagatctggcggaggggagggccccgccatgttgccgcctcccttcccgctggatctggcggagaggagggtgccgccgcttccgggccgcttcctcccctcccgtcggctctggcataggggagcacgccgccgtgctgccgctggaccaccgcctcccctcccatcggatctggcagaggggagggccccgccatggtggatggaggaggaggagaggagtgctgccactgttgtggatggaagaggaggagagaggagaaggaagaaatggagagaaagaaggaagaagaagagaggaggaagtggattgcgggtgcgggagatagagttcgagagagagggaggggaggaagagataaggatgggagtagatagggtggctcagctcggctcggttagttcggcagataggtgtcggttttaaaaaaaccggcacttataatatattataggtctcggtttttaattaaccgacacctataatatattacagatgccggttttttcttaaaaaccgacacccatagtataagtgtcgatttttctttagaaccaacacctatagttgtttaaaggtgtcggtttttttatgttttcatcccgttgaggtttgaaaaacattatatataggtgccagttttagcacgtccggtacctatagtgccgatatatatgtccctttttgtagtagtgatccctcggaataatagtaaccaaacaatattcttattctgcaggtgtgaacaaattaaacttagttttgtcttgatcatctgccaactattctttttaaggttaactgtcgactactcgcatttctcatatacccatcctcctcgtggaaaacagttctcctcctagactatgtttagttcctaaaaaaagttgaaagtttagggaaagttagtagtttggaaaaaaaattgaaagttcatgtgtgtaggagagatttggatgtgatgtgatggaaagctggaagttgggggtgaactaaacacggccctagtgttctctcgttccccaaaattaatataaatatatttactctttctacacatttacatcaacacaattcgcaatatgcgaagatcgtttcatattgccttccacgtgtaccgtaaaaggggagcaaatacagtcgacagtggatggaggggaatagctctggttttcccaacagccaaccaccagctgctaagctagctcccaatcgtattgaatgaacgtatggacacatgcaccgtttaaacaccacaaacccatccttgctttgttaattgctcgatctcttgcagctgcgtgcaccgcatctgtgcatgcatccacactagcaactctacctatttaagcccctgcattcccgcgtattctcctcatccatctcatcagcaacgaaccaattcacaccgatcgatcgagcaacagtagtaggaacca

SEQ ID NO: 46406 - DNA, 498 bp, Oryza sativa
tcactactactatacttgcttctagctctatagagcattcatcttctaattaaggcaattaattattcttttgaacattagatttgatttttcgctaataatatatatatcgagctttgtttcggttgaactgataaatgttgatcagttacaattatatatatttagctaggaaaattaagtaactggcatactctctcagttttgtaatataaggttttattcacttttagacattatatttgattgtttttattttaaaaattagtgtaaatatgaaaaaataaatcttgaataaagtaacctttagtgtaaaagttttttttaaaaaaaacgatgcacatataaattaaggttttgaaggaaacgaatgatcgatctaacattattttcaaaagttaaccgtaccatatatttaattaaaacggatataagtatactgcaacgtgtatggaagcgatcgtgtgtgtgcggttattctctaccggttccctcagg

SEQ ID NO: 46407 - DNA, 1358 bp, Oryza sativa
agcaggtagaataacaagttactccctccgttccactatacaaggcgtaattgctttgatgtaaaaaccaaggaagctcatataactaccgcagaattagggggctttaaaacaagcagagcaaccaaccaatagttttcactgcatgcatgcatgtgcatggatgagaattacaggattcaaagaggcgcctctgcagcttccttcaatgcatgcatgcgcatgaacgagaataatggagtcaaggaggtgcggctgcatgtgccgccctatattgtactggaacttgtgaaaaaaaacagttacgccttgtataatggaacggagggagtacataattaagtaagctgaacgaagctatacgagagacactctcactgaacgacgagtagtagtgattactactcgccggttaattaagtactagtcgaacactaagggcaccaacaatgattatctataggctctctacaagagatccatgtcagcatattttcctatttgaaaggtattaaatgaagagagagagcaaagctatctactaacttagagatagtctatagagaaaaacgaggcaatacatgagagagctactaacttagcaaaactatctactaacttagagatagtctattaagatggtttactattaatcgagtctattgctgagatgtacatattttatagataacaccttactttactattacggatgcttaagagtattatatgtatatgagagaggaatcaagtattaatggtgctgtttgattagctatagaaaattttaagatggcatttaattagctatactattatcaaacttattttaatggaacacatattagagcaagtttaatagtatagccaactactagctccaattcatctatagccaatctaatagctcatttgcacaatagttacatactatactattaatactgatcccacttgttatacatacaccgtgtcttggagtccgtgctatagctggctacaaatctgtagcccgctgcttttctctttttatttatctccttaaaatatgtttgcagctggtttatagcttgctattgtactgctcttagtatatacatcattgagattgagaagagtctagtatagctagctcgatggagtccaactcccaacgacttagcagcgactgccatcaatggatgtatatatgattccatctatcatccgcatctcagctcgttgcccagcatcttcctatttataccctccacccatcgaccgacgatccatcgatcaccggcgacgagagacactctcactgaacgaagctacctagcttaattacctagctactcgatcgatcatcagtctagata

SEQ ID NO: 46408 - DNA, 365 bp, Oryza sativa
tgttgaagatgaattcgctcgatagagagatcatattaattccaactggatcgcccatgatgtaattaaatcacctgatactgatagagaacacatgctgtagtacatcattgagattgagaagactctagtagagtacctatggcgatctgagtccaactcccaacgacctagcagcgactgccatcaatggatgtatatatgattccatctatcatccgcatctcagctcgttgcccagcatcttcctatttataccctccacccatcgaccgacgatccatcaccggcgacgaggagacactcactgatataatcaagctagctagcttaatcacctagctatccgtcagtttagctagata

SEQ ID NO: 46409 - DNA, 1501 bp, Oryza sativa
actactacacaactgatcttttatcgggatatccatttcggatagatttagaacgggtattagagatatttttaagcaccggttaccaaaaacatctttaattccgattggtgttataaccggtactaaagatgcctacagggctagtttaaaaagaaaacatccatatccatgtctgatgggtggagttggtggatggttacacgcgtgagggctgaggtgagagatcttgagttcgaatcacatatcccacacattttttttatttcgtatgcatctttagtaccggttatttcaactggtactaaagatcgagatatttagtctcgatttgttagaaccggttctacatctaaaacggttcccaactggtgctaaaaatgggttctccactagtgtggcaatacatttacattcacacattaaggattcacatcgtcacccatattcacgttgacactgtcttttaatgtataatttaaatgttcacattgtgaatattcgacaatgatagggagcccgatccctatctacaagtctaaacctaagattaatttgatcgacatgagctaatgaatagataagcgcactatctattgcttgaaatggtagatccattaatttccttttcatatatagattattgtaaaaagttgtcgttggctgattggaaatagacttgggcatgaaacctataccctctgcaactccacgtaatcgaaaatcatcctggaatagacccaaggatgaaatttagaccaaggaacgaaattgggcatctataagtgtggggagacaaaaataaacggtttcatagagttaaatgatcaaagttggaacaatattgcaatagttgatgattaaattaattaatgtggacttctttaaaccatatatagactgtgttcggcagcgctgttcctaacactaccagtacgcacgaaaaatgaaacggtccattagcgcgtgattaattaagtattagctattttttttaaaaaaaatgaattaatttgattttttttcaaacaactttcgtatagaaactttttaaaaaaacacaccgtttagcagtttcaaaagcgtgcgcacgaaaaacaagggaggagggttgagaaaaagggtgccgaagtattgtgcgctagatactggtaggggcattgttgtccatcctcggaagtggctcaaatataacgtgccacgacattagcgccatttcttacacgaaaacgaaacagggaaaactaattgaacaaatagagagatatgtagctagctagctttcagagtccactttttgagagagctcaatccaatgtgtggtttggctgcagcgacgaaccagaataatctcactctgctggtgcacccaatcaccaaatccaaaggaaattcaatgtacaacaaaattaaaaagaacatcttataatttgtctcctcctcctgcatatgcttgactcctagcttaactagaggtacctgcagccagccatgcggcggc

SEQ ID NO: 46410 - DNA, 338 bp, Oryza sativa
agttttgtaattagtctatgtttaatactctaaaatagcatctaaacatctaatgtgatagggactaaagttttaggctgtgtttagatccaggggtgaaaagttttaccgtgttacatcgaatatacggacatacatttgaagtattaaacgtagtctaataacaaaacaaattacagatttcgcctgtaaattgcgagacgaatttattaaacctaactaattcatcattagaaaatatttactgtaacaccatattattaaatcatggagtaattaggcttaaaagatttgtgtcgatcttgattggttgctacccaagactgttctccactggc

SEQ ID NO: 46411 - DNA, 587 bp, Oryza sativa
accccacttattttatatgtcccactatagttgtgtgactagcttaccagagaatgatgtgggtttaatgttcatgcgaatgattgctctatgacattgcagaggatatagagtaatattgatacgccccgaccaagaccattcatacatagtgtgattgttgcgcatcaatgcaaggctaaagctatgcttaactccaaatcttattgtgttcatcacgaaaggctgctacttggcttgtacgattgtaggttacagcatattgttgtacttaaagagagagacttgactcggattaccaacactacaccaaggcatcgtaatcgtgcaccaccgttgctatcatatgaacgtaaaccatcaattggactagtgctaccatctcaaggaccgactacaccaagtcgtgtggttactcccatcactaagagatcatgccaagcatggatggagtactcaacatcattcaataaaaacacgacaaaaggttaattcgtttcttgctgaatttaactttagtattgatgtgaattttatactatctaaatggtgtatatttgatttgctaatgttcataccaaaggaga

SEQ ID NO: 46412 - DNA, 325 bp, Oryza sativa
aaaaagttaaaacctaaatacatgagatggtacacgagaatgcttcatcttcataacttgtccctacaatccaatttccatctgaacacgaataggaatccttcgtctatatgatgcgaccatgtagtggcatagagtaaatgaaattgtacccgttcgaccatatatcgatatgggagaatagagtagaagaggtacacagaatcaatgccaggtttgtaagaacagatgacattcaaattttaacaaattcgcaatggttcatgagaggataaatcatacaaaaattcagttcaaaaaacagtccattgggtacctccatagc

SEQ ID NO: 46413 - DNA, 192 bp, Oryza sativa
aagcaaacaaaattgggactgccaaaatatttgttatttgtttggtttgtggcaaaaaaaagttgccttgccaaattatttggctcagttcaatatgtcaagatgcaactttggtagcaaaccaaacaaagactagacaatttttgctaaaaaaaaagcactgccattgcccaaaattggcaaggctagaaa

SEQ ID NO: 46414 - DNA, 193 bp, Oryza sativa
actctcaataaacccgaagcaaaggggagaggaaggggaggaaaggtgcaggcctcgcttctagctccaaggaagctagatctgggcaagggccaggaagagactaagggcaaagaggtcaagaagaaatacgttgctccacaggagttcaaactaggcatgccattggttggagatgacgtgcttgccacaa

SEQ ID NO: 46415 - DNA, 456 bp, Oryza sativa
gtcaggccacgtgggtgattgctcctgcccaaggctctagtcatgatactcccggtcccatgtcaccgacacatatggacaaaaaatacgggaaggcgtgtcaagagaagtcctgagccatcgacaggaacggggaaaattagtcctggtggatgctggctgtttgaggaatcttatatacatgtacagtccttccttttttggttctaaaaaatgaaactcttttttcacaacagttatgcactaaatttgaaaggtgatcagcataagagttaattaagagtttggatctaaattatgattgaaggtgttttaccttattaaaattctttatcttttagacaaattaaattcatatagacatttgtataataccctctatgtcatataaaagatggaggggtagtataaactagagggaagatagatactccctccttttttcaatatggaaaa

SEQ ID NO: 46416 - DNA, 320 bp, Oryza sativa
tcgagtctttataaaaggcctaaaggaagagtgtcatctgtgacgggcaccaaacttatctcaatcgggcctcaagtatagcccgtcatagataagtgtcatccgtgacgggctttagttttatgcctatataccatgactgtgcgaccatatctcaatcgggggaaacttcggcccaattaagattacttccttgtgacggcccgcaaattccagtcttgttatgggccgtcacagatggaaggatctgtactagtgtatatgtccgtcctcctccattatggtttttgccttttctcatacactgcttcttctccaga

SEQ ID NO: 46417 - DNA, 281 bp, Oryza sativa
tcgtcgtgctgaacctgtgatgttgctttgcaggcttcattctgcagggcatttgatagacatctgcatgagcaatattggcttatcacatttcgaccctgggaaaggacatcatttccctgatgggtatggttgcttgttttggatgctttattctgttgctccataacaacaattgattactcttggcctttgcgtccaacttatcatgtgttctcaaactaatttggttgtagttagattattgtgtgcacaattaagtgttctttgttcactgcaga

SEQ ID NO: 46418 - DNA, 208 bp, Oryza sativa
cacatgacatgatccgtcgatcctgcagccacggaattaattaatcataaaatgcccggaaatgcaaccataaactaattattaaagctaaatatttgagaacttttacggtacaatatactaacagtatatactgcaagtatttacaagggtattataggaatatgctaaaaaaatgtaagggcaatttagtaattctcttttcaga

SEQ ID NO: 46419 - DNA, 1384 bp, Oryza sativa
gagaaaatggacatttcgccacgttaaaaaaaaaaggtttcgctaaaatgccaatatagagtgtgtgatcacagccacttagctattttctccattttcgctagaatgcggtttgatgagaccaaattgcttctctcactgcttgatgagccatgaccagctcgcggcggagctcctggcaccgacaatgtcgacctcaatgcctagcctcctaacgcaagccatgcgaggctagcgtgcacacagccacggtcaactccaccgtccgcggggaggtggtggcgaggagagcgctagttaagcacttggtttggggccaccgccgcggatccgcacggcgagagaggggcggagaagaggcagctgagggaggcgaacgcggccgccctggacctccgcgagcgctagtcagggaccggagacgaggaactgacccgccgtggggatgtacggtgggagggaggagacggtgcaggcgcggtcgacgaacgcggcgtgagctagcgagcacccgtgcgccggtggatgtgcaccccgctgcttgcttggtcggtgaggcctcctcgggagctaagcttgtatgcgtgtggctcgagggcgagggatgaggcactgcgcagtggagggaggtgtcgtgccgctatgccttagattgtagccaaaataaaccttatcaaattttgtcaatttggcaatattgccaagttttgacatgatttattacgtatttactccctgcatcccaaaatataagcatttttagcatagtgacaagtcagacattttcaactttgactattaatagaaaagataaaaaagatcattcatataaaattaatgttattagatttatcattaaacaaactatcaataatgtataactctttttatttaaaatattttacttttatagatattattggtcaaaaataatatctcgttgaccgtgtcaaagtctaaaaatacctatattttggaacggagggagtactaaagtttgataaaaaaaactaaattaatgtacatatttaacaacttaaaaaaagatatgatttaaaatgacatcaagctaaacatctgaagctaaatgcatcgttcggtgtgaacctgtatatgttttggccacgatctagaacatggtacctaccccttctattagcaatttagctgctcttcttgtttttttttccttaagttcgtggggagcttggaactttcggagtggtaggtgtatctgaaagtctgagatgtgccacgcctcttttcttctgtcctgtcttcatctcctacctaacccctgcctgcatcaaccctcatatgttgtccttggcgaataaaaacatttccctactcacgctctttcgatcttcagctcctctctatt

SEQ ID NO: 46420 - DNA, 815 bp, Oryza sativa
gcatgctgcaaacagccaagttaattttaggtagccaataaacccgccacaagctgtacagtgtaatattcagcttcatttccagaagtccactttgctacacttcggttttaccgctagactgtagttccaacgggtgagttcacgtttctcaagtaacttttttatctatctgaatattgtttattcataatttcatatttctaaaattaccttctgtggtgtttaggccaatactgctgctaattctcaaagtgaagactgctgaactgtgaatttcgtaagaactttgagtcgtattaaactattaatgtattgatacgcagcagatgggagataatcttcttcttgttctgaaatgtgcctgttccactgagagtcctcgtttttgagtatgtcacaatcattgtggttaggactttggagaagtgcattgtttcccaacatgcatcagacaaaatgaaaatattgggtttctatccatttccattgcaatatgtgaaattttggatgtctactccactgaatgtctgttgtcagtaaactgcactggctaaattggctactgaaatgcagaaaaggagaatgaagttgaactctgtcctctgcctagaagtgatgaactaaatttcaatgtggacgcttcgctagatcagtagcccatgaaaggtggaatattcagcaagtaccaaagcaagtaccatggtgaggagctcgagaagctgatccagatgggcaaacacaaataggattgcagaatgcattctttcttggcttcatattgccagatggtaactgtaatatttgctatacaa

SEQ ID NO: 46421 - DNA, 1495 bp, Oryza sativa
cgagatccaacctcccacattttgcatacatatcaatgagtgcattgccaaccaagccatcagatacaatgcccttgctctgaaggtttatgtggatgtctgtccccagctccagcttgccatcctttgcacaagccccaaggattaatacaagtgtaagctccgtaggttcaatggcattctccttcatttcttgaaaaatctccaatgctttggtatatttgccgagctttgtgtagccacttatcaaagagttcaatgaaacaacatccctctgtggcatttccctgaaaagccttgatgcctcatccatatacccgatactaacatttcgtgcgatctcagcattccaccatgacaagttcctctctggcatggcttgagagacgcgctctgcacccatccagtctgcagcggcacgatgagccccgaccaacgcattccacgagacggcgttcttgtcaggcatttcatcgaacgccttccgtgcatccccgaggcgaccgaacttgccatacatggagacgagcgcattccgcacgtatcgatccttcccgcagccaagcttcaagacacggcaatgcagctccatccccttggagacgaagaccgacgcgacaccggcgcgagagctgcggttgaatgcgcgagcgcaggatttgagtaacgcagggaaggtgggtagcggggtggggagggagcacgaggaggcatggttgaagaggatgagcgcggacgacggggccggagaggaggagaaggcgacgatgaccgggcagacgagcgacggcgagaggacggccggggaggcctcgagcagaagggagagcgccgacggcgaaggcgggatgcgagagaggagagcggagaggaattcagggtggtggagcaggccgagcttggcgagcagcgcgtggagctggtgaccgccggcggcgcaggaggcggtggtaggaggcagtcgtggtcgtggatgtggaacgcattggtgggctcgcctagtgggccgtggtttggttagtgggctaagaaaaagcccacgaggccagcgaatggtcgcagggggaaaggaggaaaccgtggcttgaagccgcaggcagagacagcgtcgtctcctcttcctcttcgtcttcctgccgccgccgaggagccgagcaaaatccaataatccatcatcggagacgagcaggagcacgcgcatcaatcatcgtagagtgactcatcggaggaggcgtgaattccacctatccttttcttttccccccttgtattctcttattattgaaatcccaaccccataatccgaccgtacccacccgccccccatcgccggcggcgcccagatcgccaccgatcgcctccaccaggggcgcggcgcctcttccgccctctctcagcggcggttgctccacgtctccggattccggaagaggagggagggagggagggagggagggagggaggaggcaactcggggcgttggaccgggctccca

SEQ ID NO: 46422 - DNA, 320 bp, Oryza sativa
cgttcatgtaatatgtgatatgtttactaccttggcatcatgttctttaggagccaaacacatgttccaatggtgcataacatgctcactgctagttgttctatgaggagtgctccttagtgctcaaccctaggaattggcatggcattagataggcaatatgggattctctgattttgttgtgacttatgtacaatacttgaaaaagaattattgcttgcgcttttagtcctctgcgagcactggtctctctctctgtgtgtgtgtgttgaatcatccgacatcgtgctattaaaaactacaactttaacctttttctt

SEQ ID NO: 46423 - DNA, 296 bp, Oryza sativa
cggggggactaagaggagggcgaacgcatcaccctcgggcccgacgtccctcgggggtaccagaccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaa

SEQ ID NO: 46424 - DNA, 155 bp, Oryza sativa
tcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatcttcagacgaaacgaatcgcca

SEQ ID NO: 46425 - DNA, 353 bp, Oryza sativa
ggggataagacgacgtccgtggtggtcagagattatgcgggatacttaggctagagttgatgcacgtggttgatggagattccatatggcatacgatggaggtattgtgtgtgtatgggatgcggagtcgaatttggaaggagtccaaatttggtacgattggttatgtaaagtttctttcttgtactagagggttttctaaggtgtttaggactcctagtatgagtttggttcctgcctgcctcgggtataaatagagggggagcatgaggcttcccggtatcgcttttgaaagcaattgagttgagttttgagttagggttttgagtttagtcgaaatttctgtaaggagt

SEQ ID NO: 46426 - DNA, 671 bp, Oryza sativa
agcggcagctttcgcatttctagctgtgaattgtaccgtttgctatttaacttatcaactgcaacaaagaatttaatattaaaaaatatttctatagttgattttgattttttttatcctaatttattttttagcattgaatttttaagtcgttcagaacacattataaaagttttatcatcatttttttttatcgttagtaagcgttatgacttatagttagttgtatgcaaaacgataacaatattaccttaatagcttgttagtctgttggttgtcaccttgaaaatgaagtttaaaacaagttgactttagagtatttttatccttgtgtttttaaaaattgatttttaaaccactaataacacatactgttttagaagtttttataattatttcacggtttatcagccctggcttaaacgaggaggaaacaaaaacagatattatgaactgtaaacactctgactttgcttggtgtagtacttgctttggagcaaatgcaactataataactgtccctctgcttctgtgtcactcacgggccaaagttgaggacaaattgttcttaaaaaaattggttcaggacaacggagtgacattgacaacagtcaactgtaggagtaggacatagcattaattaattaattaatttctctccgttttctagg

SEQ ID NO: 46427 - DNA, 162 bp, Oryza sativa
ccactctggcgccccataaaggaccatttttgggataagtttttctaggggtctacttgccaaataagccttttaaaaggaccaaaatgtgaaaaatcctaccgttggttgggttgggacgggttcgggagcacgtggaatatgcccttgccctcctgtagt

SEQ ID NO: 46428 - DNA, 686 bp, Oryza sativa
ctgaccatgtgagctgtagtagttctgctgttaattgatataggccataattgtccttgcacaagtattaaggaggtgataaaattccccgcaaaaaaaaaaaggaggtgataaaattgagaatgcttactaggaatttagttctgttatgtaccatctcatgattgtttttggaggatgagggaatacttagtagtttgtatgggttttaacgaaagctgcatactgaggaaagataataagcaggggcatggttgggaagctcattccatcgacatgcaggcattataaaatcagaaaatatctcaaatatatacctttaaattttcaattgaggactgattatcatatcagattatcagctatgatcataagcattgcaagctagaaattgtagtatggtaagacggtaatgtattactgttctggcctactagttctgtgaacaatttccattcagtaggattctgtagagtttaactgggtatttccttccactaagcacataccttagataaagaattggattcttgaattaaaaatatcagcctgttccattgctctattgtggtatacttgtttttgctaatgtcccatttatttcgactttatgattccataactgttgttgtcatgttatttattatagattctaatattacgctaaaaatggttatcctttcagg

SEQ ID NO: 46429 - DNA, 240 bp, Oryza sativa
tattatagtagtatgttttacttgaatcatcactgttctaaaaaggtcgctgcctagcctacctaggcaaccattagaatactgatatgcctaggctcttgagaatgtgatatatatttaaatgtgcctttcacgtgctattgtaccagctggcatactgcctgttacaaaatagaagtcctattggatcactattgagccttttgatgcaattaaatctcttgcatcctactctgcagg

SEQ ID NO: 46430 - DNA, 295 bp, Oryza sativa
gtctctttttgattgaacgaccaaactgactgtacatcaggattagttgaaaaaaagccaccgccaacatgtgcccctgttgatgagcaaatcttactagcttcctgaggtccattcagcaccactgcctccctgcataaatcataaccagacaaagtctgagttccacgaagatgaacgaatctgtttttaataatgcatgactagtcaacagatgtaataaaaattgaaccatcagttgcagcatacaaattattattagttgcctagaacaatattttcaacaccaaacaca

SEQ ID NO: 46431 - DNA, 804 bp, Oryza sativa
gattagtacctgatatgtgtgtacccattctaacgcaaatcgaattggttctgaaactaatatcattttgctatatatgaagcagaatgggttcgcctaaactgatttcattttcatatgaaacaatatgcttcgtttgatatgcaatttatcatccatatttccagtggactgtaagggactagtgagtaggattgaaaatttggaactctaaattagtgcatggtctgtaagagtctactttgctaattgtatgaagcagtatcactcttgctggttgtatcttcaagagagctatcttgtcagaaatggaaaggcagcgaaaacagtggagactgaagatttttccttgtcagctgaactaaatttggccgagtgttctatctgaaactaaattatcgttatgatttctatgaatcagcccatatggcctaatcttattcattttgatactctgaaggctgaagcaatgcttttatctgatatgcaattttgcgtccacatttctagtggactataagagactaatgatcaagtaaattagtggtggtatacttaccagttaagtaggattggaattctaaactagctagtggcatgtaatattccagtgttttttggtcctaactgaatgacattactgggctggcgtgtcattttgctagctagttagtggtacaacaatatgtatcttactgtcatctcctggatttcactacctctctgcaaccagaagccttatccgtatatgttgttgagcaaatacaagttctgaattccttgcatcagtacaaagtcatgtgt

SEQ ID NO: 46432 - DNA, 396 bp, Oryza sativa
atgttacctacgtatacatatgcttgatcaaacatgaaataagtaatgtttattatacgaataaaaaacgtaaaatataaagggagtatgcaacgaatacaacatgtctcatggccttatatgtgtgtgagacatcctaattagttataatatatcgttgaagacttgattcatatgtactagacaagtttatgcactagaataaatatttttattagtttatgtactaattgcacatgtatgatatttctgtgtaccgcacatgcaatttaattactccccataatcaagcatttttaagaatggtgaggtgttaacaaaattatagggacacataaaaaaatcttattgagttgtgtcatctctctttctcgataaattggcattcaattgcca

SEQ ID NO: 46433 - DNA, 552 bp, Oryza sativa
ctgaagttttgtagaaatgtactccttatgtcctaccataggataggacatataaatcatcctatgttaggacgagaaatgtgacatggaggacgaccgaagaggcgtgttattgaaattttacgggcagggtgctgcctccaaaaaggcatgataaatcaccatttattaggacaatctactgttgcaatggtttatcttaaaaaaaataacaagtggggtgaccacggatatttgaaagtgccccagtaataaatcgttctacggaagagtgagaaggggcgcctacaaaattgccacacgacgcgcgccccttccgtcatttgccacgtctcgcacttccccttgtatggtatggcgattaataagggtaatttaatttttattttttaaaaaaataatataaaaataaagaaatcgcgactagcaggacccagacggccctaatccgtgccatcgcgctgaggctgagcctcggcagccgccgccatccttcctgacttgtccaaccctcctccttccttcctgtagattgcacgctgcccctgtaga

SEQ ID NO: 46434 - DNA, 842 bp, Oryza sativa
ccacagagagcgaagttattggtaaacaaaagaaaatataatacacatgttgaaaagtctgaacaaaagctatttaaacaccagttgtgagttgtgaggaaaataaattgtccctgtcactgaggatagatccaacatccaagagctcatttttcacggtcctaattgatcacccaacaactttccaagatgttaataatactgctaatcagactgtccaaatgtcgactggatttggttaatctcaacaacccaattgtagctgtgacaagttgtacatatgacaaaggctatactcttcagattgcaacttgcgaatttcccacctagatgcttttgtcctttgtaagatttgagaatttttttttgctttgagaaataatactgagatatcaatgatagattcctgataagatcgctgtaaattagagagagagagaaaaaaaacgttttaagataagtcatgtggtcatgcaaaattcagttctactactatacatttatatatctttcagctgttgccagtttatatacagtagtgtttgtcttgataggatatgctaaaaaaaagccttggccgacaatatgtgatgatgatgatgaggtaatcctttataaccagtaaagcagaacagagggaatagtagtctgaatttgcaagagatggagaaaaaccttgacctgctctgctttcctgtcaccttgaccttattatcctctcggagaggagatggaaggaactaggctttgatctgtacagcttgtgtgccgtttcaggtcctggttgacgtttcagctgaagctcatcaacctcgtctctggcagattttgcgccgttaaga

SEQ ID NO: 46435 - DNA, 276 bp, Oryza sativa
agatccaggggtgtaaagttttggcgtgtcacattgagtattatatagggtgtgagacgaatttattaagcctaataaatccgttattagcaaatgtttactgtagcaccacattgtcaaataatgtagtaattaggataaaaagattcatctcgcaaatagtcgcaatctgtgcaattagttattattttagcatatatttaatatttcatgtatgttgtcagggttacgggttaggtataccctttacctttcgatatacgtcacatatcgata

SEQ ID NO: 46436 - DNA, 1501 bp, Oryza sativa
gttttctgctaggttgtgtcaggggctcatgcttctgagaaacagaaatgggttccgtattgggaccatttatggcaatggatctcaaataaatatacttctatatcatttttttttgcggggtacttctatatcatatgatatcaagaaataataattttattatactctaatttgcacgcatgttcaaaaatcaggaacttgtggaaatttttttatatagaagttctgaaagaatcacacagagcatgtaggtaggatgtaaataaacaacctcaactccgtttatgcataataaaattaaagaatcttaaaataaaaacattgtttctgttttttcttttttctaattttcttcgttttatatctcacaataaaactttgcatggttgtctaatatcaccgtaaatttaccctgttaggatcagtacaaatcattatttacttcatgggcccatcaccggcccacataaagatcagcccatcactgaccgacatagtgatcggcccattaacggcccacgtatcatcgctcgcccccacatcccgacccgttcacctctcccgattctgacccgctcctctctctctctctctctctctcttttcctcgtgagttcgcccgccgcctcgcctgcgccgatctccatcgaactcggcgagcagccgaggcggacctgctgcctccttccgccgcaagcatcctcgccgccggtgagcaccaacccacacgcaccttcctacccccgcaccatctgtcttcgcctaaaccctagcttctcttctcctagatctggaagcttttctcttaatttgccctaaccctagcactaatagcagcagtttgttacggaataaagttttgggggggggggggggttcgagtgaatccccatgcccccacgttaagatccgcccggcctggggaggtgtattcgttggatttatttgcttgcttttgggttgtagctcgcaatttctttcttaccacggtttactgtagaatctcttagctctaagggtttgtccatttttttatttttgggcgtagcaatgattgaccaccgacgcacacaccgagcgtatgacaaattcataagtagatgttcttcttatagcaacgaaaaatattatgtgccagattttttttcctgcatcaatgtgttgattttggtatagcagaaagcttatttattgtttgcgttatttttcattacccaaattactctattgatgtattttggtttccttacaggatcataatattgctgattttgtatgatttgattcttgttgggtgagcccaagatgtctggaaatgacgataagtctcaggctgcagctgagagaataaaagcacaggccttatctgctgccaagggattgagcagaactcaagccgagcgagctgctgcagccgctgcccgcaatgtcaatgcttatgggcagaaagaagagggaccttcgcgctggcaggagaggaaggaggccaagagacaga

SEQ ID NO: 46437 - DNA, 316 bp, Oryza sativa
agccatgcagccatgctagtctaagagggtgctgtcctagagcatcccaacaaactgtcctagagcatctcaacatactgtcctagagcatcccaacaaactgtcctagagcatctcaacatattgtcctagagcatctcaacaaactgctgtcctaactgtcctagagcatccaaactgaaagtagagatgctgtcctagaaagctgaaaagcaggaaaaggcaccacaagaccaagaccaaccagccaagacttattcctatagttcctacattcttatgcttctgtatttgattgccaatttatgatttcagc

SEQ ID NO: 46438 - DNA, 844 bp, Oryza sativa
gaacccacacgtcttgccaaatttaagtatttaatattcatcaacaaatcacgtgtttatgatgcgaaatattgaatcatgcttagatggtcacatacttgtgaaatttgaattgtgaaacatccttaactccagctcccagtcccagacacaatattcctgttgacctgctactgaaaataagcaagaactgaattaagtacctgaaaaaaattacttgtcaacacttagaacttaaatagagctagaggtagaattaaatacataactgaattagcatgacaacaaatcaatgctaccttacgaacagatgtatgaataagtcatggatcttgatatggaaatatggaagagttagtactattgtaaactacagttatgagtcatgacattgcaaatcctaaacatattcaatattctttgtgcggcactgaccagcaagtagttttttttagacaattatcagcaagacatggagcatgacctggatatgcatgcaaatggaaatgaggaacaagaaattcaactgggtaaaagttcattactctttgatcagttacaaacatgtttacattcttgattttaggactgaataaatctacacaatctgattaacacacattaacttaccatgtaaatttttttgtagacaatgacaatgaattgcaacatgagctggaagccttggaggatgatcttcgggactatggcgtgtatacagatactgtcaatgttgtctttgatagagaggagttgtcagactcagaagaagaagaagatgcaaatgcaaatccaaatccagatgcaaatggaaatgaggaaaacagttctagagaattgacaa

SEQ ID NO: 46439 - DNA, 1501 bp, Oryza sativa
tggtggtgttactagcaccctggcctacaagggaggttggacatgacaaggactccaggaaggagaacctgaaacccaaaatgaagatagaaaaaggaaaagagaaatgatcgtttgtctgaattcaagatacaatattcagtctagtcaaggaaaggaatactaccatttataacaatttattaggcatggtctaaaatttgtgaatactcaaaggtgttttttttttcaaaataagagtatataagatacccctgacattacttaagctaagataaaacgtgaaaagaatatgtcagattttttacgaaaaaataagcaaagtcaaatacggatcatgtgaacatattctgaaaattcagttgtggttggtcttgtgctgttccaacgtaaccaacctttcctcctcttccctctgcacatctgaattgtcaagcaaccacaactcttgtccatcctctccaatcttaagcaggataacacaaagaattcttccttcacattcccattcacaatccttccttattcaacaatttgtctgatacttgcatgcccacaggcagctcaaaaagctagctacttgtttctgacttgtatcatttctacatagatagctcaaagcctctcaaaatcctgcatttcttgctcaaatggatttttcaaggcatagattcttcaaattcagatcagcagctgtctccttcctctccatgtaactaatttcaagctctcaagatcagcaagttcagcaatcactagactagctaggctcactccttccacatatagtcacagctgctctcatcaatcaatctatctttccagcttccaggtgacaatcgagacctgaatttctgaactttttttccctctcgtcacttcgtcagtagaaatccaaggtttatattcctctgtactactacacaacagagtgagcgtagtacgtgtctcatcagcatcaaaaagtgacatactgaaagcacgccacaattgaggccgattgatagaatcgaattccactcaaaattgcacggtggaagagaatcccctgcgtgcttgatttgatcaggatttatattggaggcatccaattccatcactcaaccggagctgtctgtctgtagctatcgccctatttctgctagctcgtggcgtgccagtttaatttcttccaaaattctccggcctcacctcgcgtcgcgtcgcgtcgcttgcgttaggaggtgcctaagtagtggcttgtcggcgtcagatgagtgcagggacgtgctgctcggaggcgtccatggcgtggatcgactgctccctcctcgcctggctcctcttccgcgtcgtcttcttctcctgccacgccaagcagttcagcatcttctagcactcgatcagctaggctgaatccacatatactccagcatatatatacagcaactgattaagtaagctgttgctcgccgacgacggtggccgagcatgtccggtgcacggcggtgcggtggccgga

SEQ ID NO: 46440 - DNA, 727 bp, Oryza sativa
cagcacacactatccattccagtggccacaatgcatcgcaaaaaccttgtctctgcaagctttttgcttttgttgttcccaatgccactgccatgtccatttcttgtccttcattgtactactgctcctgcttgctctttcgctttcctctctgcatagcaggcagcagcagcagcagcttcagacttggtcactctacaccaattcaattcagcatttcacttgtcagtcccagcctccctctcccagagtcccaggtacttcatgcttgctcttctacggttctacccttcattttcaacaaataaatctgtttgtctgcaacatattttcttgatcctgcatagctctatctgttgtgtactgctttatccaattctatccattacaaccatgcaaatgcaaggctccagcttattgctcaaatctactagtagtacattgtagtatctgaattttgttgtgcaagtgctcaaaacagtggagatggagcctatgtagtctgtggtttactgttgggtttacatctcacaaaatgaaagatattgctgcatttggtctgtggtcataaacagaggtttgttagtctttctgtcgaattagagaagtaaagcaagttcaaaccattgattacattgattttctcgtagataattttaccatactctcccatgtcgtctcaaagattcttcttttgtttcttggttttcactgaatcagccccaat

SEQ ID NO: 46441 - DNA, 1501 bp, Oryza sativa
gacgtatgaccagtgattatatttatccctgcaagtattcccaaacgacatttcgtatgcatctacgtatttttcctaggcaagttccatacgtgctgcagtttgaacgcgtgacagtttttgtttagtagggtcaagtggcaattgcgaagtctgaacgggacgaatgaggtcagaccccgtaaaataaggccggagaagaagcaactactgattgttactactactaattactacttcctccgttccatgatataaatcattctagcattttctacattcatatagatattaatgaatctaaataaatatatatgtctagatttattaatatcaatatgaatgtgagaaatattagaatgatttacattgtggaacggaagtgagaaatactagaatgatttacattgtggaacggagtgagttctccggtattactactactacagtacgcacgatcaggggaaggtgggcgctgattcgtcgcatacgtacgaagcgagaaaaaacgagcagaggacgaaagagacaggatgcgtgccgggttcacgcttccaatttagtcccagaacggagttaattatacggactgctagtaatacgatttatgattagccccgtttaactcaagagatatttaaccatttgccacatttagatgtggcaattaactttttaccactggacccacatgtcatagacacatgtggacccatatgtcattgagataggggtggcaaataattatttgccaaatctaaaagtggcaaatagtaaaaagccccttgactcaaatgcaaccggaaaagaatcgaaattgcaaacatagggcatgtttggtacagctccaactcctaaatataactccaggagttgagtctagagtggagttatggagctgcctaaacccagcttcacaactttagtacattttgtgagagagctccacccaactccactcccagttttggtggagctgaaaactgtttagctgagctccagctccaggagaggtggagctggagctggagctatgccaaacaggtccatagatacgatattccttaagaaaactgcgaatttgaagccctacaaggtagaaatcgaaataataaccgaaagaaaaggctgagacatgaagaacgttgatgaaagtattgaagtgtcacagatcatgattcatgagagagagcaagagatcaaagaggactgcacattgtgaccgtgtgtacaagaaacggagaaacacgcttaagtatctgtactttttgatcatgcgcatggcggcatggcgatatatttctaacctttctttgcacgaagcaactagcccggagctaacaaagcatctcaacaaacaaacatggcagggacggcctggctcagcggcgccggctcttggcgctggcgccgccgcgcgggcgcgcctgatgatgcttgtccttgccgaagaggttgcagaagccgcaggcggcgacgcgcggggagggcgggtccagcg

SEQ ID NO: 46442 - DNA, 189 bp, Oryza sativa
attcagcaccttgtaggggccgcacattatttccataaatatatgtacgtgtacacagggcaagattccaaatctcaaaaagcaaaatttagatcactaggaaagattattaattgcaagaaggattagttccatatacatgagacaatattcgtaaggcttgcatacatatatatacaccccgccagc

SEQ ID NO: 46443 - DNA, 496 bp, Oryza sativa
atttaatagaaatgcgggacatttgtaaattaggtacaatatgatcaattgcaatgtatgacttgccttgctctcgcactgatgagaccacagcaacgtcttcgagaaaccacgaatcgacgaaacgggcgaaatctacgcgacaaacaaagcacacaagcaaaacatgctataagactactgaaacaggaaacaaaaccatttttaatggattctacacatttttatgaatttactgagacttgaatggacttaatcggagctcggatgaattacgtatgatttttagaagattctctgtgtttttactattaaagaaaagccttaatgtatttattgcgcaataattcaccccagggctgacgtcagcacaaggaggggtggcgccgacacgcgggacccgcgggtcagcggcacaaggggagagggagggggcggctggcaggtgggcccactgggcagcggctcaagagagagagggaggggcgccggcaca

SEQ ID NO: 46444 - DNA, 1501 bp, Oryza sativa
acggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagtttagcttaatgaactggctagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtaccgtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatattctttgcaattggatttgtttcgggaaaaatttggggttttgcctctttggtttgtgggaaaaatcttggtcgttcattcggatcggatccttaaaattagctcggtctagggttttagaaaaattttatttggagttatatttgacagtcagttggggatttatcgggtgatatgcattaggtcgtgtctatgttcgatggggcaattttatgcgcatcattttccatgcaactagtttatgcattaagctatggtttggtcagtcgcattagtgtctttatccgggttcatgaaaaatgttctatgcataaaaatcatcatgctcggcaagttacttgagtcattcgttgctttatttaatttggttttagcatgtgttggttcctatccctctgtactctttagatgtcagacctattctccgatcgcaagcgccgctccaagcttcagagtcgccgcccttagctttatcgtcttcttagtctgtttgcgtgctagtttttggtgtttaggtttgttgcttgtgggttagtcggcggtcgatatcatgtgtgagtggtatgacagcctttattaggagttgtgtgcctctttttcagtgttttaatcaagattaagataatggcacttaatttcataagaaagattagtttccgagccatctgttttcttcctttctcttatttctacctatcccctccagatgg

SEQ ID NO: 46445 - DNA, 1501 bp, Oryza sativa
  unsure (1)..(1501): unsure at all n locations
nactgacatggttccttgctagaagcgcacnggaactctctcttctgttgtgccataatcccttcaggaatctgcgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatggtctgctgccagatgcactactgacatgagctccatcggtctgctcttcgctgcccctggcgtcgctggagtcacggggatcattccttgtcttcaccatctggaggggataggtagaaataagagaaaggaagaaaacagatggctcggaaactaatctttcttatgaaattaagtgccattatcttaatcttgattaaaacactgaaaaagaggcacacaactcctaataaaggctgtcataccactcacacatgatatcgaccgccgactaacccacaagcaacaaacctaaacaccaaaaactagcacgcaaacagactaagaagacgataaagctaagggcggcgactctgaagcttggagcggcgcttgcgatcggagaataggtctgacatctaaagagtacagagggataggaaccaacacatgctaaaaccaaattaaataaagcaacgaatgactcaagtaacttgccgagcatgatgatttttatgcatagaacatttttcatgaacccggataaagacactaatgcgactgaccaaaccatagcttaatgcataaactagttgcatggaaaatgatgcgcataaaattgccccatcgaacatagacacgacctaatgcatatcacccgataaatccccaactgactgtcaaatataactccaaataaaatttttctaaaaccctagaccgagctaattttaaggatccgatccgaatgaacgaccaagatttttcccacaaaccaaagaggcaaaaccccaaatttttcccgaaacaaatccaattgcaaagaatatatgcaatgaaaaggattcagagggctcttaggtttttccatttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaa

SEQ ID NO: 46446 - DNA, 224 bp, Oryza sativa
ctcgcaaaggagaacggggacattgctcgccatcgttgggccactgatcatcatctggccgacacgacgtcccacggcttcgctgctcagacctgtgaatcgagaaccaaagttcgataagtcaggaggaacgcgcacacaagcaagtcagggtaaatgcaagaaagataccccgaggagaaacctgggtcgtgtcctccggtccagaatagtcaaaggctaga

SEQ ID NO: 46447 - DNA, 407 bp, Oryza sativa
cagtttgttgggatgctctaggacagtatgttgagatgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatccttttctcaatgagagtagccattgaagttctaacatctggtatcagagccacactttcctgtaggctaaacatctcttgttccaccccttcccaagctcggttgagctctcagccaccaccagcagcagcaacaccggctgctcctccttcccctttcccttccccctctccacgcagcagccccccggaggtgcgcca

SEQ ID NO: 46448 - DNA, 274 bp, Oryza sativa
ttcctgcagccccttatttaatttttttttgcaaatataaaagacaaaaaattatgcttaaagtaccgtagataataaagtaagtcacaaataaaataaaaataattttaaaatttttttgaataagacgagtagttaaacattacaagtaaaaactcacaatctaatataggacgaatggagtactttgatatcccacttttctcacaattccaaactagcaccacaaaatataattttgcaggccctcactttcacaccaagaaaactaaac

SEQ ID NO: 46449 - DNA, 1501 bp, Oryza sativa
ggtgttcgtcgttggattccgccatcgtttcgttgatagtttggctagagtgatatagagctccgtgtgctgtgtggttgtaccggccacggtggaaagacttggcgagtctctactcgccgagagtttgttttttctttttctgtaacccgtctgggtttttactcctgtttaatgaaatataattgacagttctcctgccggtttagtttaaaaaaaacccaagctcatttttgagagtcaacgttgtactccatcatgcatactcatgtatgagcatcgcgctgctatttctctatgtatctggatgcatgcatcatgcgtacgtctctctcgcgttttcctactcttccgtacgcagttcgtcgattgcgctcttgttcctactcttttggttttcactttcaagtaaacgccgggtaacccccgcaaagaaaacggacgcccagagacatacggtagcaggcccggtttgaacgcccgccggcgccggatcaatccgtgatacccaagggtgccgcgccacgtatgacgtaccaatcccaaatcgagtcgagtcgagtcgccgggagcgcgcaaaggctttagctagccaacgcagagcatgtcttggaacgcgtctcaagtctctccagtctccacacgtcgttagttccatcgatgatgatctgtggcaagcagagccgcctcaagtagaataactcgcccaatgcacgcgtacattcctttcacctaatgcgtagtattggcgtattgctgacacacacaccctccgtcgtttgactgataatttttttctccccgtcgtttgattgataattcgacatgattgacagcgtattttagctaatccctccatactaataaaggaagtcgtttagaatattgatacggtctctaaaacacaactttgacttcttttttctataaaaaatattcattgaaaagtgatatatgtatacttttataaaagtatttttcaagacaaatctattcatataacttttacattttcaatcctcatgatttatattcccaaggtttaacttaaatattatcctaaacgactttctttacgagtatcgaggaagtacttttctctctctttccggtcaatgtttgatacctatatcaccttgattagaataaacactgcgtaaatatgttcaaagttgttattatgcttatcattagttcacaaccaagccaacaactccctctcggaggtctcggaaatacggcttttgttaattaaacgaaagaatcggctgctactgagtctgctaccctcgcgtcgcgtgcaccaggtgcatatgctgctcttttgtcctgccgcggcagcgcgcgcacggcgactcttatgccaaacccacgcacgcaacgcaagcacatatgcttcgttttgactgctccctgctcaacaccacacacgctctcgctcgcatataggcaggcaatacgtagctacaccgtgcgcgcgcgcgcacacgtacacgcacac

SEQ ID NO: 46450 - DNA, 176 bp, Oryza sativa
ccgtggcctcgcggcactccctcctctctcgcagactcgcagtagtatgctagggatgagaatatgagatgcctctcccaattcatggcgccgccgtccgtggcaccctgtcccgcgcgtgtcctcctcgtctcgaccccatccccgccttctctctcccgccgccgcccggcagg

SEQ ID NO: 46451 - DNA, 497 bp, Oryza sativa
cctgcagcccagatagaaaggagagtagaacccactgacatgtgggtcctactacttttttatttttatttattccggacacgtgagcttaaatattttggttcaactttttttttttagtcttccttctagtgactcgtcaaggcatattagacaacaactaattcaaactagtcatgtaggcgtcacgtcagcaaaaattgccattcaaatcctatgagaattatttttatactggttttgatagttgggagacatgttatatttagtattgtggtttatggtcgtgattcaaactccgcgtaaagacgagacctggactgaacttattcttttatgctaggccgtcggtgtggtccgtatcgatgactgtacagcctgtttttattgggccggaacatgatggtgacagaagtgcggcccattatggtatatcatcaggttcaataattaactccatcagagagagaagctcagagctcattgcaagtacaaat

SEQ ID NO: 46452 - DNA, 566 bp, Oryza sativa
gtggtggaggttgtcgtccctccaaacacacgcgcgcgcaacaaattataaatatgcatattttccccataatatccatataatatttataccgatggtgtactataataccgataaaacaagtgtcaattttaatagaatagaatggaatcattggatactacctctgtcccagaatacttgtcgctttgagtttttatttataacttttgatctttcgttttattaaaaaattatggaattttttttatgatttgctttattatcaaaagtactttttaagtatgacttctccgtttttatatttgcactaattttttaaataagacgaatggtcaaacgttaaaagaaaaaaagtcaaagcgattactaggacggaggtagtaattagtatgaccaccctaatatacggtagtatggtatagtataaatgacctcagtttgagtttcggatgacagaaaatggtttacattttcagcttttgcctgttggccggtatacactggtgaaaataatcgatgaatagtcaattcaaggtgctatattttcaagagattcatgtcca

SEQ ID NO: 46453 - DNA, 363 bp, Oryza sativa
caaatgatgggtgccatggcatctaggcgtacaaaatccttggcatttaggtgttattttcactttaatttgttatttttgttgcaacttatagaagttgaatttggtcttgcatgtttgtggagtgatatatttcgtattaatctatgttgtcaatttttttaattttttaataactatttagatgacatgcaaataacgagggaatgtcccctcaagggatgaaaatccacgtccgatttctgttctcaatatggagtgtgcaaatgtgacagaaggaattctactcgcgttaataatcaattgtcactaccatactattattagtttataacgtgttgtcatttttgtatgtatggcaga

SEQ ID NO: 46454 - DNA, 1501 bp, Oryza sativa
gcctgtgaggcccgcgtctacgtcagtgagtggcgccggaggcagtgaaaaggagaatgtgtggaggtacggcggtgcttgaggtgtagggggaggctggacgatgaggggtgacggagggaggctggcgcggcacaggtggcgccgacggcagcgggaggtcggcgtggcatgcgatgcggcgggcggaggcatgagcaagtgcatccatggccggcggggcacgcccagcgcgacgagtggctgtgaccagcggcgggatgtgtaggcgtggtggtgaccggcgatggtcgtggattgggcttaggtgctaaagggatggtgtggtggtcgggcaatggtcgttgtacaggatggttgtgtggagttttgattggaatcgctggcgaaagccttgccaggccatgggccggcatgacgacaacgacaccattaggcgtcgttccccttcttgaaggcgtcgttctggcgttgacctctcctggcaccaagaaccttcccccgtgcaacggtagtcattggtggactcctgcattgcctctgaagctctacaagcctaaggtgtttgacaaggtcttctctgtcttggttctgtttcttgctctacggcaagtgttcatcattcttatttggttactgctgggtagagtcagagctgcttcgctgtaggggtgcgacgaagttcggcaacgatgacacactgcaatctctttataagattgttgatgccagctgtatgtaggaagtggttccttggttgtttgggctaatgtccttcatgggtatcgtttatgcttgttcttttggcgttagggtagcattcgagtgaagtcgaagctgttgtgtcgtttgggcggcaagctcagtaacgaaaacatgtgtgggctgttgtgtcgccactatgacaagcttggtcgatgccttgtgtcgggctccgtcgttgtaatttaggttatgttagctgttagtgtggtgttgtagttgtggttttcgttcaattttccctaattaactggacactgtaaagtttggtcctgtttactccttaaattggggcaccttattcttaatataaaacgtcggcaatggcctgatcgttgaaaataaaattgtgtaagacatgtgtcaagtagagagacaagtcctttgaacgaggtgtaggacttcggtcctgctctgtaattttcttccgatcaaggagagatggattctaatatgtgatgtgaatgtacactcttttttttttcatgtaaactaaatggttataaaataattttttaaaaaaataacaagatagattatgtaatatattacttcacaaattaacatacaagtttaaatttgacttctctaagtaggaaaaaaataactagtcgattttgaagttgcatattcgtagagtgatacattacatattattaatacctatcctgtcaactttttttaaaaaaattcataaccatttagttgacatgtaaaaaagggtgaacgtccaaccaag

SEQ ID NO: 46455 - DNA, 793 bp, Oryza sativa
gccaggagacaacgaggggacgtcgagagacggcggcttgcagccgtagggatctggccgcagctgggacgggatccaccggtgtgcgcgccgccgcctagcgcggtgatgtccacggccttagtgcggccgtcgtcgccggatccgatggataactcgatgacatcaccgtcattgaggctccgatagctgtcgaacttgagggaggaccggtggacgaagaggtcctcaccgccgttgtcgggagtgatgaagccgaacccattggtggcgtcgaaccccttcatcgtcccctcaccctctccgacaccacctcgccctcaccgccccaagtcgaaccctccaaaaccctaaaagctgcccgccgtctcgctccactggccagccgccgccaccgccctactcgcccttctccctctttgcgcatgctcgccaactcgtcgccgtacccgtctccctcctcgtcgtcactgccgccgccagcccctgcaaccgcaaaccatagaaatcatactgaaagaagatatggggaagaagggttggatcggatgcgggggaggggggcgaaatgcaaatatactgccactctggacggtcacgtaagccagtcaacctggtcagaggtcctttggacctcaatgagtcacttaaacaagatcgcggaccctaatgtctatttttcaagatcatggacctaagtaacacctcgctccaactttaaggaccgaccatgtactttactcttttacctacgtactctttagaatccttttgaactaatatcctactgtat

SEQ ID NO: 46456 - DNA, 1501 bp, Oryza sativa; identical to SEQ ID NO: 38892

SEQ ID NO: 46457 - DNA, 651 bp, Oryza sativa
aagaagagaaaagtcaatatacacctaataattttttttatcttggaatatagttatcaagaatttagaatccaaattttatgatttcccacaataaatgtactttgcttgataatgtaagatgagatatcaaatggaatccatgtcacttagtggactagcaagcaatggaaatcatgtaacatgaacaagggtcacatccattgtattcactcataagagtaagtgtaataaaatgatgtgagccgatgacgatgggggtgagaggagagagatcaagcccgcgaataatttgctgccgactcatcacgcactccaagaagccataaatgacttcaagaattcaggagcaagcataacacggaagaggttaatattttgctcattactgctactcagtagcctcattcctagttagagtttctaaggtcgttttgttagacaaaaattcctgataaaaggattttctactatttactttttctgctgtccacagactccagctgcttgccgttgcttcctccccgtgaggggttgctccatccctactcagccatctctgccggcgaccacatggccgcctccgctagtgaccacttgtagttgctccttccccgcgcctccaccttcatcaattagggcgtatttgaa

SEQ ID NO: 46458 - DNA, 1420 bp, Oryza sativa
taattcctgcagccccagccatcatgtggcaaactctttcgaccagtctgcatcatcttcgtcgaacagccagatatgaactccatcatgtggcaaaccctttcgaccagtctgcgtcatcgtcctcgaacagcgagatgaatccaatctgtagttctatatagaagctgttgctattcccgttgagaaacctgggccacgctacgcagttttgatttaatatgcataatatcacctgtatgaatccacggatactctcctggattgctggtaactacaagcgtaataagaaaagcgctattgatgaagctatttctcataagcaacactcgtgttgtgtcttgtatatgctgctgatctgaagatatgtttcgtcagctgatcgtatattgaccttttctgtctctgtcactgcagtgcaatgcgtttatgttgtggtacccaaattaggcctgcttggttactggaatactataccacttactactaagtattctgcgcacaaacagcagatcaggagtttgtcagagaatatcatcatatgctgcgtgtctcccgtcagtcccgtgccgaactgccagatgtcccggataagattcagacgaattctgggacgagccacaagatcaacaaccaagctggcaaaatcgttgatgataataagaaaacaattaccagtacgcagtacgcaaaatgcagaacgagctctcatgaaatcatggccaatgatttgatctgcacgaactgcccacacagaatgctggtcgcagtttccggcgcggcgaaaaagtcaagagtccactggccaatcatgcgcccagctgcactgaagtcaactccaacccatgtgaatatgtgatttgctcgtcaattccccagttagttgcagggtcattttatttgggtaaaaaaaattccagggccatagagggtcgaggcattgacaaagaggtggcctactgccctactggccttggtaaattcagaataggcccacccgtcagaggaaacagtccatacatatgcgacgcgtcgactacggcgctcgacaattggcaagcgacgactggacagatgtgctgagtgctgacgtggttaaactaacctcgatggtgtgataaaaggctagttgtagtaagtgatattaagaatgttaaatttgatacttatttactgggcagattaacgctggatataaaaagagcacgtacgtccctattattatgcttcagtagttcagttagctcgctgctgcctgcatgtgcaatggagcgttcaacgccgggaacaatggcggcacggtcgtggttgcttctcctctgcttcgtcgccgtcgccaccgccggagtgctccaagctcgtgcccaacctgacagcaacggtacattccaccatgtcctgtctttcaagttttgatccg

SEQ ID NO: 46459 - DNA, 276 bp, Oryza sativa
acaataataaaatgatttacattatgaaacggtggaagtattttttttttcaaaaatgaattaatttgatttttttaagcaacttttgtatagaaacttttttaaaaaaaacacaccgtttagcagttttaaaagcgtgcgcgtggaaaacgagggagatgggattgggaagggggggtgccgaacacacccttagtagcatcagagccacaaggtggacagtggtcccgtgctagtggtaggggcaaacgacccaactatatcgactagttagga

SEQ ID NO: 46460 - DNA, 1501 bp, Oryza sativa
ttttaggaaatcagacgctcgatttgtagagggcttgaattttaggtgactggaaatttgtattttcaagagcttaaaatctagcaatacatttgaaaaggacacgactacatagtgcacattattggaagtaactacacttctaaaggagttaagaaaataaataaataatttaaatatactcaatattagactcattttatcacatattttgagcaaaatggatcttaaaagtaatataaggtctaaaaatatataggtcatcaaagattctataaaaaaacattatactagtgtaatgacatgttagcctcagtagcatgcacgtgaatcgacatgataactagcagatagtatgttgtcctcttttcctgtcaagtggtctcatttctttgactcttcgtcaatataatatttacgtgtccgtgtctcagtcaacatcaattgattgatcaatataacaactttcaatgcttagatagttacctctattgcagagctaagttactctacgattttactaaattacttttgaaattaagtaaattactttaaatgtttgaatatattaaatattaaatttgttttatcgtatattttgagtagagcacgatggtacaaacaaaaatgaaaataatatatgatttaaaatatataagtcatcattagaaaaagaatagactcgtgtaaccaatatttagtttcgatggttggtggtgtatagcgatacctgacgccacgaaggttcctcgctttgatgccattgcaatggaagcaagcctatctctccgacaacatgaagacgcggatggatggctggcggagcgtcgtgccataagacaaaatcaagaatgctctccatttagatttcccacttaaagaaatatccaaacgtaacttgtgcaatgtacgggttagagactagtagtaaattaactgctcctgtaattaattttaacatcatatcatctcatagagagcacggtagcagtagtaccttaatactacatccgtcccaaaataagtgcagccatggatattcgtgtctaacgtttgaccgttcgtcttatttaaaaaatttatgaaaaaattaaaaatatttagtcacatataaagtactattcatattttatcatctaatagcaataaaaatactaatcataaaaaattttgaaataagacgaacgatcaaacattgaatgtgaatagtataaaactgcacttattttgggacggagggagtaatagtttttctcacgcttttctccataaattgaagaaatgacagaaaagataatgcaatggaacgccgggctctccggcgaagccgacgcgtccggcagcacagcgctccacttcgccgcctcggcggacggaccaaagatcgacatcgagaacagctcactcctccggtggctcctcttgccgtgcccgttccaatgccgccggacaccaaccgaacttctcctggagaccgacccgtccttggcctgccagccgg

SEQ ID NO: 46461 - DNA, 266 bp, Oryza sativa
gaatatttgaagcatccaattaatgctgggtgctactactagtatcaacactacagattggtgttatacacctaattcgagtgatatggcgccaaaacataagggcttaaaagaatccaaccggtctaatcaaattcaaaaactccatggatggtgctttgccacccaagggtaccctccataatcctcaagcagcgaggcagttacaagccttttatcacttcatccatcatcctacaaaccaactccacacccacccatcacaa

SEQ ID NO: 46462 - DNA, 158 bp, Oryza sativa
aattcctgcagcccattttggccttttgcctgtgattgtactcatgcagaagatctcttgatttttctgtatttcaagcttgaatgcttgattactctgctatctgttctctagtatgtatttcagtctattgcccttaaactgttatattcatcttg

SEQ ID NO: 46463 - DNA, 515 bp, Oryza sativa
tcctgcagcccacacgtttccacggcgtcaaacttagcccaacctccgaaaaaccgccacgcgcggctcacaaaaccagcgccgccgcacggcccgcaccggacccctcgctgacgctccgaccccaccaccaccaccgccgctcactcacacatcgagcgccattattaaaccccaggaaaaacagacgacctcgttcgcttctcgcccgcaaaaggctaaacctcgattacgcctccccaaacccgccgcgaaacgaagcgaaagcgagttcctccgatcccgaccacttgctcttctcatggcgtcctcccacatcatccttccgccggacgacgacgacgaggagcagcgccggctggaggaggaggaggacgaggatccgtgggcgcggagcgggcctccccccgcggcgccggagcacgcgatgaaggcggcgctgccgttctccgcgacgtgcgtgcggatctcccgcgactcctaccccaacctccgcgccctccgcaacgcctcct

SEQ ID NO: 46464 - DNA, 219 bp, Oryza sativa
atcgatctcacttgctgtgttcgagctttcgaaggtcttggaggttatcaggtatttgtattggtggctgctgcctctgcctccacccgcttctcgtgcaacacgtgcgggaagagagcgagcgagcgcgtcgcgttttcatcgcgcgcgcagtaagaaggccgctcgctcgcgcccgtcaacgcctaggcgacggcttgacgagatcgcagacgttga

SEQ ID NO: 46465 - DNA, 776 bp, Oryza sativa
tcctgcagccctgtaaaatggatgaaaggataatcccatctattactaacactctgaatgcaaaaagcaagaccctcaaaaaccatgaggtattgatatgtgggtctggaactgttgaagtaactgtgggcaccattacacatgcagtaaatttgaaggaaaggacatgtacttgtagggcttggcaagtgagtggaaagccttgtgatcatgctttggctttcattgcaaagcttaatagggaggtacaaatggatgattttgtggataagtgcttctctatagagatgttgaaaatggcttatgcaggacagttcaatccaatggcatctaaggatgagtgggcacatgttgatctaggctataaaatcaagaagcctaggttgagaaggaaacctggaagaccaagagtggctaggataagagcttctgatgaggctagcactagtaaaaggaaaaaatgcagtgaatgtcatgagcttggccatacagcgaagcattgccagggaggtctcacagcaagtcaaaagaggaagctctcatcttcacaaagtggaacaggagaggggatcaatgacccaagtgatgcacccacatcagtgtgaatcattcattgctactagcatttttccttgtttttaactaatccaatgctgattttgtttattttgtcattgctaattttttgcattacttagtgctagtgcaagtggaactacaaggggaaggggaaggggaaggggaggtgcaggtgtaggtgctgctgctgcccctaa

SEQ ID NO: 46466 - DNA, 250 bp, Oryza sativa
catgtaaccgctgcatgtttttgtcttgcaatttggtcgtttggtgcaattgtatttatgtattccatggatctttcattgagggaaggcatagaaagaagcttgagggtggaaaaactaattcatcagaaagtttgaactcctctgataacgaagatagaaaaaaggatgatagattcaacaaagctgatgataaacatgataatgaagcacaggtttgattatgatctatgcaatccatctcgctagc

SEQ ID NO: 46467 - DNA, 340 bp, Oryza sativa
ctctctgttgaattcctgcagtagctattcttctagcaaccaaactaggaaatagttacattgttatggagctcgatatagtgagagtgagcaatacttgcacaagtagcacaactagcaatgctaattggacccaaacatttttttgttgtaccttttgtaagtttgcaggaaggatgcttgaatttagttgatgagcatctttaatcagttcaagtaagggactttatttcttctaagatgcatatttgcatctacacgtcttcctctacattcaacactatattttatgttgcttgtggtaaacaatgttacatctgacatcttttctttatacagg

SEQ ID NO: 46468 - DNA, 186 bp, Oryza sativa
caaacgcaagaaaacagcattaagggaaaagttgctcaacatacatttgtcaacatcagtttttccttggggaatttagttacaaagcaatttaatactatcaccgtatgtttatttggctatgctgttggctctgtgattgtactgtctacattttcctatgatgccttcctcactttgatgtgg

SEQ ID NO: 46469 - DNA, 348 bp, Oryza sativa
attcctgcagccccagttgagcgacttcttgagcgccgcccacaccgtcggcatctccccttctccggcgactccccttcctcgccggacaatccgattgctgccaatcaaaccactccatttttaacaagacacgcaacacacattccatgattccatctagagaaaaaggatccaaaactaaagcagatagtactaatcactgtatattcaagaaagaaattatctacaagatgaacagggggaagaacctgaatactgcaatgactgtgcactgctaactgtaagtctgtaactgctaatgtcattcattcctcatcattgccttcttcttcttctaccttcagc

SEQ ID NO: 46470 - DNA, 1501 bp, Oryza sativa
tggacaactcatgctagagaacatttgatggagttgcaggggctggagctttcagttgaacttgtctctataaaatggcagttgaatggggctgaaatattgcaactgaaacagatgattttgctgtgaaggtaaaggagtttaggaaactgaatttcatcttgtcagtgacagtttaaggagttcagtttgctccaacatcttacctttggagcctcaaccgatagtggctgcaaatatgtggagatttaggccgcgttctaaactgggtttcagctgtactaattcatcgtttaaagtgagcaccctttccaaactgataaacaatatgttttgtggtaaaactttatatagataagtttctctaaaaaatcaaatgaatccatttttaaagtttacaatagataatacttcctccgtttcaggttataagactttctaaacatctatataaatgtggacaatgctagaaagtcttataatctgaaacggagggagtacttaattaatgctaatggcttatattattttttctgcggctaactagctatcctaaccgctatatagagcgcacccttacttggctagacatcgcatccaaaatctttggcagaacgagaaaagatttggttctctgtagtatctcatgttcacttgccaaacaaggatagtgcagagcagtgatttttaacttctgttcttctaactttctctgaagaaccttgcttggaagctgaatgtgtaagtaggatgggaccaaatcttcagcagttaataagtttcagttaagcaattgattactagttgtgaaatcttgaggacactcttgccaataggtagaatgttagcttggaattggatggagcaacgcttcactgatgaaacctggttctcctcatgcaattctcagcattcagtagtaatcatcaatcaagctgctaaacagaatagccatggcagttactacctcagtcctaaaatatataaaaatctataatcaaatgagacattttctagtatcagattcgtattactaaaaaaaatattccatccgatactaagttcttatatattttggaacggagagagtaagtcggaatgcatcaaacggatcccaatgaaattgatccgaatctacgagagcgcaagcgaatattactacagaatatcaggggttacatgcaaaaagttcttcttcccattcccctgaaactgaaaaagatttggcacgaatcgaaccctccaatccattgcttgcccttttttgtgtcctccagcttctagaaacttctagaacccaagtaagtccaagccgccgccgccgccgcctacagttgcttgcaagccgcattggcccaggtaacacgcccgcgatgtgctggtcattctggtgttgataggaattcacagttttgatctctctgctccattctgtagcctccaggtttggcgctcaccacctgttcgacgaaatgcggcaagagggagcagatgtgcgcgg

SEQ ID NO: 46471 - DNA, 1501 bp, Oryza sativa
tgctcctataaatccaacttgcaattacacttagttacatagcactacttaattacaatacaccaaaattagattttataactactagcatagcatattgtccatgcattgaaacaggatctaattgatgaaaataatcgttaacctattattatcattattttccgtactattaaattctacatatttgtaaataacatatgtgcatatggcctcacaatatcactttttcttcataaaaaaatagagatggtggtgggtggggtggtggatatgtgggtcattcggccacacatatccttttttcactcaaaagaagtagggagttgttggtggaaccccacgtgtcattttttcattctaaaaggtagagagttggtggcatgggtggtggcacattcaccgctaactaccaccactgctattttttttaaaggagtatagatttttttcttagattgaggaatttttattaggtctctttttttattttatttaaaacggaatgtatctgttggttgaaaattccataagatttaaagctccgaatctaagaccctcttttgtttaggctaggcttattggcctagacttttaagtcagcttattggcttatatgatttataagacaatggatttaatgtcctaagtttagtggttgagtcatacatctacctcacataagccaaaaatacctcacataagccaaaaaagcttctccaacctagcttttggcttaatagtgttaaagtggcttgtggcttcaaacaagccaaacggaaaagctgcttgtttgtttaggtttagacttttcgacttataagttggcttataagtctaaacaaagaggacctaatattaataggcagtccaaaagattattacaataatagttgaacgttttgttataaaaaaactgaaaatttgtttatctggtaggtccgggttgcaccttagacccgcaaagttaaaattgtagtgccgctgcagttttgctaaaagagttgtattattttttttaaaagaaatagtcttcataattattgtagctctttgtctttttaggagaattgtcatggaagggattttaagccattattccattcattcactttttatagcaccggtgcatctcatttaactttttgaacactgtcagatttttgcacagttgctagtagtacgtgaggctgtttgttgatagccacccttgtggttagacgagtttgatcatattaaacgtgtgtttggttgacaactataagtgtgggtaagattacttcactgcaaactgaggatccatgcctaagagcatctcctacagtctcttcaaatctaactctccaaatatcaatttggccaactctctatctaatttagccagtcaaactcttatttactccaacagcctctctattcatcctctctattatgagcctatgatagggggacccacgtgtcagtctttacaaccctttcttcttcctcatctatccccctt

SEQ ID NO: 46472 - DNA, 353 bp, Oryza sativa
atacaaccaaccacaaaaaaaaattaaactcgaactaccacttagctaagtctgaaaatatctagcataccacttagtctactttgcaccttcactaaaattagaccataactcttttagtaaaaccctttgatcagcatgttaaacataatgcactctaccactatatgaaattacttaatctaattcaaaatataaccacatgaaatgacatatataagttaaacagtacatagagatgcaattttttttatttttatttcatttttttgatattttttcacacttaggagaacataggaaccaaccgtataaaaaataaactcaaacggacaaaatatgtgatatgtaga

SEQ ID NO: 46473 - DNA, 423 bp, Oryza sativa
tggggatattttgatactggtctcttactgtatgtgccattggataatgatttgtcgacgccttccgtgacatttttgtactatgacaattgtcttggttcacaaagaataggataccccagcattggcagagatacgacttgttcaattatttgtatcaactctattacaatccaacttaaggttcctatgaatcatgcacatttctgagatgttattgtgcaaaatggttttgtttaattgttggtttcaatgtgtacccattgcttctgcaccttcaagtctatttgggtggcatttgatttgaacttataatggccaaagaatctcatggattgtactatcattagcttatttttctttcctccacacatggtagcccattaatttcaagttatctgtgccaggaatatgaagagaaaa

SEQ ID NO: 46474 - DNA, 197 bp, Oryza sativa
ccccttcctccacatgagcttatagttggctagcccactattaagctttctcttaacacttacataaatttgctttccctttatgtcatcataaataaacaaattggccacgaacttttaaacagctgagttggtctaagattgctatagctaattgattcatatattttgtgttccatttacatagttttagatgc

SEQ ID NO: 46475 - DNA, 1501 bp, Oryza sativa
ggaagtatcatttttgcaagatgacaatttggtgatattgtagatatattggtttctcattttgactaaatatcatgttataaacaaaataagggttagaaaaatacaatgcactatatatataaatgtcatatatgattggtattgaaaaaaattatttggtaaaaaatgcaacatacatgttatacatattgtgaaccaacctaatcctaatatttttctccctatattcatttggttaaggttaggtacattttgcagcatgaatcttggaacacatcaacggtgtagattgtaggtacatatgaacccgagtgcaaatctgtattttctaaaaatacttatattttggacggaggtagtaagtcgctgcacaaaaatactgtcatcaagaattgactttcacgtgcaaccttttccagatgcccttgagtgggcagccaggtaacagcgatgacattgatggtatcgtgatcgatctagctcacagatttgtcatcaagcagtagtctattttccgctggctctgagcaaaaaaagcacatgtgatagatgaatacttctatgtaatatatcacttcacaaatatgcaagttaaaatttaacttgtataaattataacaaaaataacacagaaaactcaaattagtatactttctccgtcaaaaaaactaatctaggatgagatgtcctatcccatccgagggagtatgaactataaggtacagccacttttctcttatgtctcataatataagacgtacatgtatacatacattaattaacacctcttggtccaatagaattgatttgttttaaatcctataccatcaaacctttcaatcatattgcttgcatgtatcaaggtgatccaaccaaaaaggtgattaaatgttttcttggttttgtgttatgagtggttgagctttatattttaggatggagggagccttgatctatcttgtcaatggagtgatgtatcctgtgtgcagatacatcagcaggagccattgtgacccatccatccgagtgagacggatccatgttctctgaaaaaaattcgcatatatggctgacacgatgcatggcgtcaggcgcgcattgctgagttatagtaatgttaggtgatggcatcgatggggcataaaaaaacaacacttgttgtgggcctttagctatctgagtggatgcactgtggaaacaacacaagaagcggcgtggtgatcattacaccttcaagcgctgaagggtaaaaatgtcaaaaccacatcgctctgtgctgacacctaccactcattcgccatatgcgccatcgagatgtacaagaccactctacgttttaatgatcaattacacgaaaccattacactaccggggacaggtgtctatcgggggtcaagggtatatgtgcactcgcgtgcagattttccatctcccttatcgatctatcttgttaaatttttaacacagatttaaaatcggagtggctacgatgaacaga

SEQ ID NO: 46476 - DNA, 1501 bp, Oryza sativa
agagctctaaaaatttaataaactataaaattataaataatatagcatgtttacatgatgtttaaatataataattgttagtggatgatgatgtggtatctttgcatgttaagcgttaggagttaatgtgttataactttatagtataataaattataaagttatagataatatagcatgtttgcatgatgtttaaatgtaatgattattagtggatgatgatgtgatatctttgcatgttaagctttaggagttaatgggttataactttatagtataatcaattataaaattatagataactagcatggtggcccgcgcagattgcgcggctagcatcattatattttctctcatataatagcatatatgttttcacaatttattattaaaatatattaaaatgacaacataattttaaattttgtactaactttatgaaactactaatgtgtaattcatattatattttatatatgtgttagttattaattatttttaatatcaaatttccgttatttctaaattatattcctatatggactctaatctcgtctttcaatatttcttatttttttaattccgaattttcgttaactataaattgtatttctatatagactctaggctcttcttctaatattatttatttttaattctgaaattttattatttctaattgtatttctacgtggactctaaactcatctttcaatattcttttatttttaatttcgaatttcagttacttctaaattgaattcctatattgtattaagactcttcttcccatgttttttttaatttcgaattttagtaatttgtaaattgtatttttatatggacatctaaactctacttttaattttattatgtttattcctaattttacttagttttaaatttatatatatactctatactctacttctaatattccttatttttaattccaattttctattatttcttaattgtatttttatatggactctatactcttcttctgataatgtttattttttaattctgaattttggttatttctaaattatatttatatatggactatagtctcctcttctaatattcctcattttttaattccgaatttcaactatttctaaattttatttctatatggactctgtttttcttttctccgattaatataagaatttctagaccgtaagagtgaacgtggaggctccttttttttttctatttctttaataagttaatagatatagcatttttgcatgatgtttaaatataatgattgttagtggctaatgatgtggcatctttgcattataaactttaggagttagtgggttataactttattatagcctcaaaaaggagaaaaagttttgacattcatgtcttgattccttgtgtatatggggaggaagtctatttgtctctcgagaggatataccattgttttccatagcatttaaaatgttatcaacaaatttggaaacaaaaaagaacaaga

SEQ ID NO: 46477 - DNA, 1501 bp, Oryza sativa
tataagtccattgatccatgtgagtactcttatccagtgtcaaaatacaaacccacttgctcactctctttgacttcagtatcctcatgtaaacaattttcttctaaaaatcttcccttgggggccttaaaagaagcacaaatttcaagtatccaaagtaacctaccttcctgtgcctttaattaatccaaactacaacgactcaaagctttcatatctttccaaggtcaactgttgctgtctaatcatttttttctgttacatttggaccttcatgatctattgatatatccccacttgtgtcaatggtcctgtatgaaaaaggaaattgcaattaggtaagtctctttagacaggctttgaactatctggtcgtaaattgacaaccaaccttaagaaaatccaggagctttgttgttcaattagtacagtgatgaagagggtttacaaggccactgaagaactatcatgtcccagttgactgtccaagatgttccttcttaatgcaatgatatgcagttctgctgcatattcgagaaaagaaaaactgtcaagatgttctgaatctctaataccacttgttagttgttatgacaatagatggtaaagagtaacaccaactttaccttcttgctctgacatgaagattttacaagttacatgtagctttgatgctactgcatgctttatttcctgatggcataaaaaaacaatacaatattgtagtttgtagttcactgaaagtctgaaaccgatggatctgggatcttcaggttcaagagtgaaaatattcagctgattggggcattgggtatttgcagtgagcaaattctctgaactccatacttcaaataggccgttgacaaatttgctgtcgatttcaccttgtcactttcacaatccaaacaagcacatttgtctgctctctctccatgcgacttccttgtttaattaattgcaaattggagtgcatgaccagatgctaatgctcatcttatgatatataatgtgtacagaaagttgtcaccatccaacacgtgaactttcagaaatcagaatttaattctacccaaaaattaccacttgtttgccttcttttactaccaaatcttgaatttcttgatcttgcattggtcaatggctgccttctacttatatactagtatataagtgcaaactagttgtccaccatttctgcctctgagcatcttcacaccttctccttccctgaatccaccatggcgccgtcggcgtcgtccaccggggcggtactactcttcgccatcgccgccgtgcttctcctcgccgtccgggatggccattgcgcgcaattgtgcatggattcaagtatgatgttcttgcaatttgtctttctttgtgattgaattgtgaattgcaactgatggtttggatcatggtggccgcggagcagcgttcccgaggacggtgaacggatcgctcaccttctgcggctacaatggcacggcctgctgcaactcga

SEQ ID NO: 46478 - DNA, 369 bp, Oryza sativa
tccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagc

SEQ ID NO: 46479 - DNA, 408 bp, Oryza sativa
cgaccgcgcaccgcttggctttgggggattacggcgtgtccggcgtgtgcgagtgcgagtacgagcgtgacaccaccctccgcgcgcggccgcggcgcgatccgctcgcgatgggtcacgggtggccctgcgttcgcgttggggcactacttggccgggcagcggcagcggctggccggcgtgggggaccgaccgatattcggtatcttggtctgacgtcgacggccccggcggctgcggctcccacagctgcctgcttttgctttggaggctttcggcaattcggctccgtgtctacgctctctatgggtcaacatggttatcttcgaaaaataaaaagacccaacccatccaactcatgatgatgcgtcgaaatggctgaatttgcgaggttttcttttcttaagg

SEQ ID NO: 46480 - DNA, 1501 bp, Oryza sativa
aaaatctgttgatgtttctgatcacactgttacgttacaggtaattttaattttatggctaatgtggcttgtgattgttaaacttttctttattagcttaatcagcttcatttacgaagaacaccgatctatgtacaaataacaaagtgccagcatataattttacccgcagcattgttataggaattctagtgttttgtcctaataagttgtgttgtgctttactgtttagcagcacagagcctgcagaaacactgaatgtttagctgaaccacaactgtcatttactcatttaatgcccattcaaattattgtgggacttctgcatacttgataacttgccgcgattgtgcagcttactggggatctcgacaagatggttgcattacaaaggctgttggagccttatggcatctgtgaggtatattgaattctttttgtacttttctttcacctcatccgtttgttgctcatgtggttatgtgatgtgaaatgatgtcaacagattatctgcgcaaatactgttaccgtattaacacacattgtctcaaaaactcattctccacacgtaatggatacttttgccgaagtgaacacatgcttttgactaccaaaataattttaaatcatttgccaacatctgctttatgtctttaaatatgatatgctaggttgctagccgtctcctttctatctgggacaatggatccgtatgctttcgcacccatgctcgcggcgtttactttcctcactattttttagataatggatagaaatccgatctctatatccacatgtaatatacccagctttcctcgctaatgcatattccgtccatgaccacaggtcgccagaacagggcgagtggcgctggtccgcgaatccggtgtcgattccaagtaccttcgtggctactcctttccgttgtaatcccaggtcttgtgagaagaaaggacagtaataaaatgcttggtcggttggttgctacctgttacagcagagtgttgtagtagagtgttgtagtcagattccgttcgttcagttatgttgtttgttatgatgctgttcttttgttgttgtttaccttcctctctgtaatgtgccaatccgctggcttcttgtccagtaaagatcatgatgcaagagttgagcctatgttttctactgacaggcaaaccaaacgtgcactcagccacttaccatgttctggaataaaaattgaatccagcgctttgcaccgtgtaaaatgttcgtaatataccatagaaaaatgttttaaaaatcatattaatttattttacaggtttttttaaactaatactccacctaattaatcatgctctaatgggccgatagccttgtgtactactgggcctgcaggtccaacaaggctgtcggcccagtggcccacggcgatgagatgggaagcggggaatagggagaagggaagaagaatccggattctgttgcggtggttgttggaagtttggagctctcgggt

SEQ ID NO: 46481 - DNA, 353 bp, Oryza sativa
ataacgtgtagtattaattgttgagaactaatctcttggtatctatataagtattaactataatgtatcacatcatatattagttttgtttttttatgaaacaacgggagtaaaaccattcttaaaaaaaaaagttgtatcgtagttttgaatctggttatacgcctgtccaaactcatacctataatttgtttttcttgtgagacagagaagcagttcgcttcatttcattgtataataaaatgaaaaaaaaatgaaaaaaaaaagaagatacgggtgatggggaattggggatatgctgaattgctaaccgaaatggatggattcgcggcgctcgatcgccggcgtgcgca

SEQ ID NO: 46482 - DNA, 447 bp, Oryza sativa
agtaaaagagagtttaacttgctaaattaaatggagagttgaccaaatagatgggcctgttcacattgataaaaaaaaacattaccaaattttgatatagttgccaaaattttggtacgtttcttatatagttaccaaaatttggcagcaaactaaatgtagccatttttttggcaacttaccaaaatttggtaaggttgaaaataacattaaaatgaacaggcccgatatttggagagtcaaatttgaagtgattgttggagatgcttttactgtgcataaacgaaaaaccgtgtgcagccgccagtttgctactttgcaaacgcgtcagtagagtactactccgagtgatgagtgtgtgggtcgtcttcccaaccgaacgcgggaattaaagcgcgggaagcaaatggctaacggctgaagaaaaaaaaaaaacagcagcggcca

SEQ ID NO: 46483 - DNA, 463 bp, Oryza sativa
tgttttcttgttaattggatcacgccgcaccgcacttgtccgtgttggcctcccaaaaatccgttataaattatcttttatctttagaaaaatcactcacctcaaaagataatttataaccaaaagaccaaaaaccaatcgcacaattgtcaagccaaccaccccagatctacttacgacaaacacccaatccaggccgtccattcccaaacaagagcggatctgagccgtacaaatcctgagtgcggatccgcttatggcgcaaaggcgaagggtactcgaggctaccggttaaaacgcccaagtcagtggctctcgtcctcctttctcctacgcggccggagagaggaggggggaagagaggatctcgcagagcgccatagcctcggatccagaagcggaattcggtggaggtctcgggcacctggatcgatcggaggaagggaaggcggagcagcggtga

SEQ ID NO: 46484 - DNA, 288 bp, Oryza sativa
cccccccccctccgaattttttaatttttgttttatttgtttgatatttttttcacgcttagggacacacaagaaccaaccatagaaaaattgaactcaaataaacgtaatatgtgacatgtagaatttttcctctcctctcctctctccgaactagtgcagaggagagagatgtgcaacttttttatttttattttatttttttgatatttttttcacacttaggaactcacaagaaccaaccatgtaaaaaataaactcaaacggacgaaatatgtggcatatgga

SEQ ID NO: 46485 - DNA, 213 bp, Oryza sativa
gcttgtcggtgcgctccttgatgaagccatccagatccatcgtcttcttgtatctgtctagctgtggcatggccttgaagcgctcaagaaccctcgtcgcctcctgcaccgacagccaaacctctgttgcttgcacctcgccctcaccatacaccatgaggcatgtatccacactacatagtgtcgacaactcgcttgccttcttcttctagc

SEQ ID NO: 46486 - DNA, 213 bp, Oryza sativa
ccgtttttatcaggcaaacattaacttgcatttattcgtttgatattctcgaatgtgtaaaataatttctttccataatctagtgattgttgcgatatgatcttccattataaaaccaccatattcccctttctttgaactcatatcaatctaaccatttcccatcaatccataggtgcagtcttgctagaaagtggtgaatcgtgaaggcca

SEQ ID NO: 46487 - DNA, 200 bp, Oryza sativa
ggcgctcccgctccggtgagggggagagaggcgcggggctcttggttcttggcgcttccgctccgctgagagggggagagcggaggagggcggttgcgacagttacctcccggcgcgcaaggcggctgcaatttgaagtagctctcccgttagctgacaggtggggccgcacttcctcagtcgctgacagtgggcccaca

SEQ ID NO: 46488 - DNA, 1501 bp, Oryza sativa
tgaaatggatcaaaaccaaaattcaagagctataagagagtgagcaaaactcgagggacgtagaagggatcggctaaactttcatgggcataggggaattctttcgtgaatataatgaaaattaaacatatgaatagaaaaatatgatagctttgaacagtaatgtgtgtgcaaaatgaggatttaaaaacaactgggacatataaaaatggtgcctgattggtatgaaacataaaaatattgagtacttcctccgtttcacaatgtaagttattctatcattttccacattcatattgatattaatgaatctaaatagatatatatgtctagattcattaacatcaatatgaatgtggaaaatactaaaatgacttacattgtgaaacggagggagtataagttagcgataaaactcatacttgtagtttaatccatgcaactcgaagcatttcacgagcaaagatccttttatggtgctccttcttacctccaaagagctaagatgatacaatagattttaacagttgattattcattttttttcgaaacaaaaatattttctcattgatattaatatatcacagcatatgaggaaatatgattaaatgtcataattacccttccaaacttaataatgcatgcatgtaggcatgcacacatgctagctagaaattatggtgctaatttgttttatatggagtaatggagacatgcataccaatttaatttcaaagttgtgacagtatatgaaaccacccgaaaatacattcaaacatcaagcatcacaaaaactcttctgcagaaatttaatttaaaaagtacaaattggcttttttttgtctctatgctgatgttttcatatctgatttgaaaattgcattttattctgattttatttttaaaaaatacaatttagattttattctaaatttaccatttagaatctaaaacataatatgtacactatatatattttaaagagtaaatttcacaaaacctaaggtttcgaggcatgtgtaacgcaaaacccaaaatattgtgatttatttcaagaaacccaacattttgggacaaaatatttcaaggaaccccatttatgtaaattactcattttacatataatatatagtactttaaattatatgttctaagtgtgctcaaaatgtgcatccctcccaccccagtttatctatttcctcacccactatgcatgattgcaaaaagtcaacacaatcctcaatataaatggtaggtcaactagttgcctaattaaaaaaaaggttatactattcataactcacatatgttgaaacagtggctactgtgtatgtacacttaaaaataccacatactattttttcacaatttattatgcataaatatattagccaaatagacaatgtaagcttgaacgtagggttcattaaaacattttgcctcaaaacataaggcttcgtgaaacaaatcgtaatacatgggattttacgttatgcatgcc

SEQ ID NO: 46489 - DNA, 400 bp, Oryza sativa
tagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtgatattttatgatttttgtatgaataaagatatcttataattattgtatgactgtcattattgtaagaataattatttgtgtgcggtttttttgactcatgtagatggatcggcaatggatgtacgcatctacgagacacatgccatgccattattctatggcgcaggcggtacatcatcctccctgggcgacaagcggcgtctcgtgcaccatctcctccggctcc

SEQ ID NO: 46490 - DNA, 784 bp, Oryza sativa
tataggacactcatatggggcaccatggtatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatatatatatatataattttttatatcgggatgataatgcactttagccattggttctgaatgggcttacagatcacttttatccctcaggcagaactctatgctataaaaaatgctgactagtcgccccgcttttcaaaagtcatttcatgtttcatattgtaggtattgatgtttaggctcttctatgtatatttctcctgcatccaatggatcatatatcctgaaggttcaattttgagggtttgtagaagaatatgatctttggcaactagaattcatgctaatttagttttttttttttactagcataaggcatataaaccctgttacatgtagaataaaatcctgattgttgtacgcagc

SEQ ID NO: 46491 - DNA, 1048 bp, Oryza sativa
agctttcaaagtttgttttaaaatataacagaacttttctactaacattttcttcctaaacaaatataaccatacatcattcaattttttaacgtaacttcacttcttatccaatcacactccttttcatttaattttatatattttcttaataaccgtaatagaggttgtagttcattgctcaatttcatcaggaaacaatcacattttcaaagaatgtgacaaaaacagtcacgaaaaatattacctctatcccaaaatacttgtcattttgagtttttgtttgtaacatttgactattcgtcttatacaaaagattatggaattattatttattttgtttgtgacttgctttattgtttgctcattcatcctttttaatattttattttatttaatatttttatttattttattttgtttgtaacattattcatccttttgaatattttctctaactttttaaataagacgaatggtcaaatattgtaagaaaaaaagtcaaaacgacatctaatttgggacggaggtaatattaatactagtatcaaccgcaattattgagcagctgatactaatacacttaattaatcacaaaatactactctatccattccaaaatataaggcacaaccactcttaacccaaagactaagaaataattattatcatctcatagtctggattaccctaataaatagaatgcatgcaaccaataaaattagatatctgatgatgaacgatgtaaataatacggagtaatattttagtggaaacgatatgatagttaatgatatgtatgcacgccttatattatgaaataactttaaaaagtagttgtgccttatattatggaatgaagagagtactcaaatatgttgggattaattgcttttgtgatttttaattggtcataatggcacgtagaagttagaacacctccttgcccagtatgtgtcacgacggcccggagtgcaggctccgatggtgatgaccaggtacgccggccaccgctccgtggggagggcggtgaggtagacggaggtca

SEQ ID NO: 46492 - DNA, 408 bp, Oryza sativa
caaataattgtcccgctccagttcatatgtctgatgaaacatgaatgtaaaggaattaagactttggttatatgattcgagtctgaattttcttatgcttatgcaaataatagtccaaaagaattggtgatttttttgtgtagttcatatggttgataaatatgaatgtgtctcaaaagcaacgaagattttgatgacaagacaatctgctatttgagtctgaaatttcttatgcttttgcaaataatagtcatagtcagaacgaattactgaaatttccctccagttcatacggttgatgaaacatgaatgtatctctttagtaattgaaactttgacgatcagacaatctgttgcattgcctagtcttgcagattctcatcgatccttttaattcttctctgcagt

SEQ ID NO: 46493 - DNA, 1501 bp, Oryza sativa
acctaaaaagtatttttttcttgaaaaacagtaagatagttaaatatgtgatatgcaatttcaccagcatgcaaaattaaattcagtttatataagaagaaacaaaataaaaatttcctttaaatagacgcgtaatttttattcagatttattgtttttgttttaaattgtataggttgaatttgaacttacatatttgtggaatagcatatcacatactctctctattttaaaatataaatatgtttagctatgaatctggacaaacacattcataatcatagctaaaaattactcacttcattttatattataagtcgttttaactttttttcattagtcatttttaagtttaagtaactttataaaaaaatatagtaacattttcgatacaaaacaaacatattatcagaatatagtgaatgttagttttggttaaactaatttggtgttatagatgttgctaaatttttcgataaacttaggcaaacatatttagttagagataatccaagaaatgtcattgacaagcatccaaatttaagaaatgccatcgataagtatgaattctaagaaatgccactgtacaaacgattttatttcagaaatgacatcaccattagggttacgtccattccgtgccgttaagtgctataggatgaacaatgtatttgacggcgctgtcagggttatggataccacatacctaatagtagttgactacatctcggcaggacccaccacataccatgtcctatacggaaacaaccttcggatataggaggagttccgataaggaaagacaacaaaagttcttcatggaaacgacaaggactactcggattgtatccatattggtttccctagttctacttagacaaggggacacctatgggtataaatacaagaccccctaggaggggaagagggcggacacccaccagggagaaccaacgcgatcaacacggtcaccacgatcgagaccccccatgagacaatcaactcccaacacaatcaacatagaagcctatatacgccaagacaagccgccggatatcgacatcagagatacgcctagatcgaccctatccggtaccttcagaggccggtcgtagggatctagcactgtctctgattccgtcggccgcgagctcgaggagaaaggctaccctgttgtcgactacgagtcagaccttcagaccgccatgtcgacaacagttagatagactaccccacatattgtacttgtgtgattatggtgaataaaaagcaacatcggctccggccaacaggatgtagggctattagctgattgctcaggggcccaaacctgtataaaaatccctgtctccatctcttttacctcagtctcgcgtatatcctagcaccgacgatccccatactgttcaaataccgtagtcgagacatcaaacgtcgacagtggcgcgccaggtagggggattttggtgcttcaggatttcgacaagataggtttaagaga

SEQ ID NO: 46494 - DNA, 1501 bp, Oryza sativa
ggaggtgaattgtgcacgggcttaatcagcacacgcgcgcaacaatattggctttctttcttccccgagagaatgctagggagggctgatgaagaagatttattcagacgacttgacgatgaagttctggcgcctgacggggttcatcaccaccgggcggcccgtccgtccgcggccacgcctggaacttcttgtccgtctccttcccccactcgtcagtcgccatggtccgagtcgtcgtgcctagttttgccaagaaacacatgtgcaagcaagcagtggtcagatgctgatgacctgcaagctactttgtttagataatggaatagaatatcggcctttacttaacgagttacagtcaattattacaccaattcactcaatcacgagcacacctcaacaagtcataaaacacaaataaactgaagtaaacacaaactaataaacactaacacaagagaaagagcacataaactgcaagctacgtacttaagctagctaggcagcttagctaaggagatctcggtggtcagagaagataattaagctagctcacctccaagaagctttccttccgcgatgtagatctcgcagacataggcgaatgcgaaggatgcagccactgatccgatgatgtacttggtcgccatgctgtgtgatcaccagcagctagctagccctgcaaaaaaaaaaatgtgatcaaatgttaaagattcggttttttccctactccagttcagttttgcgagaaaaaaaaagaaactgataaatctctggtacatattgcagaaagaagagtatgcatgaactaggagacatctaaagcattgtatgtacaagaactggaacggcaaacataggaaactgaacagtcaccttgagcaaacagtgttggttcctgagatgtctttggaactatggaagcagtagagagcaaaatgtttgaccctaattgcgtgtatgtaagctagctatgtggcggtttggcatcttaatactgcctagctagcaaagccaacttgcctgtatcatagtcgtttgaaaattgaaatttgtgacttgtgaggcaggtggccagtgccatagactaatgaaacagtacgtggttaaatgatagagaaacttagcttggcattgcttcacaaattgttggtcgccgtcgccgccgctctgcttttgagcagtgacagctagcagccatggcaaaccagggcaaaacagggggcgccgctgtattctggtcactggacattaaaaaatattcagcatcgcctattgacgttaacgaactcctactgcgttatatattgtcattttgcgtattgttctcgtattcttatccccatagcaaatatcgtcttggcgaaaatcatgtgcttagactttgtgatggtagtatactaaattcctgctttaaccacgatccactctccgaggcgtatgccgagcacgagcagtgaccttgacgtagattgaaggaaaagaaatgctcacatatcgc

SEQ ID NO: 46495 - DNA, 1501 bp, Oryza sativa
tggtcctgtttggcacggctccagctctagctccatctctcctggagctgaagctcaaccaaacagtttcagttctatctaatatgggagcggagctgggtagagctctctcacaaaatgaactagagaggtggagctgggtttaggcagctccataactctactccagactcaactgctggagctaaatttaggaattggagctctaccaaacaggctctacatgcagtttataaataaacagttatataaaaaattataaattttaataagatagcttatgataatataagacactgtacaaacataaaagtctaaattcgatcaacaaaataacagaattttttttgtcgtacaagtattattcattaccgatgttaccaattattttttatatttttataactattcaagtcacgagcaaataacgggtgtcatgatagctgctgcagagaaccctgtcaaccgagctctgctcgtcagcccgtccgtcgtgctgctgcttttgctgctccctccatcctaaaaatacttaatctagaagaggatgtgatttgtccagatcgttattcagagtccatatcgtggttgagtttttttaagatgtagggagtacttggcaaggctagcaaagtgattcgctatatgtagttatgagctgatcattaattgattgcatgctgcttgcattaaaaagggcgatatgtgagcatttcttttccttcaatctacgtcaaggtcactgctcgtgctcggcatacgcctcggagagtggatcgtggttaaagcaggaatttagtatactaccatcacaaagtctaagcacatgattttcgccaagacgatatttgctatggggataagaatacgagaacaatacgcaaaatgacaatatataacgcagtaggagttcgttaacgtcaataggcgatgctgaatattttttaatgtccagtgaccagaatacagcggcgccccctgttttgccctggtttgccatggctgctagctgtcactgctcaaaagcagagcggcggcgacggcgaccaacaatttgtgaagcaatgccaagctaagtttctctatcatttaaccacgtactgtttcattagtctatggcactggccacctgcctcacaagtcacaaatttcaattttcaaacgactatgatacaggcaagttggctttgctagctaggcagtattaagatgccaaaccgccacatagctagcttacatacacgcaattagggtcaaacattttgctctctactgcttccatagttccaaagacatctcaggaaccaacactgtttgctcaaggtgactgttcagtttcctatgtttgccgttccagttcttgtacatacaatgctttagatgtctcctagttcatgcatactcttctttctgcaatatgtaccagagatttatcagtttctttttttttctcgcaaaactgaactggagtagggaaaaaaccgaatctttaacatttgat

SEQ ID NO: 46496 - DNA, 1061 bp, Oryza sativa
tattattgttatatggtttaattaagatgaaatgctctgtgggagttcgtttggatatatatatttttaagaaaatcatgagctgcagttaggagtccgatcgtctcaagttagcatgtgagatattttaacagatttcttatatgattccttatgtattaccaaaagtgaacaatcttaaaaaccgactcaaatacagatatgtatttccaatttaaaaaccgactcatacacggatgtcgaactaaagcaaaagaacggcagctaacaagaagtctacattcttctccatctttccatccatttatcactgatttccggtactgctagcttgtgtgtgtgtgcaagctccatcgtaaatatgtttgattcacccatgatttgcttgttcttgcttatgttctgttgtgtgtgcgtgtgtgtttcctccatttgttccgcgcgaagcagtataccgtatgcttgcaaaattactacaagcttgctcctgtatttccaaaaacaaacaaacgaacttaaaaaccgactcatatacagatgacgtaccaaaatataataaaaacattttcaatttttataatagtatagatatagaagagaagagatatagattaaaaccaaaacattagattaaaaccgacttaaacacagatgacgaaccgcgaaaacatctttaatttttataaccgactcaaacacgaatgacaggccacggaaacatcttcaatttttaataatatataattattattaattgtttgtctatgtggtcagaattagaaggaataaatttatatatccgtttgaaacaagggaatttcacaggagtattgtaggaaactatttagttagtgtacgaatatgaaaaattttcggaatccaaacaagaatctctagaaatcccttgggaaggtaatcccaaactccaaagagtcttcagctgcatcttccgttcttctcaggcagaaataaacgcaaaggcgacttccaaacaaaccacccttagctggagaaatcctactagctcagtagtatcaggtcatcaactgcacacagatgta

SEQ ID NO: 46497 - DNA, 275 bp, Oryza sativa
attcctgcagcccgcgtttggtggaactcgtcggaattcgcccccggctagttcaaacatgtggggttctgcccattagttgaaccagttgtgttttggtgaacttgagtgtatattagttgaaccagttgtgtacttggagggtttagggtttaagcttgagtccctcttgtacttttacgatttctggtggctccctaattctagcgagttcaatattagtaagttgttttggtgtgatcctgacttctccctgggtttcattcttcatatgg

SEQ ID NO: 46498 - DNA, 252 bp, Oryza sativa
catttctgtacgctctctgcagcggtactggtgagtcctatttccatttgattctgtaccacattgattgtcgtcagttattgtccttacaccaccacatatttgaattcagaatcttgtttttcccgtgaatcccatttcaatttcacaacggaacatactccagtcttctcacgaataatagtagtactagcatataatcaaacaaagataatctgggaatcttgagtgaagcacatggggggaaatagg

SEQ ID NO: 46499 - DNA, 598 bp, Oryza sativa
  unsure (1)..(598): unsure at all n locations
tccatccccatttntgtttcatgcttctacgaatcgctgctgggttgtggaatttggtgtagttttaacttttaatcgcgttctgattcccaccgaatcgtgtttgaaatgaagccctatctgctgcataattcttcgtgacttgattgtttatttgttaattcctaaacagggccaccatattggaatcttcagtctgtgcgatcaacgatcagtgtcagtttgtagatcaagtggtacatttgtggatgtcagaatgcgtagcagctacagctagttttatcagttagattcttaaccaagctgttccctcttatgtcgacatagcatggtcccgtgattatatgaagtgcttaatgccatttgagaatttgagaattgaggatgcttacttgcaatgcaaatgaacttctggctactttattgctgcattgaagctgtgactaggaagattttatattactgtttcctttcaaatgaagaaaattctagaatctagataggagtacatcacttgaaaacagaatgaacctcctggttagggatttcaaggaataaaacagctcgttctcaaggctgtcatttcctgttctatttc

SEQ ID NO: 46500 - DNA, 1501 bp, Oryza sativa
aattctactgcggaaagcagcagcacaaggatgagcttaatctgtcgattcagaaacttaagttattgtcgtaaatatatattgattcattcatcgtgcatgcatgaattcgtatatatttcatgtcaaaagttattgtttcgcatggatttaaatatttataggagtcaatcgatatatccggtttttcatttgagaaatatgaatcagaaatcggactgatatttgatgaagttaaattggacttattccttgtgggttaaagcaaaaaaattgcctaacttaaaaggcgaaattacataaaacaccctaattatcagtgttgttttcaaattctatcccataacgtattttatgtaaaaaaaaaccacccacctaatactactatgttgaaattgctcccatcatagtttacacatgcaactaactgattcggtctatttatttgagttaatcccttgtgtacccataaaaatttgcccaatctcttctatacctttcaattttactcgaacccctctgtacccctaaattctcgctttgatcccttccatgccctcccgttaggttttcttcattttatagttatgtgtggttgcaaatgtctataatgccctttagatggaggagcaactgcaggtagattggaaaagaattggaatatgttgaccgcacaacatgtgtattttatgagactaataatgagtttaaaacttttattgtggtattggaaaaaaaatgcaatccatcgaacgatttgttttgaaaaaaaataatagggttggaaaatcaaagtgacatcagtttgctgtgtaaaaaaaattggtacactcaacaggaatgtggacaaaggagaaaatctgtgaaacaaaataatctggatcaataagagcatcaagatcatcatagatcatcaatcaaaatagtagtaaccatacatagcacttcatatcaattttattttcatcatccatacagagcacttcatataaatttcatacaattttattttcatcatccatacagagcacttcatatcaatttcatttttatcatccatacagaacagctcatatgatgcacataccacaatttcatttccatacccaatagtgcaggaaccaaaccaactttccactccatacacaaatgttgcaaatgacagatcaaatatgtcaaacactttgtaaggcatcacaacagcaaacaaaaatgaaaactgcaagaagaagaaatgaaaattgctgctactcctaccagtagggcggcgcagcgacgagagggtatcggactttggccgcacgacaggaggacggtggccggcggtgcctgcgacagagggctatgggcggcagctgcgcgactggaaggcggtggccggcggcgcgccaccgcgcgacgggagggcggggaccagcggcgccctacctcgcgacagaagggcagcggccggcggcgcgcgcgacgggagggcgtgagccggcggcgccccaccgcgcga

SEQ ID NO: 46501 - DNA, 853 bp, Oryza sativa
tatccgatccaaatctccacgacacgaagcacgcacatagctaaaaatcgaatcgaattgatgtggatggattgaaaagggggaaagagtacctggccttgaggtggtgtgggcggcgaggtcgcgggaggagtacttctgcgagggcccgaagatgcgggtgccgccttgctcgttgccgcccttggccggagcccaggtcggccgcgccgccgtggtcatcgccgcggccgcgcgattgacaaggaaggaaaccctaggcggcgatggattcgattctctatcctctcctcgacgagacgagacgacgcggttgcaaaattgcagagaagcccctgcagaagcgtgtatatgtcgaggaaggcggttgtgttggtaaatgggccagcccagggaggatgccggcccacataaataaataaatacggaccccccacccacaaaaacgatccgtccctttttttgttaaagaagaatgatcaataattgtacgtataaagtggtaattagtaaattggattaggattacgaatgtccggttctaactagaattctgtgtatccaatccaatccaggtaggataagaagttaatcttattcagatccgaatcatgatcgatttgtgttaattaatttgcttattacaaatacacacaccaggcaccaatcgatctatagatcaatcaatcacggtggctagctcaaaaacaagaaaaccaaaactcttggatcgatcgatcaatggggtcaggtttgtcatgcgcaatcttattggagatggccggggaagcctgttgtaaggtgaggagttcagttttgagagcagttggtcgtcggggtacaagaaggacga

SEQ ID NO: 46502 - DNA, 1501 bp, Oryza sativa
gggattaactcaaataaatagaccgaatcagttagttgcatgtgtaaactatgatgggagcaatttcaacatagtagtattaggtgggtggtttttttttacataaaatacgttatgggatagaatttgaaaacaacactgataattagggtgttttatgtaatttcgccttttaagttaggcaatttttttgctttaacccacaaggaataagtccaatttaacttcatcaaatatcagtccgatttctgattcatatttctcaaatgaaaaaccggatatatcgattgactcctataaatatttaaatccatgcgaaacaataacttttgacatgaaatatatacgaattcatgcatgcacgatgaatgaatcaatatatatttacgacaataacttaagtttctgaatcgacagattaagctcatccttgtgctgctgctttccgcagtagaattcggctgggtgcagaacgcgtccgggcgggcagaaggcacaatcgttgccattggcggcggcggcggtgagatcggcatcggccggcagctgctggagcacggtgcatgtgtcgacgaagaagctgtcaaggacatagggggtgaagcggagctccgcgaaaaccaggcaacgctgcttctgccagtggctgttcctcgcgcgagtgcgagccacgaagttgatgtggaggtagatttcgcctctgaatcgggcgcagcaggcgttgatgggaggcggcagggggatgagcttgctgtcctccacgggatcgaactccaactcatcctctgctctgctgcagaagaaggcgtggtaaaaggggaggacgtccatgatgtactccacgcgccgctctttctccgtcactggcatcgtccttcttgtaccccgacgaccaactgctctcaaaactgaactcctcaccttacaacaggcttccccggccatctccaataagattgcgcatgacaaacctgaccccattgatcgatcgatccaagagttttggttttcttgtttttgagctagccaccgtgattgattgatctatagatcgattggtgcctggtgtgtgtatttgtaataagcaaattaattaacacaaatcgatcatgattcggatctgaataagattaacttcttatcctacctggattggattggatacacagaattctagttagaaccggacattcgtaatcctaatccaatttactaattaccactttatacgtacaattattgatcattcttctttaacaaaaaaagggacggatcgtttttgtgggtggggggtccgtatttatttatttatgtgggccggcatcctccctgggctggcccatttaccaacacaaccgccttcctcgacatatacacgcttctgcaggggcttctctgcaattttgcaaccgcgtcgtctcgtctcgtcgaggagaggatagagaatcgaatccatcgccgcctagggtttccttccttgtcaatcgcgcggccgcggcga

SEQ ID NO: 46503 - DNA, 1035 bp, Oryza sativa
atattgagcttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactctgcacgagtatcgacggtcgccttcaaacttaaaatctgaaaaacaacttgggtaaaacttgggttttacaaaagacttggaaaacccgacacctgggtcggtgcttgcgaactaaataaatttccaaaaccgcggaccggggaacgtaccgggtgtacggtttcccgctcttgcacttaaggaccgtttccttagaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttgaaaatgccttgtcatgaaagcttggaggtctcccgacgtggctgatccccacaggctgggtgatccgggttagtaatgtcgtgtgggtaaaatgtaccccctctgcagaggttaacaaactgttcgaacagccgtgcccacggtcatgggcggatgtgaggtgattcctagcgtagttttgtttgactactccttgtgaaattgctgttgtgaaaaggggatcgatgtttggaaaatctgcagctgatgggatcagctaggcccgggtggccgtttgaaagttgttggcccgggtggccgtttgaaagttgttggccgggtgccaatcttgatcaattctaaagactgatacattgcacatactccgaccagacgagacgcactgtctcatccgtgtcgtttgagaagcactcacttagttgttttc

SEQ ID NO: 46504 - DNA, 1501 bp, Oryza sativa
agctagcgctttgttggcgagttggacactttggattggtctaagagccattgtcagctatggcacgtgcattcttttcagcatctcgtgtttttctgtcaaaaaaaaaaaaaactggagaattggtccagagtggcatgtattccagaccaagattctgtggccgcgtcaaaccaaaatcaactctggaaacctccatgattggaacccaacaattttggacgaaacaaaaaaaagaactttaattcaaaaccagcaaaggattgagagaaggcgaaaaataaatggtatcccgggagcaactgttcttgaaagctatggttccttttgaactaatgaatttcgtggaatttttataggaatttcactggataattaccacagattatttgttttgcacctctaataaagcattttcttaacttttcttaattaaattttttttcttctactgcattgcttcaaccacttatcttaagctatatcttagatttatttgttaaaatattcaatttatgcctataaaataaataaataatccgcgacaatgatcacaggaataccatctccggcctatttgccactcatagccagagtgagcaactgattggtaggcaatcatatgggatatgggatagtgatataacatatttcaactaaaatagatattcctgatttggcaattatgaaatgttgggcaaccaaaagacacagtaccaaaataccatttgaactaaaatagatattcctgatttatagggcagacgaagtacttacttgcatcatataaatttcatagaattttcatatcaattgcacacaaaaacagctcaatgattttgtgcaacatcccaaataaactagaactaaaataaaagagtactgctatacgtacgacccaattgtataattcatgtacaactaaaaacatataatcatatatcaataaaaaaagagcatgttcatacgccctgcatccgttaacaacacttaccaaaatttagtcgcacatgagtcggacagttggaacgtatgtatagcaatttccaaaacaaaattaaaacaccgcgggaatacaaatacagctctgagtagcacctaaaatcccgagttcaaatctctatatgagcgaatttcaggtcgggttatttgcagggctaagttctaaatttagtgtctgaatataaccgactggatgtagaggccgagtaaaaaaatatcattctctaaaaaaaaatacagctctacttcttctcctaacctcctttgatcgttcgttggtttgttttttttttcttttctcgcgtacagctggacgcttcgtttgcttctcccgttccgtctcttctcctctcctcttcttctcccctctcctctctccacttctactctcacctctcgctaccaaacacgcgcacacgcagccgagatcgagagcgagctacttgccctagcagcagcagcagcgaggagcgcgagggggcggcggcggcggcgtgca

SEQ ID NO: 46505 - DNA, 444 bp, Oryza sativa
ccctaataagacaaaggtaaagtcaaaattttaaattttgaactcaatttagatgttggttttagatatttttatcgtagtttttttttcagcattacttcctccatcacacaaagactttatttttcaatttttggatatgacatttgactattcgttttatttaagagttttctatgattaatattttttatttctagaaacataaaaagtactttatgcgttaatatttttttcataatttttttaaaataaaattgacggtcaaacgttggacatataaatctaaaaataaagtttttatgagacagagggagtagcttttaagtcactacgtaatatatataagttttacttataagttagtttttattttgttaaaataagctgttttagcgaggacattccacacatgcaggcgtccatgtccgttctccttctaga

SEQ ID NO: 46506 - DNA, 163 bp, Oryza sativa
taaacaactctgaaatatccattttaattgcacttaaaattcggttggtcgtttctcggccatacgagctcctaattgactcgttcaaattgtttaatttttgttataacttaaggaaccggtgtttgatgttgttatgtattgttatcgtttctttcttaga

SEQ ID NO: 46507 - DNA, 189 bp, Oryza sativa
taaccgattatgagacccgtgcctgggttaaagaatatagcattcagactgaatcgttcatccctgttcttgagtacgatgtaaagccattgctggtattagatgatgggaggatactcatatggttaggatcgacaggactactgctcatatatgatccaagaaccagcagttttgcggaagtcaaga

SEQ ID NO: 46508 - DNA, 426 bp, Oryza sativa
tcgccgaatccgggcgggggctaggcgcgggctccccgctccccgccgatcgaatccttcgaggttagaaacccccgcggccgccctccccccgggttttccggggctcccccgcgcttcgcttccgtccatttcggagggttttagttcgggttttgtggagtgggggtgtgtggtttcgttcgtggtgggtgggtttcgaggggtcgtggctgtctgatcggtgcttggcggcgtggattcggattttttttcttccatcgttttgtcattttcaacccattttctggggatttaatgtgtggggaatgaggagcgggttccatttcgcaatgtgcgagtgcgaaatttgccatcgttacatcttatccgtgattgttgaacttggtggatttgggggctagggtttggggattttactaaaat

SEQ ID NO: 46509 - DNA, 262 bp, Oryza sativa
gtgttatatgagacacacaacttgtcgacgtttgaggtcgcgactacggtatttgtatgtatggggatcctcgtaccaggttatatgcgagattgaggtaaaagagatggggacaaggatttttatacagaatcgggctccttacctgtcaaataatagccctaaatcttggtggccaaagccggtgttgctctttattcatctagatcacacaagtacaatatttggaataacctatctagctgtcgtcgacttggcagca

SEQ ID NO: 46510 - DNA, 1501 bp, Oryza sativa
cgtggcattgcagcctcgtccccaagaccccaagtgtcccgctagtcctctatcccaccgcttcccgagcagccgagcaggacacagcggtagcctttatcgtcacttgtagctggtagcgatgatttgtttctatttgtaatgcactaaaatttgttttcttcctttggaaaatagagattttatctttgcttatttgtagggattgagatttaaggggatatgatgctttttttagcaataacccatataaagacctataagaaaatacaggggatatattttaggaacgtattactagaaatacagctagcaccaactttcaaccttctttcttagatgttgcgacaattgtattgcacttcttcgttgatgtaaccatatacaaatatacgcacgggtcaacccccaacattttttctaacatcatatatgccattcactcaaaactcatagcttagctttgtgcacatcaatagcttacaactaagtagaggtaattattgttgctatctatgtttggttttatcttaaaaataaaatattgtaaatcataaagcgactttgaacaatcgagacaacatcactaatggcttaaggttttaatgtttgagctagcaccaaccttgtgacgacctagcatatgtaacttttttcagcggaaaaaatccttatgtatccaatcaaaacatgtagttttctatatattaattaacttacaacttagtacttatcattgttacattgcatgcttgaattaccttaataagcaaccttaataaacatttaaactatagtctataaaacaacttagagcaaaccagaaactatcatcaatgcttggaaaatatcatacctcaccctgtttccggctttcccataaaaaaaagagaaaagcattcgaaaaaaacttccattttcttagctagcttagccaaacataccaactggtatcaatccaagacaagtaaaactattttcttaacacaataggatcatgtatgtcattcacttaaattttgcagatttacgcaaattaattaaattgcatgcaagcaccatttattattaccatctatgtttagatttaccttaataaaatactatagaccataaagtaactttgaacaagtaagaatacatcactagtggcttaaggatttaatgtttgagatagcaccaatctcgtgataactcatacttttctcccagggcaaaaattacaaatacatccaatcaaaactattatagtttataggtaaaaaaaactattagtttatgtatattaattaatttatatctaagtatctatcactgactgggaatatatcctaataaaccttacaaaccgtataatatgtaaagcaaccttaaacaaaaccatgtattttagcatcactggttggaaagcatcagcagcagcctcatcacctcatcaaagcctctgttcctggcttcctgcctgccgcaggaccaaggaaaacccaaaccatcacccccc

SEQ ID NO: 46511 - DNA, 348 bp, Oryza sativa
cctcgtgtaccgttggagaaaacaggtagtacgtcgtttcttgtctctctgaaacctagcactctctggaattcaaaaagaaggcattatcttcgaacaaaagtcattctctaagacccttctatgaaaaggcagaacattttttccttttaaaaacaagatgagaaaaaaattaattgtcgctatcgatattcctacctttatatttttaatcctataaaataaatgtgaattgtaacggtcaccatctcgacccattcacaactatatctaatagagaaaaagagttttgtaagtatataccttcaggtgattctgaaactaatccttcaattccgttatataaga

SEQ ID NO: 46512 - DNA, 236 bp, Oryza sativa
gccgcgccgctcgacggagaacgtggccgacggggagtcgacgccgacggggaagggtcgtcggccgccgccgccgccgcctcggcggcgggaggggaggaagtggtgggcttcatgaaggattggggatttttttttttgctcctctcctctctctgattgttttttgggatgcttttctctcttttttttttctggggggtgatggtttgggttttccttggtcctgcggcagg

SEQ ID NO: 46513 - DNA, 834 bp, Oryza sativa
gtaattattaattattttcctatcatttgatttattattaaatatatttttatgtaggcatataattttacatatttcacaaaagtttttgaataagacgaacggtcaaacatgcgctaaaaaatcaacggtgtcaaacatttcgaaacggagggagtatataaaaatataagtaatgctagaaaatcctacattatgaaatggagggggtaagatacaagaaagatactgcctacataaaaatatatttaataatgaatcaaatgataggaaaataattaataattacttaaattttttgaataagacgaacggtcaaacatgtttaaaaaagtcaacggtgtcaaacatttcgaaacggatggagtatataaaaatataagtaatgctagaaaatcctacattatgaaatggagggggtaggatacaagaaaggtacttgtactactacatcctaattactttactgtttacatactcccaagaagaaaattaggggatccaatttttgggtggctctgaattccgatgatgctgtaaaacatcttcgcgaaatttccgaacgcatcctctccttttacgtaaaatcacatttcaacccctcccgagtcccgaatccgggaaaggcaaaaaaattctcctcctcatcgagtcatcgtcatcgtcctcgtctccgactccaactctccatctcaaaatcgtctcactcggtcacgcctcgcagcccgcatcccatcccatcgcatcgcgtcgcaccgcaccgcaccgcaacccgcccaaaccctaaccctcgcgccatctcgtcctcgccggcgtgctccgccgccgccgcca

SEQ ID NO: 46514 - DNA, 531 bp, Oryza sativa
  unsure (1)..(531): unsure at all n locations
catctccatccgtgtacttttgtttataaccagactgagccacaaactaagccttacccactagacatgtggaagtacggtagtgctttgcaacagaggcccgaagaccggtccttatatggccgaggcgctactatcaaaaccatgcacnccgagcccagcctaaaaccattttgaggattttgaatagagggggaggtgtgaatccaattccacaataatccaaccattccatagtgtccaggtgatatgaatattccaaagtctagagttgtaaaaccacctaatgttgcctatttaaccagcgaagcatctatctaaaatcatactagtggtaccgtgagtagagtgtccactagttggggttttgtttattctagggtgaacaaggaaataataacaataacaataataaggtcataacaaaggtaaataggcatggctagataaaacagtgataacgcgggaatttaaataaagcgataatgcagtaatttaaatcaacataaatttataaactgggattcaata

SEQ ID NO: 46515 - DNA, 1154 bp, Oryza sativa
cttcccgagtggaagcggattgttgtgctgctgggcagctggactctgggagtccgagaaaatgaaaaaggctctgggagccgattaatcaaatggaatggctctgggagccgagaagtaatgatctgacccgggaggtcggtacattactaaatgagctgttgaaaaaaaaacatctcttaatgtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatagttccccggccctgaagagaagataaagtgaagtgaagattagggtttcgtcctggttcccagccgtcgcctgtggtgttgggtgttagaccgttgtcaaatatttctgacaggaggaagtatcaatttatttcatgtcttatattaattgatgttttttagtatactagtttcaattaatttgttatcagataaattaaatgtcaatggtggatccttaattcatcatctataatgcttcctagaattaatggacatccatttacaatttaagtttgttgagaatagtcagtttcatgtacatatgtagtggtatctattcttgctgaaatttgtattgtttttattcgtttctgataccggtatcttattaggcacaaattaacgtatataagtaccgctgctatttttagtgaaaacattactttggtctgatatccagtagtagtacgttcagttacttgattatgaacacatatatattatctgtatttccatgtaataaactatttttcacaactctggaattcttttttcagcctggaggggacaatcgaccgctacattagccacacccaagaggcgcctgcaaacaagaagccccgtgaacttactgtaaaggtccttgtggatacattctgaattcctcatatctatcaaccatgatcatatactgttaggatcgatgacgataatgtgtgcaacttgcattaatttttttttcttcacaactactgcatacagaatatgaaatctcaatccgaaaccttagcaa

SEQ ID NO: 46516 - DNA, 1501 bp, Oryza sativa
tgacatgtatagatggatattaacaccggtcactgtaagttgcattggatagatagcgccttttgccccacatgtcagtgacattattggcagattaatccggcagctagtaggtgcagtaaataggcgtgtggttgatgatgagttttttaatgatacctgatcgaggagcagtgcgttctcctccgacagaatcttctcctgcatgttcagtttcgtcagttaatcacacatggatatatagataatcttttgagatttgtatttgtatcaacatcttttgtaaagcagtacactccaggaagagacggcttgttgaggcgaacaagtgtttccatctaatcatactgatgtattactaacaagttatgcaaaaatcctctttcagaacaataattcttgtcagccatgctttgatatatattatattcagatacataagtgcatacctgttgttgtagctgtgaaatcttatccatcagcttcttttgctgcaatgttgacggacaacaagaaagatatttatgtaaatctgatcaaaatgcatatatcatagagatattcacaacagcaacaacatagatagcacattgcgaccatttgcttgccttttgtaaacggatgctgcttaggctcttctccatctgcatctccaggccatgcagttcttgcaacgagcatgattccaggttttcgccctgcatcttcctacgtgaaaaatcattttcatctagtcatgtgaatttccccaccctaataattaggaacatatagtaattgccagtctgcatgatttcatatatattctgataaggaataatcattgctattatagttaccttgtgtatgcctcaactgtgtcaatctccattgctaaggtttcggattgagatttcatattctgtatgcagtagttgtgaagaaaaaaaaattaatgcaagttgcacacattatcgtcatcgatcctaacagtatatgatcatggttgatagatatgaggaattcagaatgtatccacaaggacctttacagtaagttcacggggcttcttgtttgcaggcgcctcttgggtgtggctaatgtagcggtcgattgtcccctccaggctgaaaaaagaattccagagttgtgaaaaatagtttattacatggaaatacagataatatatatgtgttcataatcaagtaactgaacgtactactactggatatcagaccaaagtaatgttttcactaaaaatagcagcggtacttatatacgttaatttgtgcctaataagataccggtatcagaaacgaataaaaacaatacaaatttcagcaagaatagataccactacatatgtacatgaaactgactattctcaacaaacttaaattgtaaatggatgtccattaattctaggaagcattatagatgatgaattaaggatccaccattgacatttaatttatctgataacaaattaattgaaactagtatactaaaaaacatcaattaa

SEQ ID NO: 46517 - DNA, 1501 bp, Oryza sativa
ataagttttgcacgaaaccgttgacaatttggcaggacttttagaaaataaaaaagaacacaaataataattatgaacgatttttaaaatgtcaaagacaataaatagatgaggctgtggacggaccgaagaggagtacattgacaacgtttgacaagacttctaaaaattataaaaacgaaactcaacaagacaatgaactctaagaactacaaggtctaatttttaaagttctaaagaaaatgtggtagatcgagaaatcaaataaaggggtgactgaaaaatataaaattagaaacacgagaatgatatttttaaataaaatcagagcactatatgagattaactaaaattctaaatttaaaataaactaaatcctaaaattagaaaaagaaaaaataggagttcatctggaatacattttataaataaataaaattcgtaataaaaataaagactattgaaaaatataatcccaataacgattaagaggagggacgacgggcacaccgttaagcagcacggttatggcggttggcggaacttatagaaaataaaataaataaaccccaatgataattatgttcgattttcaaaatctcaatgacaaaaaggatgggaggcagcgggcaggccgtagaggagtatagtggcgaagccgctaatagtttggcgggactttcagaaagtaaaaagaacacaaacaataattatgttcgatttttaaaatcccaaggatagtaaagagatgagatagtaaacgggccatagaggagtacattggcgatgtttgatgggacttctaaaaattatgagaacgaaagtcaactagacaatgatctgtaaaagctacaaggtctaatttttgaaatttctaaagacaatgaatagtcgtagtgatagatcaagcaaacaataaaggggtgataaagaaataaggtgcaataaaatttgaaacacgggaatgataattttaaataaaatcatatggaaaaaatagataattttatatggatgctagccgcgcaattgcgcgggccacccaactagttcggtagtaatagattggtttttttataggacggagggagtatatatgtatttggctatagcgagcgcccagcatgtcagtgactgatgcaaagcatattcttcagaaagtaaataaataaagaaaatataaaaatatatgtggtatgaagtgtgaagcgggcattggtgcagtggaggaggggaggaagaagggccatttaaggcgaataccatatatgccaagtgtttccaggtttgggatgctttcctttgcgaggaaaatcaggtaacccaattcaaggccccccaaatcattcattctttcaatcgccgccgctttcttcttctacttccctatccgatccgtacgtctcctctcctctgcagccagcagcgacatagatcgatctgttcccggccggcgagccggagtagatctctcgcataccctgcacgcacgtactgctta

SEQ ID NO: 46518 - DNA, 1501 bp, Oryza sativa
gtggggaggaggccggcggggcgaggcaggaaaggaggtgcggcagccgatggcgacggcggcgggagcacggggggaggcgaagcatggggaggcccaactgctcgtctgccccgacgacgccgcggcgcgccgtcgtgattgcgggagaggctgtcgacgatgaggaacggcgcggcgcggcacggggcgggaggcgagcgcggtggtgggaggaggagggcgacactcgtccccgccggatggcgggatggcggctgatggggacatggacgcggtcacggctgctgcggaggatcaacatggagcaggaatcctccccgccgttccccaatcttgcatctaaatcgcctattttgtcgtcggcagcggagatcggtttccgcggagctcgcttgcgtggttttcttgggagaggagcagcacaattgcgtggatgatgtattgaccggcgacggcggctatggccacggacgggtggatcgatcgattccgctggagaaggacaacgtcgtcccatgaccatgaagatcgagagggcaaccatgaaacaagaacacacaccaaaagctctcaaaattcagagtatgtatcaatattcaagatggggtcgcggtggctgggtacgaaaacggagctcccccgtcctcctggccgaggtaggcggcggcggggggagcaaggcccctagaggtaggcggcgacctcgacggcgagcagcagcagggataggacgaggaacacccggatgcagccgtaggagcgcgcccgcagcgctgtgctctcccccggcgcgccgtcggcgtcgatccgcctcgcaatctgctctgggcacgccacccgccgcagcggccgccgccattgtagccttcttctccggcgcttggccccgcgcaacggcgccatgctgcagaggcttcccgcactgcaccggacaaattaaatcaggaagagcaagttcatcgcgggacctgacgaatcaagaagcagcagcgaacatgaacacaggggaagtctcgccgaggagggatgtcttacggctgcgatggcaagcatggcggacgcggcgcccgtcagccgccccgcggcgtggtgcgccttgaccggcagcacccaccaccctttgacgcggagctcgcggccacgcaggaggagctccccgccggcctcctccccacccgccggcgccctgcagagacaagattgagagagagagggggggagagaagatgggaaataaaggctgttgacgtggcacactgacacgtgggtctcacatgggtcccacgctgatttagctgccacgtagactagaaccgggtcaaaaccaccgaagaacctcgggtgaccggtcttatatagttaagggatcccaaatatctggttttgcggttcgagattgtttttatattccgatgacaagttgagggaccttcggtgtaccttttccatcccattccccccattccggcctctcacacgctgcgcgaaaaagcccaat

SEQ ID NO: 46519 - DNA, 1501 bp, Oryza sativa
taaaggacgatcggaattgttgatttcgtacgtcattaattcctgcccgacttgggataaagctggacgacaaatcgagctcgtatttgaaggcctcattgtttggcttatgcttattcctataaaccaaaatttaaaatttagaacttaatttgaattcaaatttttggcttttttatcgtacttttttttacatcatttgcttttgagtcgctaagaacatatgtataaaagatttgcacacaaataaaatagtctttaaacgaaacaatgggctgtgattatttatccacacgtatgtacaaattaaattggctctacccgttgcaacgcataggggtatttttttctagtatattattaagaatataattatgattagtttgaaaagagtactcaaattcactctctaggcatagaccgtaagcactggatgaacatcagctgttgcagccacagtcccagccttatgaacactcgtatagaaattattaccagatcgaccggccggataaatcgaaaggcacatgttgcagaaatgtttatatttagacaaaatttaaatcctataaatcatttatattctggagcagagggagagggcgtagttgtttatactccatccgtttcaaaatgtttgacactgttgattttttatacgtgtttgaccattcgtcttatttaaaaaatttaagtaattatttattcttttcatatcatttgattcattgttaaatatacttttatatacacatatagttttacatattttacaaatttttttaataagacgaacggtcaaacatgtgctaaaaagtcaattgtgtcgaatattttgaaacggagggagtattagttagctcatgcgcattgcatacctacatgcgggtatgagttctttgggcactccaataataatctcctattttaaaagccccaaagaccaaatgaaggttgccccatttaatttcctgagaacctaaaagctctaaaccgcactccaaaccacttactccctccggttttattttaattgacattttggacaatgacaccgtctacaaaatataccttgaccttattttctattataatatatacaataaataaatacatgtttacttttattatagtgttttgaaagacaaatatatatatgttgttctagtttctttaaactaaatatttttaaagttattgatggttaaagttataaaagtttgaccttaaccttgttcaaaacgttaattattatagaaccggagggagtaggatgcaaaataagctggtcttgatagttgagagatattttatatttggtttaacggttgagagatgcttatcaatttgggcaatatatgaggggtcacaaaaagacttttgaaaggcttttatgggccaatgcaggtgcggaatccgtcttgggcagagtatgtgtcatgggccgtgcaatggctcaccgcttattgggctttttcgcgcagcgtgtgagaggccggaa

SEQ ID NO: 46520 - DNA, 1501 bp, Oryza sativa
atcaagaaaactatcaggaagccgtgcatgggagagggggaatgagactaccacaggagatggtggatatgatatactgttagtcaatgagatcccttattctgcaagctctcttcaaaacctctatttgctcgtaaaaaaggtttgttctccatacattttttcttcaggaaattctcgccatgagacatcatatatagacagcatacagacaatcactgcattgttatgacttatgactagcataatatgatagcgataagcgcagaatgagtgtagagctcctccctgaggtcactctgcattgatatgcaggagattagtatgggtagacgaatttccttatatcagactttacagcagaccaagaactgagttttttttttttttggcattagacttaggaattggcttagcttcgctgcaaggctcttttccccttgtttctgggactgtcttcatctcatccttctcgtttatccagataatatcaaatgcattgtccgaatttgccgtctgctctggaacagaacctgcttcatagccttaacatgtactccgcactaaaacttctgttcttggttcttgcagtgcctaaggccgccatatggggtgatgtaccttgctgcaaggaagaattacatcggctcgagcagcgcggtgcggcagctccgatccctggtggatgaagaaggcgcatttggcgcgcacctcgtctctgagcccccagagagggagatctggaagttcttcttcaagtagtagtaaactagtagttcttcggtgtggcgctgcaaatttcatcacaagctgcgatgatcaccagttctgtacataatatactttcagagttccagccatgttttttgtgtcgtttttgggctttttttccccctcggaagtgtggtattattatgatgaaaattcatgacaactcaaaaccagtattcgttgttcagctgccaaatatttttgagtttgttatgctgagttatcacttatcaccagtattgatttgttgaattattatcatttttaagtttgtttggttgtgggttataggctctatttcaaacgatttatttaccagattattgcaatggattatcctctcgattatgggttaaatattttttaaaaaattaacaaatatgttataagtggtgtaagcaatctaatagataaaagttctttggaaaaaacatactactagcaaacgtatattttgggatggaaggagtaatttatatttgaagtaaataatctatggagtatttaggaccaaaacctgaatcctatggagtaattaggaccaaaacctgaatcctgcactgtttttaagttcgtttctgaattctgctgattactctttttgtactctttagtttgttactatcaccctgtgacaatgttatatggaacccattgagtccatgacaagtgggtgcagatataggctgaagttacagccttgactgcaagtcaaagcagcgcagtcatc

SEQ ID NO: 46521 - DNA, 601 bp, Oryza sativa
  unsure (1)..(601): unsure at all n locations
atcaagaacccatttttgtgctttgttgctgcttgttatatggagtttattagagtaaaagccttttcttttccgttggtcgtgtagacgctgcagcttcggaagatccgctcttcgtggaagttgaagccgacggttgggaaagcgagcaaggcaagtcacatcatccttgaacatattgaatcccagtttataaatttatgttgatttaaattactgcattatcgctttatttaaattcccgcgttatcactgttttatctagccatgcctatttacctttgttatgaccttattattgttattgttattatttccttgttcaccctagaataaacaaaaccccaactagtggacactctactcacggtaccactagtatgattttagatagatgcttcgctggttaaataggcaacattaggtggttttacaactctagactttggaatattcatatcacctggacactatggaatggttggattattgtggaattggattcacacctccccctctattcaaaatcctcaaaatggttttaggctgggctcggngtgcatggttttgatagtagcgcctcggccatataaggaccggt

SEQ ID NO: 46522 - DNA, 702 bp, Oryza sativa
ccagtcgccaaactcgccaccactcttccgcatcctgttttgattagcttttctctatctttcttctgctcatctcatatcatctgtcccccctcctgttcgtaatcttgattgattaattttgcgtttttgtcccgacttttctttggaacctgtctgtgattcttggggacagatcttgggggttcgtacaagtaagtgtttcttccttcatcttctctccctcttttcgagatgtcttgatcttctcttgaatttgtgatgttggaacttggatgtgatgtttcttggctctatagttttagctgttgacaacaggtctttgggccgtttcttgtggcatttggcatttcaatgggggtttagctcattgcgatttcccctctactttgggtactcttgatgtgtgatgtagctgtaagttttccggctatgaaatctcatccggtaggaatgggtgtcctattgtgccccagttgttgattttctgtgtcctttggaagtgagaagggttcaagaagagttatcccagtagaaagaaattttacatgcccaagattttgataatttgacactttatttgtcgtcactttgattgtattgacattacgaagaattgttacattttattttcaccatcattacagtgctactgcattacatttcttttcaccgtcattatgatttggtcgtttcaggcaa

SEQ ID NO: 46523 - DNA, 154 bp, Oryza sativa
taggcgaaaagatcccgtcctggacttgtgtttgataaggtacggtcgttcccattttgattcaagcttaccaaccgctactgggttcgtcttctttcttaggacaagatgaccaggcatcagctccgtgggtcaaactttttttgttgtaagt

SEQ ID NO: 46524 - DNA, 736 bp, Oryza sativa
gactcaattgcaaatccttcgtcctaatcaaccataaactcctatatcaagggtaggtttagtgtcgttaccactatctcacaacaaacattgtattgctgtctactccatctatcctaaaataagaggattgctacagcacgggattccattccaacgggatactttatgaatctaatcccccaccacctgtcttccccatgttcgagcacccatgttgtaaataaatgaaacagtggcacccctagctccttgccctcactaatcacaacaacaacaaaagaaggagggaggcgtcgatgagaggaagggagaagagaagatgagacaatgatagtgacttgttggtcaaccaaacgatgacaatgcactatctttcctcatgtcttgacctggcacctgataccatatgtaccagacccgatacctaatactcctacttgataacatgcacctagtacctatgggtaccggctggtacctaagataccaggcatgataccccaaggtaccagatcctggtacctaggtattaggcacaatacccgaggtaccagaccctagtacttgggtaccaggcatgataccccaaggtaccagaccctagtacttgggtaccagacatgataccccaaggtatcaaaccttggtatcaaccctctaatacctaaggtatcagctgtgacatacctgtacacaacattagcgagtagaagtgataggctagcaaggagca

SEQ ID NO: 46525 - DNA, 1385 bp, Oryza sativa
atatgtattcagcccgtcaatctgtataaaagagctttatggctgaacgcctctttagttgacatgtgctacctaaattatttacaaattttggatagggctgttgaaaagaatttctccaagaaagctatttgtttcttccgtttcttcttgagattgtacctccaatctaacaaattgatgttaaccaagtcccgcagcaatgcgcggggcatcctctagttgtaaagagggctgaggccaaaatttatgctagaacaatactccctcattcccaaattgatcatataagagaattcaacattcaccccgttcctattttaacactttaatagcacccaaagttcaccttgttcccatttttaacacttccgtcaattctcggttatttttcgtccgccttaatcgctattgacccagccacgtacactatatgatgtttctacccctcacaagtacaagtaggatgcatgataatgaggggtagaaacgtcatattatgtgcgtggctgggtaaatagcgatcaaggtgtacggaaaagatcgagaattaacggaagtgttaaaaatgggaatgtggtgaattttgggtaatattaaagtgaaccggtatctttcggtgctataaaacaaaaaaaatgtgaacttttgatactatataaccaattttgcctaaatattagtggtaggggtggtgcggcatattggataccaccaccactaagactgagttctttccccaactttcgcaactcacctcttttgttttctgtgaacacgcttttcaaactgctaaatggtgtgtttttttaaaaaagtttctatatgttagttgctttagaaaaatcatattaatctattttttaaaaaataataagtacttaattaatcataagaaaatgcattgctccattttacttgcacaggagatgagttctcaacatcacctcccgaacacagcctaacattttaaatatgtagtgaagtctttaaaaatatctaggttaaaaaatggtcatatgatatttatctccgtcatcagagtaaaacttttatactcatatagttgaatatgaatttgggagtaaaaagttattcacggtgactttataggcgtttaataaatattgtctgcaatatatttgttctagaataagtttatttttaaagtaatcattgcattagagtttgtgaaagtagaagaaattgtgttggacaaagataaagtgagaaataattatattgtgattcgataaggtatgagtgttttttttattgggacgtgtgggatgtgtgaaaaacgaaaattttttgggacagatgtaatactactagtgggttgttcaattcgttgaaatgacgaaacttgaatgctttacactagc

SEQ ID NO: 46526 - DNA, 163 bp, Oryza sativa
ccccatcgaaaaaatattcttctgaccaaaagattcgcaaagcaggaaggaaacaggtaaaaacactattactttttttatgtcatatcattatatacaatacattattcatggattaaaaaattaaaaaaagtttgcataatatatgttcatttttttcagc

SEQ ID NO: 46527 - DNA, 1501 bp, Oryza sativa
ccacttaatcaagttgtactttgtatttgtttctcacatttacatgaagtagcatgtttggtttattgaccaaactaccataaaataaccaaatccaaacattgagcctaacttgctagtattttggtttgttatgttgtggaaccaagccatctgtcatcaaaccgtcctccctaaccacaccatacaactctttcttgtgactatatatggggagagaggctattattagccaaactccaacctcataatcaatatttacctagctttaggaacacttatgaagctaaggtcctaagtctagcctcagggattcgtcaccattgttcatgttcaccattaggttccaagagctcgataatctcatttcacactaactataagtctagaacaaggggattacaggaacgagaagagaaatcaagttgtatcaaaccttatattgagaactgaaaaggtagggggtatcatcgatcaagaccttctagatgagagagacgacatttatgacaagggaaagagaggcgatacttctctgcagtacctccacaccgccatgaggagcgtgcctccgttttgcacagtcatgcatgtctttacagttttgtgcatgctattttgtgatttgatagaatacgtgaactgaattgagtggagcatgtccatcttttgcacatgtttgtgaacattggaaggtcttacacgtgacaacaaaggaatatggagaacaaacgaatatctagcgtgtctcgtaaatagggaatatcttgatagaacatataaagatagtatgcccactgatagatgaattacaggcgtgctaatcgtgaatgggaatggtggtgcctatgatgggtaagtatagtagtgatgtggttccaaaaatcacaatagcgtgacaccccacatctcacatagaagggagcataatagaaaaatggtccaaccatccaagactaccgtggcagcttctcagcccaaggctagccaacactgaagtgaagcattggtagccaccggatcatgtcacggcctcataagcatatatacactagagaacgactactctagttacagtaatatttaccaaaccaatacaatctgtacaatcttaacttatgaaaatgttactcgtacaaaaattctctaagatttaacatccaaaaccatactccctccgttttacaatgtaagtcattttatcatttctcatattcatatgataactagattcattagcatcaatatgaatgtggaaaatgatagaatgacttacattgtgaaacggagggagttgtcacttaactactctctccgtccgatagaactcaactggacacacagtcacagacagtgggccctgcataagtttcgtacgcaatcaggtagggcccactcatcagcgacagaggtgcacttcccccttcaccctccaccatctctccctctctctctccattccccctctcctcctcagatctcccacctcgaaccctagcca

SEQ ID NO: 46528 - DNA, 258 bp, Oryza sativa
cttattaaaaaaatttgtgcaaatataaaaaacgaaaaattgtgcttaaaatactttggataataaagtaagtaaaaaaataaataataattccaaaattttttgaataaaacgtgtggtcaaacagtgcaaataaaaactcaaaatcctttgtattatgggacggagggagtaccatagatccgaaataagccaaataacacgatggacagaagtttggatgaagtaaaaagaaaagaaaaagatttattggcagca

SEQ ID NO: 46529 - DNA, 1501 bp, Oryza sativa
ccatactcttttaggtatgtgcttgtttcattgcaaagttggtgcatgtcatagatatttaatttttagaccccacgtgctatacatttactatgttttagtcaaatcttatcttagatgcgaccataagtttgttagttgtcttcaatatttgtctcacctaaattatctttagggtgtaattcactagaccttttaacaatagtacattatcattttcttctcgttttaaccatcaaaccaacaatattcccttattcccttatcatcctcgtttgttttctccccccccccctcgttttttctatgagagcctcattggtcgcccatatttcctaataagaaaaacggtttattagaggaaaaaaataatttataagtaaaacttttatgtatttgttcgtagtaacttaaatgccaacattaaaaggaaattacgttgagaatatcttataatcaacttcaaaattaagttcaaaaattcaaattttggttttttttctttggttcattaggtcaaccgatgggactatgaaatgataatcctctactaattctctttaacttagcttaaaataatatatacttttaatagatgaagagagtaactttcgccaagtttaagagtgaaccaaacatgacctataaaccctggagtgagccctaaacatggtaaaggctgtgtttagttccaccggtaaaaagaatttattgggtcatatcagatatatggataccacatttgaagtatgaaacgtagactaataacaaaacaaattacataatacgcatgtaaactacgagacgaatttattaagcctaattaatctatcattagcaaatatttattgtagcaccacatcatcagattatggcgcaattaggctgtcgacgggggatacccgtagactagatatagagggtattagggtacgctggtacgaggatctacgtaatacgacatcaagcaacaaaaaacagggattatactggttcaggccccttaataggtaatagccctaatccagttgatatgggattatatgacggaaatcacaaattacaaagggaatagtggaactcgatgataccgacgagatcgtagttgagttggttcgactagatcacccggcgacttggctcctgtaggttctggctttgtaggctgtagtggatgtgttggcgataagattcgatgccttaggtcctcccggggggtctctttataccgcaggtcagttggtctccaagtaggactcggagacatcggaccctacacgatacagtgacgacccagttctatccgagtaggaatctttccatctgtggactccgtgatgaatttccttaacgtgtacagagaacgtccgtatacgcgcagatataccatatcgatgtatgacgtatatccaagggtagagggtataccttatccgtaaccctgacataggcttaaaagattcgtctcgcaatttatatacaaactgtgtaattagttttt

SEQ ID NO: 46530 - DNA, 1501 bp, Oryza sativa
tttgttcttctcttcagcttttgctggctaactagttttatctcttttgtagaaagagatgtgtagtgtgtgtgatggagagaaataattaacgaggaaaaacatacatatactccatccgccctattttaattgtagttgcggatttctgtgtcgaacgtttggccgtgtgcggtagtagacaaagagagggagaagcataatatgtcgacgctgataaacaaggatccatccatatatgctaaaaaatgagcacactatatatcgtctactacctagtatagatcgatccagatgcaacttatgcttcagctgcaaatgctatcaaggcaataatacatatacacactactactactactacaacataatactactatactagataggaggaggaggagcagcaacagatcaatctgcctccagatttgagcaagaggctttgcttaatttgatctccaagctagcaaagcaaagcaaatctcaaggtgtttaatttcaggtaaatctacatgcatgcatgcatcagcttaatttgcttgcttgtttctcgcttcttgctttcgatgcggcaaaagaaataaaggaaggaaaaggatgagacgacatgtatttgggtcacatcttgttccctccagctggctggcctcctctctcatgtcgattcatccgtgacatccatgtatcctcctcgatctcaaattctcaaatcagattctttgttcgctgtctcgtccatatgattgatgtctttgcctcttttgctttaatcttgatttgttggacctgctgcttattgtctttgttgattgattattaatattattcctcatttctcttctctctctctctctcatcacaaattattatccgatttgatttgttttgcggattgaatacaattttcttgatctgttccagataggattggttatacacagattttgttgatatatattttgattggataaatttggttgttgatgcagtggagagagagacgacatggatgactcgagcttcttcatgcagtgggcgatggacacgctgcaccagctcccctccgactccaccgccgccgcagcctacgccactgacgtcgccggcgacagcggcgccttcccgtcgctgcaagctctccgcaacgcctcggcggccggcggcggcggcggattccgggacctgacagtgcaggtggaccaggtccaccgcgccaacagctggagctccagcgacagcccaggcggcggcgctgccacggccgccgccgggtggtccccgcatgtcaccggcggcggcggcagggggcacaggccgatgagctggaacttcagcgcggcgtcggcgcagccgaccaccgaggatagcggcggtggaggcggcggcggagtagttccggcgccgctgcaggcgatggagactaccgcgacagcgagagcggcggtgaagaaaggaggaggcggcgggtcgtcgtcgtcggcggcggcgccgggatacgtgc

SEQ ID NO: 46531 - DNA, 1501 bp, Oryza sativa
ttatactcgctccgtcccaaaatataagtattcttaggctgtgtttggcaccctatttttccaacccatctccctcgttttccacgcacacgcttttcaaactgctaacggtatattttttgcaaaaaatttctatacgaaagttgcttaaaaaattagctaatacttaattaatcatgtgctaatggaccgtccgttttccgtgcggtgagaatgagtttccatccttgagatgcgaacacagccttagcatagcgacaagtcaaacatttttaactttgactattaatagaaaaaaaataaaaaagatcaatcatgtaaaattgatgttactagatttatcattaaacaaactatcataatacgcaactctttttatttaaaacatgttacttttatagatattgttggtcaaagtagtatctcgtagaccgtgtcgaagtttaaaaatgcttatattttggaacggagggagcagtggttaatgttagaatatgtgtttggatatattagctagtgatcttattaactacagttaaatttggtgggtgaaattagagttgaactctataacccgataacattttaaataaagagaaaggtgccacagtataaatacggcgatacatagagagagaatggtggcgaggccatggactcttagcagctaggtgtaatgttgattgaaaaagttcctatataatcagagctctgaagatgtatagttcgactgaacttcgttaataaataccgtgtgttcctatatcattatttgttatgtctgagttgatcgatgtctaacttttataacaagtaaaaaagaccataatgcaatttcattatcttaatttcatctggtctcagaaaaatacattacctatgaaagtatgcatgtattaagtttggcgctagatggcgatgtacgtatgcgcacatgtgtcatatatattatcgctggctataccaataaaaattagtataaataaactgcaaaatcaagggacaagatatccctttctagattatttaagtcataatattatatattaatgcttcttcttcttctccttccttttttccctccgatcctcgatctgcataccaaatatatatagtagatctcacttatcggtgaagcctcaggtccatgtcatgttatatttattgagatgacaaggtgatggaaactactcatcagaacaaaataaaattggctagtggttaacgtaaatatatctccttgattttcagcatcttgaatcatttgggcaataataaactatatattaaatgttgttgtatacttccttcatcttaaaaaaaaaagataaatgtgacatatcttaatataacgaatctgaacagattcctttcaaacgtagaaaaataggtggaactctttccaaacaacataacatgcatggaacatcacaaacaatgggatatactcggtagcttcagcgtacaaagcacaatcccttggctcgatcaagagaaacta

SEQ ID NO: 46532 - DNA, 1501 bp, Oryza sativa
tatgatataacatctgtagcccccgactcactactcaatggaagaccaattggtgtagtgaggcagaggaaaaggaaaaatatcatataaagaataaaataaatgatgacttagctttgtaatattccccttggtgatggcagaggtggccaatgtaggaacaaagtcgtccattaataacaatgaagacaccagtcggcggcgacgaaggctgtcgacggtgaaagcgaagatgcccactaatggcggcataataggccagccctgtaggcggaggcaccaatcggcggcgacggaggcaagccggcgatgaagtcgtagacgcccaacagcggcggcataataggccagccgtgtaggcggaggcaccaatcggcggcgacggaggcaggccggcggtgaagtcgtagacgcccaacagcggcggcataatagaccagccgtgtaggcggaggcaccaatcggcggcgacggaggcaggccgacggtgaagtcgtagacgcccaacagcggcggcttaataggccagccatgcagacggaagcaccagtcggcaagagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcagggaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcgacgtttacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggatggggggcaggattacgagatagaaaccttaaccaatacggtatcggtttcctaaatctactttacaatattagccaaccaggactttaggccgttccgtaatatacaaggaaacgt

SEQ ID NO: 46533 - DNA, 1501 bp, Oryza sativa
tgtagatcgaagaagcaccaacactttactgattttctagctgcctgagcaagcaacgaacacactcgctgtcagagtgtttgtggctttgtgcttatgatgaacactgaacatatattggtctgcattagtaatgaataaaactgtagcatgtctaacttgaggagactcttaatcgtgtcctgttacttctttctcttctgccaacatctcgttaatctacctgctggttctatatgaatgaatgcatggaaattcattcctcttcttccattctccagtaaagggataagggttcgagctgctaatcaactcaatcagtagcctgttaacattgattcttgcatgctgattacagcagcagtacttgcgaatgaaacgatgggtgttttattttggattttttggttagcactgacttgcaaaatgggagtggatgaacaatggcgtactctgcactgtctgcagaagctgaggctgaagctaactgaaaaggtagggcggtgaggaataatactgtgtgtatgtttggaggggagtcaaatatgttggccggccgttggcgttggcgttggttcagtcaattcaacgcaactcttgtgtttctgaccaaacaagcgcgtgatcagactagtatgtagtataaagagttcattcttggtctatgatgtatgtatggccatgttgtgtcacattcagattactattgtacaatatgactacctcattatttagtggtatttagtggtgttccatgtcatatcggatgtttagacactaatttagaaggactaaaatttagtccgtgtcacatcggatgtttggacactaacttagagtattaaacgtagactaatgataaaacccatttcataactctggactaatttatgagataaatctatagagtataattaatctatgattatcctatataatactgtagtaaaaaatatgctaattataaattaattaggcctaaataacttgtctcacgaattagctctgcatagcagcctaccgagttgggtggctcttgtgccgtgccatgaccgcctgatccggcggcctacctccttccgccgttcatacgctgcaaccatgtatgatctcaactttcctatgctgttgaattgcgtgccgctgttcacttgagacgtcatgttgtcgaaacatgaattcggcaataataaaacggggtagcgcacgagacttaaaagtggatggatgtggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggatggggggcaggattacgagatagaaaccttaaccaatacggtatcggtttcctaaatctactttacaatattagccaaccaggactttaggccgttccgtaatatacaaggaaacgt

SEQ ID NO: 46534 - DNA, 215 bp, Oryza sativa
ctgctgttattagggtcttggggtcagtatgtccaaggccggggttttcgctggttttccataattaaccgtgccgttgtaaggttttagggtccggttttcccttataaactggatcaactctcttcttctatagtgtaatgtaggagctcccttccgttacctcgaaaaaagaaaacaaatacatcgccatctgttgtttaatatgccgtagg

SEQ ID NO: 46535 - DNA, 351 bp, Oryza sativa
atgatattggttgtactgggctgttttggtttgatgacaaaatttgccctacaaagcactttaaatagtacattgtagatatttggattgatgccaaaatttaccaaaggtaatacaactcctataaactaactctattaaaatattagtagtgctaaattttagcaataatttaacactaccagtaatttgctaggacaccaaaccaaatgatcccactctttctaatgtttactagtagtaccacttgtttaatgttttttttaacggggacgatatggattgatcttgtgagtagagaagcagcagcagcagcagatctttggtgaagcaggatttgccgtgacacaa

SEQ ID NO: 46536 - DNA, 696 bp, Oryza sativa
ttcagaaattgacatgctcgtaatctgaaaaaaaaaaccttaaccagaactgtcccaagaacttgccttgtacttatgatactgatctgcagttacatcaccggttgctccatcaacagaatagcctgtggaaaatagaattagaaagttctcgttaattttaagaatttgaaatttatcgtagacacagactcaattttcacaagtaaatcttagaccaaactaacctgagtgcgaaaacgtgtcccagatactaggctttcttccatcctctgcaaatgcaccttcaacctaagcaattttgtgaatgttcaggtcagtacaatatgctatacaacactccaaatcttgatcaacatgtcgagtagcataacttcttatgatgcaccattttgaaccgttcacaaccttatcaatgagggtactatgatgctaattattttctacctgtaaccaatatactgaaattgctgcatgactactaatgcagtgcgattactaattttccctcagagaatcaaatcaaagtacacatctgacttatttggcaaaatgcattttccccaattccttaccaccaactcagctgaaagcaacgatagtaacatctactgatctcacctcaccacaacttttccctgttctaacaacataggtttcaggccatgcatttctctgaatctgccaaatgtcagg

SEQ ID NO: 46537 - DNA, 790 bp, Oryza sativa
acttcattgcaaacatggggaataggaggctttagggacagcactgtgatgaaaacgagtaccgatatggttgaacaacatgcgataataacctctgattttttttacttgtcttttttttttcaaacatcaaccctttttggggtatgctccttactggacaatttctaaacttctgatattttaacactggtattatagtatttttgagaataattcttatgcaaaaaaggaataattccttttatatttatgagatggaggtagtagtatagaagtatatattggaggaataaactagtagcaaaagctggcacttgaaaaatataatactatcttgggatcctaaacttttaatataacagcacaacctaaaaggtttgttggtttttggaaggtcagtccacaattgcaattttgatcagagcatcatcttctcagttcagagccactacctctttgagttcaccacttcctttcgagttcacaacaacaaacacatcctttgaagttcatatcctttttcttttacttttatttttcatcgttgcaacaacaacaaataaacaatgagcaaagtagccctcaaacaccactgcacataaacattgcttctgcaaggacacctgctacaaaacaagtaatacaaattgtaagtactttcctatcaattttttgcttaatttttttcaatcagcacgacataaaactatgtcttatactctttatacattattacaataaattctttttttccccatttttcacttgttttattttttaatgcaga

SEQ ID NO: 46538 - DNA, 1501 bp, Oryza sativa
aactcttaaatttatctcaaaggagttggatttagagttaagttgtagagcagtctagatcttgctccaccttgctagtttattttatgagagcactttagtttgcttggcttctgtttttggtgaagctgaaattgtttggttggactccaactctagaagcggtagagtgccaaacaagcgctttattttaattttagctcttgactctacttgtcgagccaattttttttttaagcttagtcaattctaactaaagtgggcattttcgatgaaattcttttaacggaacatcggagagactggtggctatgaggtgatgggtccaccgttcttcgatatgcttaacctcgtgagagactggtggtgggtccaccgtactaagaaatgtttaacctcatgatatggctatgaggtgatgggtccactgtacttcgctatgcttaacctcacgatatggctacgagacccaataattcactataaaatgacatcttgccctctcgtctttccattgtctccctgttatttcccttcccaccaaaccacttcctaacgcaacaagatcggcgtagatggcatgcatcctgaaacctatgggtaaggagagggattcgttgttaatgttcttttccttgtatttgatttagtgcttatgatgatatgactagctcaatctttttgtgtcatctagatctaagagataaggaagaaactagctaccagtggcagatcttcaacgccaaagtaaagctaggcgtcaaacaccagcatcggttaaattagttgtggtggcatatcggcaagttgtgtttcatccatctcacaggttagatcaagaaattttattcacttgaggttagtaaattaagtacatgtgttgacttgtagatttatttagctattttacattattctattcgattgttagaaccatttctttaaacaatagttagaatcaacttccctaacaatgaagatgggaacaactgaacaagttagaatcctaaggtaaatgattgaatttctttttatcgttttgttgttttattaaaatgcattcaacacctctctttagaaacacaatcctagaatatctacataattgaacacttactttaaatttaccataggaacttgttttgttgttcacgccagcacatgccaaccctttctttgaaaacataacctggaatacagcctgaacatgctaaccctctctttaaaaacacaacccgaaatacagcctggacatgccaaccctctctttaaaaacacagcctagaatacatcctggaatatccacgtatcaacccttcatcggaaacacaaagatagaaattccataagaacatgttcatgctagtgcatatttagccatatgtttagatataaatataggaagattcacaccaatacccattaaagcatagctatgtaaattattaaaatatttatactcctagatctttcataggaacctgttcacaccaatacatgc

SEQ ID NO: 46539 - DNA, 1501 bp, Oryza sativa
aggctttatcgtaaagaaacaactgggatcgacaagtagccgaaacttgtggtggttacaccagcaaataactccaagcagcagcatcagcagcagcagcaacagttgagaggaggaggaggaggaggttagctagctcgtcagtataatccttctcgacagcaactaataaaggaacaagcaaaactatttctttaggaggcaaacattattccatatttggtgctgctgttagtgggtggtctgagctttttttatttaggcaacaaggagcaagctagcacaactgctgcttgctagagagaggagagaagaaggaggagaagaagaggagagagaggagctctgagctctgtgctctctcttgctgctgctgctggctgctgctcacttttccttttgggattgttacttattttaatcctgggatctgattttgtccccatattgggaggatcgattatctttctcccctcctctcctctcctctcatcccctctcccctatctatctgtcttgaagaagatcagctggctgctttggtgtcaatcgctgctgcagttcctgttgcctttgccctgcgccccatcaggagcacaccctcaggtctctcctccattttcttattgccttctcttgtaccatctgctcctcctcctcctccttattgcagcatcatcagcaacggattgcatgcatgacctctgttcttggttcttggcttcagttcgatgatggtggaatttcactgaattatggtgtgtttcttgctcttgtggttggtgcttaacgctggctctcttgggtttctgagctcttcttgccttgttgggttagagagctagggtactgctcttcccttccatctgaatttttcagcttcttttgatgtttggggatttttttttgcttgctgctggtttttctcgatgaaccgaaagctcaggtgcaaagattgtttcttttgactgaccttgaggttccatgccctcaacctcaacaaagttcttgcctttctttggtgtatagattcttgtggagaaattcttgtgttcaaaactcatatgcttagttttctccgaattatgagttcttgttttcttctcggattgtaaagcaacccacttttttgtggctttgcccataatttgagcttatgtacgaacaggctttgcgattgccgactaaattgtcctagctttctttcttttttttccctttcttcctcgacgtttacatggaagcagtcttcaaaaaatgttttcatggaagctgggctctcaaaagccaaatttcctgttacttttacctttttgcagtagttcttctgttgagttactgcactccagacactttatgctaaggaaatcttgcttgtttttcatcaaaatcttgtgcttctttgttctgtatgtaggttatacatgtgccttggagttttctctttggctctactctctaaaaatctagctatgaaaaagaatttgtttagactgacaaa

SEQ ID NO: 46540 - DNA, 1501 bp, Oryza sativa
atgtgatagaaaagttgaaaatttatgtgtgtaggaaagatttggctgtgtttagttcaatgtgatagaaaagttgaaaatttatgtgtgtaggaaagatttggctgtgtttagttcctgaaattgagaagaagtttgggaaaagttggtagtttgaaaaaaaaaagttgagagtttatgtgaaatgtgatagaaaagttgaaaatttatgtgtgtaggaaagttttggctgtgtttagtttctgaaattgagaagaagtttgggaaaagttggtagtttgaaaaaaaaaagttgagagtttatgtgagtaggaaagttttggatgtgatgtgatgaaaagttgggagtttggggaaagtttggtgtgaactaaacagagcctttaatgtgatggaaaagttaaaagtttgaagaaaaagtttaaaactaaacaaggctgtaatagatcaattaactgaacacgctactagtctcaagtgcaaatcagacgtatgtacacatgtgtggagattatgggtaccccatacccacacggcatggttatctgactagttataggggataacttatatgtatgtaatatgtaacagatcataacttgggtgttacgtttccttgtatattacggaacggcctaaagtcctggttggctaatattgtaaagtagatttaggaaaccgataccgtattggttaaggtttctatctcgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggtaaacgtcgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgcctccctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagatt

SEQ ID NO: 46541 - DNA, 555 bp, Oryza sativa
ctagtatgaagcgcgcgaaattaccgaagcagcaggtgatggcgttgggcttgtgggtttgaagcttccggcaatacaatgatctgcagaactagcttctgactgggcatctgtaactggcagtttagttactgtttgtctggctagttgacaagacattgacagcctgtcatgacaacctctatcttcatccactggcactgcttccactggttcattttccaatataacttcatgggtattaccgttgggggtaagctgcgctccaggaacatttaacgtttcatgtttttcttcagaagttgggcagaagttttcattggaggcacttctaaccacaccccctgaggagaatgctccagctctatcagtatcagcaacaacattttgagtgcaaccgattttgacaggattgactgtgtctttgttaccagttggatgtgtggaatcataagcaaggggagcatggtttctttccggacactttgagagcacaacagattcttgaggaagcacttcattattcaaagcattagcagtcatagaggttaagca

SEQ ID NO: 46542 - DNA, 154 bp, Oryza sativa
gggcgtcaaggtggcacagcgtggaccgtcgacgtcgccaggccgctcagcgtcaaggtggcacagttctccatctccggcacgtacatcatcgcctccgcacactgcctccacgacgatcgctagaccatcgaggaccccgtgttgacaccca

SEQ ID NO: 46543 - DNA, 683 bp, Oryza sativa
ataatcattttgaaaggcagacagcactactggagtaagatcctttgtttccacgaaaactaccttactataatcagtcacatttgccctctcattgagaaagacatgataattttttggaaacagatcaacgggtaacgcttctataccgctaactggtatatacctgaaccatacaacggtataaaacccaaatttgacaagagcatagaaattcccacatacaaacgatgttccatccttggattggattgtcataagattcactaaacattgtgtgtgtatttagcggtcaatgtataatttgaagattctgttaatctttgtaaagatgtccataatctgctttgcatagagagttcaccaaatttcataggagagagactccttaaagaaagcatatcccttatataattataatgaaacctcacaattggttgattgaattcgatattattgtggaataagcacatattattccaattaggactataatatctataacggatttcatagtgcgtttgcacatatttatttatatattcttttaatatacgtggatcttgcaaacagttattgacaatttccctcttcctcctcaaagcagttatataattaccactaccatattctatagaatacgatttgattttctcgctgatggattctttccaatcttcaga

SEQ ID NO: 46544 - DNA, 1501 bp, Oryza sativa
ccgtcagcatcggcgaggttggctgggcaagaggcgagcgccaacagaggtgccggggaggagcaggccgccggcgcggtcgtaggagagggtgccgactggaggtagagccgacgacccctaggaccgctacctgtgccaccactgctgtcatcatcaacatcctgtataatttttcattgttgttgttatcagggatgcgctggaacgagggcacaggactagggccgttggacatcattcatgctagcaaataaggacaccagcaacaccagcaacaggtgaggttgatgttctatattcatgcttgcaatgtgtttgatgaaatgcttagctagcactagcatcatctcctgtttacaatttgacaatttatagatgtcatactgaccaaatttctggttgattgtttgctgctttcaaattaacaattcaatggttcttagtgtattctacttaacctttgcatttgtagtactgtaattctgaaggtagaaaacaagatttctactgaacttcgtcgatttaagcaaagcttttgaacatatggtcatccattgaggctcccgcaattccagtttgcaaagcttttgaacatatggtcatccattgaggctcccgcaattccagtttgcatgttctgccatcattttggatcatattttccatgcttatggaaggacataatgaactgtagtttgtgttggcagtgatctccattggatgtcccgtctcttagctggtcgtcaatgatacaaccaggtcacgcatgaggtagcagtcccctccaacccagttgctgaagacttgtctcatctggtttcattgatgcgtgcgagtgaggcacatgctgtccaggtcaaggtacaggcaagtcggtttcttgcactcaattttttttcatgctatttttgtgaatgttggagatttctattcatggagcaacaatgtttttattttccttttatcagtgtcatagcattcttcaaatccaggttagtattatagggattttatctattttgcatacattgtgcctgtaaatttttgcatgaaaatgtatccaagagcacaagtaatttcgagtttagtaaattagtacaggtttctcttgagaagtaaaatcttttctctcaagatatatatgtgtgttttcttagaaaaaattccatttggaatatagtagtaaaatcaattaggattgtcaaatcaaggcataatagtaagatatagtttgcacagctagccctcttaatttctattagtgccacctacttcttaatttcttacgctgatgtctgacaaaattttgtttggttcctttctacagtaaaacatcagcttatgagatctgaaagcaacaaaagggtaccaactttacacccatgtaaaatacagtgatttcagtccgttctatgtagctattttgatttcttcaccttcacactcttatgagagctgaaagctataagtagggtaccaacttaatacccatcagaaa

SEQ ID NO: 46545 - DNA, 1501 bp, Oryza sativa
ccttatttttctgttataatatatacaataaatgaatgcatgtttacttttattatagtgttttaaaagacaaatctatatatgtttttttagtttctttaaactaaatatttttaaagttattgatggtcaaagttataaaagtttaacctcaagcttgcccaaaacgtcaattaatatagaaccagagggagtattagagagaattaatgtttctaaaaattgttattgtttttttgttatccgcacgttcatgctcatatccttgattctctcatcagaaattcagaatgcagggaagaatctctgcatgttttcaatcggattaggagattagaatcctgtgcacgtagtcgttcctgatccttaataagcataataataattgatgagaggaggaagatgattttggtagaatatgctcagttgctgacgctgacactggacggtggtggttgccacgtcgctggtccgagttggctgctctcgccgacagcgtgggcccactccaccgccccaacttggcgagtccaaacggaacggaggatttcttcttccgttccgttcgcatgcagatgcaggaagagtgtgagtgtgggccccgaccgccattaaactcgacatcaatcaatcgaccaaccacttccatgcctcttttgcaatccgcacctcctctcttctgctaattactccatccgattccttaattcagctggagtcaaactattaaaatttctttaacaattagtatcttctaaaatatttacaagtttgaatgcacttaaaaaatataaatagattattattaaaaatactgtaacaaaattaaatatttatttattatatgcattacaagagaaaatcatagttaaagatgcgttttgtagatcgtgttattattcaaaactttaaaattataaaaccggatgaattacttcttggcggctgtcagtgtgttcgtcacctttttacaaaataaccaacgttaggcacactatccacctttaaaattttgatcatttgttcttttaagtatttacaaaccataaaaaatgttatatgttatttaagtgtaatatgtcatatacttcccatttcatattacttgttgatttagctttatcgtaagttaacatatctatctttaacaataataaaattttagaaattcctatagttcaatatcatgtgaaatatactccctccatctacttttgatagtcatatttctaaatctgaaaaatttatctttgataggcatatttcaattcaacaacctatcatattatccttggtagcatgtttaaatagatgataagtagaattacttatccttggtctgtgtgccaagatggaatatgactatcaaaagtagatggagggagtacattatataaatattacacaatgaattttaaaacattaatctcatgatgctgaaaattgattgtgaaagatgattaggaaaaaattaattaggaatggatggagtaaatgtaag

SEQ ID NO: 46546 - DNA, 936 bp, Oryza sativa
aaaggcgtgaatgcaaataaaaaacatcccctgggtaagcttcgcagccggggggtcttcttaatagaagggacatttggcgataagcttgtgcttgtttggagagatcatcataaattattaaagtatgccggtacataaaatactcagccagggccgtataaggagcgaggtattgtaatgtagcaggggaatccgccatttcagctactacaatagtgtattccatggccccctctttttcttcttgttcccaactcactactaagcaagttcgaacgaattgcatatatattatctctcatatcagatgtgagtcaccgcctaaactacactgacttatcgaggttcaaactgtctcgcgggtaaagcaataaactctctcttcgagctcagtcacaattcattcaatctgtggcagtagtcgtagatagcgtagcccgggatgttagccatctacctatagtgtgagagtacttttcttcgaaactctataagtgtaagaaaagagtgcatgtacttttagtggacttgactttttctatagtgtgagagtactttctgttcaatctagtcgctccagatctgcccgagacatgcgcctaaggagaaattgtggtacgtaggttatgtgtctgtcttatgtcgtcctagtgatttatcatcggaatagctcagttcgagagagggggtggaatttgaaattcgaattggaaggtttgacagccaaggagcggcaaataagtaaatatcttcgacatagctgaagagaaaaggaataataatatctttcttatttctttcccatgacgactaggaacgggcaaatcaagaatttcacttcgaattccggacctcaacatcctgctgctcatggtgtttcacgatcagtattgaaaatgaaagctgaagaagttatcgaaactcggaaccaca

SEQ ID NO: 46547 - DNA, 378 bp, Oryza sativa
ttttcatttgaatacccttgaattgagttggcccacccctgcccatgaccatgacaaatagagtaaggccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacacgtaatctgtgtaattagttttttttttttttgtctatatttaatactccatgcatgtgtccaaatattcaatgtgattg

SEQ ID NO: 46548 - DNA, 1501 bp, Oryza sativa
tcctcttccagcttccaatgctgatgcttttcttgattcctgggttgtagtatgtttcttgatttaccagggtttatatgtactttgtaccattggtttggttgctcttgttgttcctttcattttcttggagacatcactgatgtgaagaattttacagtggcctccacaactagggtaagacaacaattgtgctaagaaaaaatggtgatgacaccagcgtcattagccctacactttggcttcaggatcaagaccatcaagtaccacaagtatgcattgcattgcaacctctccttctgtcaattatcaagttataaatatggcatcacaaggaaattccaggatgatgatatgatttatcatttaaatgctatagtatctccgggatcataccattatctaaaaaaggaagtctccgagagcatactggctgtagtgttctgaaaattttcgtatcaatttaagtgcatgtaacataagactgaagcatgtggaatggtggaagtggattcatcattttagtcaatagagtgtgagtttactgatctatattgattttttatctgcttgatgatatcaagtgtcttctcttaacctctacaagtataaggtattgaagtatgctccagaatatgctcaaacatgctctagaatatgttatcttcatagcaccctagcttatttagttccataagatcaattttaacaaacattttccaatgtgagattatgccatggagtgcctagtgattcacatagatcaacattttttgtaggaaattcacctcacatggtctggcaatataataggtagaattagcacctttcgaaaaaaaatagatagtactttagtaggcttgactgctttcaatttttttttttgggtggacagcataaggtggtcgcgaagttctctagttattattcagttaacatgctattattatgttaagacatgacactgatcagtacctactttcaaaatttgatgattgcttcagaagcatgagagtgcaccttgcctttaatgcttttgagtggcaaacacagaaaagaaactagaaatctaggattgttacagggttatatattgtgacatgttcaggtcaccaaattcagatttacatatggtgattgtggcaggttctctttgaacatatgggatgtgggtggacagaagacaatccgatcgtatttgagcaggctaactgcctggtttgggtgattgatagttctgatatccgaatgctgagctccagagtctgttgaaagaagagttgcaagtgattttagccactaactctaattgttaatggcacccagtttccaaatggtttgtgtttattctgcaccaggaaactgtgaagactgcaaagttttaattctcagagcatgttttccccttgctgaatctttcttctgaaagttagtaatccttggagctttgatgtcagagattggccggcgcatcgtttttcgttttggcgaataagcaaga

SEQ ID NO: 46549 - DNA, 810 bp, Oryza sativa
ttttcatttgaatacccttgaattgagttggcccacccctgcccatgaccatgacaaatagagtaaggccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacacgtaatctgtgtaattagttttttttttttttgtctatatttaatactccatgcatgtgtccaaatattcaatgtgattggggaagctggagtaggtaaaacagtactcatcatagaattaattaacaatattgctaaagctcactggggctgggtgaaaattttttatttaggaactaaacagggcctaattaagctgtgtatagtaagcacaatttccacgccgacgcactgcaattttcacgcaactttcaccgcctatttccttcttttacccccacaaccacgaccacgacgacgaccagagtaaacaagtcttattataaccacccccctctccttttccatctacctcctccaacgaagccttccttcgcccttgtcgtccaaccctcctctcctcccctcctcgtcgcggggctagggttacgccccctcctcctcctcctcctcctcctcctcgtgtgggggcatggccgggagcgaggcggcggcggcgcaggaggcggaga

SEQ ID NO: 46550 - DNA, 1501 bp, Oryza sativa
aaccacaagagttgactgggaaaaaaatcaataaatatacaaattcaaccttgaagttttctctccatttctcccgtatgttgtcaatatggcgacaggcacaccctcattaagcgcatcatcaatgaacctttgaatggtttaatacacaagatcagacacaatgtaacttccaaagttcaagatagtagtaattcataaagcaagctcatggcatagaaaagaaaaaaaggaacaaaagatcaaaacaacgacagaacagaaagatattgcttacaaatgctcatgcattgatggaaataaagcaagatgcatgggtataaaaaaaacacactggatcttttgaattatggtaccatgtctgccatactttgcagaatgcaaattctcacataaatttctggtaaagcccctcaaaagaactaccttgcataccactatggttatcatatcttagaagtatgatttataatgatcctaaaagtgatatatcaatcaacaataacccaaatgatcctggaattatttcactagagagatacttcatagaaaattagataaactgggaacggtagacttactgttcaactccaggccgcagtggtaagctatcagaagctgagaacacttccaaagctttcagctatgagaagaagcacatgtaaacaagtcagtagaaggatattttttggtctataggaaagaagacgaaaaaacacccatcaaccattttgatctggactcccgatagaagaaaactcataagttgattgaaatcaaatgcaaaatacaaatagaaattaacagaaccaatcataaaagtcagtgcattggatggttaatatgcaatcctgttctcagggtatacccaaatgcaaatggttttctgactgctaaaccctgcaaaagcctaagttccaaaattcaaattgccatttatcttccattagcagaacaatgcatggtccatcatgagaaatattttgagactatacagccatgagaattgagattcttaactaaatacaatcaaccctaattcaagatagtctgcctatgggtaatcataatagaaagttcatttttttttagtgccagtatggtggttttttcttgttaagtacctgcatagcgtaaagtatgtatctaccttttcacgaagaacacttttcataaatgattctttctcgttagttggcaaagaagtaggccacccaatctgtgcaagtcagaggacaggatagtaataagtaatgcatgcatatctcaatcaatcaacaaatgaaattattcagctctgcaatagtactgtggtacacaatgaatgatttaaggagaacagaaacaatagtattattggatcaaatatgacagctaggagaagagctaggcgtactctgttgaagaataataacaacatcctttcctcgtcgccactagctttcctaaaaaactacatagcttcagacaaataaaaaaacaaaaagagaatgatagattt

SEQ ID NO: 46551 - DNA, 286 bp, Oryza sativa
cccttacatgtgcctatgctaagtcatgaatatatatcctagatatggaatgtcttgattccattacaagggacgatgctatagggctcgctgcttgatgaaccttgtcatctatgcaactgagatacaaaatctcctttcaccctgctgatgtcctctacccagtaatctggttttatattttaggctgtccactgatgctttgtttttagttgattgcttgatgcactcagtaagtaactgttgctcagatcctcctctgtttcatgaatttcctttgcacagc

SEQ ID NO: 46552 - DNA, 361 bp, Oryza sativa
tacagtagttcatcatttatttcctttgcaattctttaacacaaaacgtgggacctacccaaccggtattaacagtgggcgtgaacggttggttaaaattcaaaattgagggtaaacttccagtccttaaaaattgagggtaaaacatcatttggatttaaagtggggggaataaatcatttttttttgatttaaaaaaggacctttagggaaataatcgggcatgccttggaacccttgtttttttaccagacccccaattaatggaaggtcctgttgcacggttaaatgactatgattgcactgggtacataaggaaaacccaaggaaaatttatctggccaagccttttgggtcagaa

SEQ ID NO: 46553 - DNA, 1501 bp, Oryza sativa
tctgaatacttgcagatgcagagagtctctgtctgcagctgttctatactccactgagctagtaacaactacttttgatctgttcaccaactagtagcattagtacagtttcttattcggatgctctctaatctctgcataataagtagcatattatactgcgagcatctaatcctaatcaccgtatttgttactcaacttccaccgtctttgtccaaaaaataggccacaaaaagagccaagcaaaagttcaggttttcaggagttctttgctgtaagctaatgagtgagttgggatgtcatgacagtgatcttgagcaagcacacacaactgaaattaaaaagaaagaaaagaataatctaatagtatgagattatacttgcattcacacaacatcctttttctttcagttccaagatgcatatgattatctgcaagggattaagtgcagatctgataatcaagtgctttgctaatacggcaagctaatcacatcttatctccgacaaagagacaggttaatgctagatcccaccgtggcaaaaattgtcagcttgtggtatgaatgaaatgatgattaaaaacaaagttgtgaggcagctgggagcattctagaaagagccagcaaatgccaatttgacccaccaccttctgaaagctacacaccaaattgcaaagtgcagaaaaagaaaattttgaacatttcttctcatggtcctcttcaacaccaacaggaagagatggaattcatctttgtctccatggccatggcgtgtcagggcacattatgaaattacacccctacctttcagcaaaatttcatccaacagagttgctgttgaccgttgacctttttgtgggtcaactcaatcaagaccagtcaaactaagcagaaagattcatagatcagtgaatgtagtgtatgaagttatagtggaaacttgaaagtatgcaatccaaatttgtcaaaagagcattgctactcatactatttttctttctttttttcgcatagctcttaccaacaaatctctcaaccgtttgatttaataattatatgggagttcaaagtaattctatatttactcacatcataccacatcaatgtttgtaatagatttataataaatcttttaggacctttgtagtaaaaaaaacaagtctaaaatcaagaaccaatacttttgggcttttggcgagtacaaaagtggaggtcttaatcaatcctcttaacaataataattaaatataaatatagggggtagagtgcaaaaaggactcaccttattagtcatcttccttagccttaagcgtaaagcaactcgtctcatcttcagagaagcaaacccaacaaaaaaaaaaaaagaattttcaggttttcttctcgctttcaccggagaaggagaaggagaggaaggtgttgatcgaatcctcctccaatcgcgcgcgattcgatccccgttgctggccgctcgctcgctcgatccctcatccgatctg

SEQ ID NO: 46554 - DNA, 1501 bp, Oryza sativa
agaaatatgatatttacaccttaactgtgggcatcttataggaaccttgttggtttgcagcttctcttgagtatatgaagtcaagcagctatagcaaaatgtatgagcacaacccactttgatcatctgagcgcctcgtttttcctcacagcaaattgaacaggtgccaacctcgtatggagatagatacatgatgcctatggcttctttggccaactgcagtggcctctcaagctcaaagctaggaagcaatattatatcaaagtcttccagcttttccaccagttcaagaattctgtgtcctaaagctaccaagagctggtcttctagaatttcagcttctgcgatctgtcagtgcaaaagaacaagaaatgacacatcatgtctaagtatgatataatacaggaaggcagtaagataactctattgaaataggtaattatgtaagaattctacagctttcggacaacataaattgaacaaactactgcatagaactgcaagtgatgaatacgatctatatactgcagctgcactgcagtagcagaatttggaatgtgcagctgtcataactgcacattccctaccttttcatcctttcgttcctctcagtttagttctgtttacaacagtcagctattaataggtagctgttaaaatctcaaataggaaagacggtttcttcattgactgattgttgaattgattagttcgactaacttggaaccaagcaagatggcatgaagtcaagtatagttatcgtggtgcggtccatttttttgtcattcggattaccagccaaacatgtggtatcctcaaaacatgaattacattattttggtagcgtatatcacaatgccaaactgcaacatacagtttagttaactaaaccttaagcgcccattaggtgatgcccaatagcagaaatatcagggtgattgaaagcgatactagcgattctgtgtaacattcataagggcaaaccatatattagagaaaatcggaaactcttgcctgaaagtacagcttctccgaattggtgaaagcaaagatcttccgtatcccattctgcaacgccaccaacaggccatccatcagcgccaagtgatcggccactagctcatccacatagaagtccagtttcttctgcacctgaagcataggcaccccaggtgacctctccatcaccaccccaatcccggacagcttcttcccctccgcctcggggctcgacacgcccttgaagaacagcctcaccgagctctcatcaagctctcccttggcgacgccggccgtgaatgactcctcggtgtcctcccactcatcctcatccccacagcagctcctgaagtcatcctcccctctcgaattgcaggcgaaactgccctccacgtcggctaacctctcctccattgctgaaatcccaatccaattggtgaaatccaatcaaatcaaatcaaatcaagacgacactctctgactcagttagaaagctgagcaa

SEQ ID NO: 46555 - DNA, 1501 bp, Oryza sativa
caaaaaaactttaaagttttattgttaggtgtatgtttgtttatactttaccctcgtcaaagaaacaaacatgtatctaccgtagagaacaaatcaatcaatgcattctagtagtgctaggtggtacttggattcagggactaaacctgtcatatcggatgaatttggagtattaaacatgaactatttactaattacataaataagagctaattcgcgtcacaattttttaagcctaattaatccatataattagcatatgtttactgtagcatcacataggctaatcatggattaattaggctcaatagatttgtctcgcaaattagtccagggttataaaatgagttttattaatagtctacgtttaatatttataattagtgtccaaacatccgatgtgatggagacttaaaaagttttaatcccttttaaacggggtcttaatcaagcatgtatttattactactccctaaagtagtggaaaattaatataccctccttttctaaatacagtaactaatcttaaattctgctctttggaattatgaccacaatctactcttaaatgttaggtaaagtgaacgaaatttcgttcttacatttactccatccattcctaattaattttttcctaatcatctttcacaatcaattttcagcatcatgagattaatgttttaaaattcattgtgtaatatttatataatgtactccctccatctacttttgatagtcatattccatcttggcacacagaccaaggataagtaattctacttatcatctatttaaacatgctaccaaggataatatgataggttgttgaattgaaatatgcctatcaaagataaatttttcagatttagaaatatgactatcaaaagtagatggagggagtatatttcacatgatattgaactataggaatttctaaaattttattattgttaaagatagatatgttaacttacgataaagctaaatcaacaagtaatatgaaatgggaagtatatgacatattacacttaaataacatataacattttttatggtttgtaaatacttaaaagaacaaatgatcaaaattttaaaggtggatagtgtgcctaacgttggttattttgtaaaaaggtgacgaacacactgacagccgccaagaagtaattcatccggttttataattttaaagttttgaataataacacgatctacaaaacgcatctttaactatgattttctcttgtaatgcatataataaataaatatttaattttgttacagtatttttaataataatctatttatattttttaagtgcattcaaacttgtaaatattttagaagatactaattgttaaagaaattttaatagtttgactccagctgaattaaggaatcggatggagtaattagcagaagagaggaggtgcggattgcaaaagaggcatggaagtggttggtcgattgattgatgtcgagtttaatggcggtcggggcc

SEQ ID NO: 46556 - DNA, 1501 bp, Oryza sativa
gcggaactggccattgatacatgtcgaaccccaccggcgggcggatggcccagatgaacggacggccgctggactccagcgccgccgcgagctctttgtcgtctggtgcagccgtatcgagttctgggagccgaaggatatgtagagcaccgacgccggccgctgcgtgtcaagccagctgagcacggcgtcgtgttcgctggtcgttgtctccgacgaggacggccgtgccgagcgcgccgcacgacacgaggaacgcgtgcgcgggcacccgcgccgccgcgccacgccgaccgtccatgcgacgaacccgtcggcgacgacgcagacggtggtgccctcctgatcaaccaggccggagaggaagccatcgaaggcgggctcgagcgactcgaacgcctcgaacagcagcgtgatgaactcccggagcgggaggtcgctggaggactcgcagccgtccggcaggccgcgccgtggtcggccggcgcgaacggcatagcgcgtggaaggccatcccggaagagcacgcgccgtcgtcgtcgtcgtcgtcggaggcgcggagggtggcgccgttgcgcggggtgcagacgagcgtgacgtcgacgtcgccgtcgggcaggagggcgtcgcggcggaggaggcgcgcgagggcgaggaagccggcgaggtggccttggcccttgaaggtcgtactacctgtttgtgttcgtaatttcgtatacggcctagctgcagcgtactcctattttatagaataaaaagatatcttaaatagttttttttttcaaaatctgaaaaactgtagttaaaaataaactagaacctaaaagttagtttgcccagtttgtctagacttgcaccaattagattcccactatctgcatcttaggctgtgttccgacacaaaacgaaatagcgcttaacgcgtgattaattaagtttgagctaatttttttttcaaaaatagattaataagattttttaagcaactttcgtataagaactttttacaaaaaaacacacagtttagcagtttgaaaagcgtgagtgcgaaaaacgaagtaaaggagttgggaacccctgcaatctgagtgtatttgcttggagtgatgtccttggataggagatggtaatacaactttgagagaaaatccataaaataccatcgacaagcaccctgatcctagataactttcaagaaataccatcatacaagcctttttctcccagaaataccatcgccgtcaacctaccgtctattgcacaccgttataatcataaaaatgaccaaattgccctcaattcacacacgaaaaaaaaaataaaatggaaaaaaacaccacagcggcacctataggcgcagggcgcggcatctcggcggcgcggcgtgtgctgctcttcggctgacgcaaccaaaaacaagtgttcgtacaagtgttatggcattttgctttcaccattcaaacaagtatgtcaaggtaacagaggagagagcatgagt

SEQ ID NO: 46557 - DNA, 172 bp, Oryza sativa
ataaacatatgcgaaacgatagaaatgtgctttcaatttttcttatcgttttagttttatcataaattaaatatttctgttgttttagttttatcctaagtcaaatatactatgtttgatcaattttagttggccagcatttttcaagacttccatgtgcaatccatatagg

SEQ ID NO: 46558 - DNA, 1501 bp, Oryza sativa
caggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatggggtacccataatctccacaggttaattttcactcatgctctctcctctgttaccttgacatacttgtttgaatggtgaaagcaaaatgccataacacttgtacgaacacttgtttttggttgcgtcagccgaagagcagcacacgccgcgccgccgagatgccgcgccctgcgcctataggtgccgctgtggtgtttttttccattttattttttttttcgtgtgtgaattgagggcaatttggtcatttttatgattataacggtgtgcaatagacggtaggttgacggcgatggtatttctgggagaaaaaggcttgtatgatggtatttcttgaaagttatctaggatcagggtgcttgtcgatggtattttatggattttctctcaaagttgtattaccatctcctatccaaggacatcactccaagcaaatacactcagattgcaggggttcccaactcctttacttcgtttttcgcactcacgcttttcaaactgctaaactgtgtgtttttttgtaaaaagttcttatacgaaagttgcttaaaaaatcttattaatctatttttgaaaaaaaaattagctcaaacttaattaatcacgcgttaagcgctatttcgttttgtgtcggaacacagcctaagatgcagatagtgggaatctaattggtgcaagtctagacaaactgggcaaactaacttttaggttctagtttatttttaactacagtttttcagattttgaaaaaaaaaactatttaagatatctttttattctataaaataggagtacgctgcagctaggccgtatacgaaattacgaacacaaacaggtagtacgaccttcaagggccaaggccacctcgccggcttcctcgccctcgcgcgcctcctccgccgcgacgccctcctgcccgacggcgacgtcgacgtcacgctcgtctgcaccccgcgcaacggcgccaccctccgcgcctccgacgacgacgacgacgacggcgcgtgctcttccgggatggccttccacgcgctatgccgttcgcgccggccgaccacggcgcggcctgccggacggctgcgagtcctccagcgacctcccgctccgggagttcatcacgctgctgttcgaggcgttcgagtcgctcgagcccgccttcgatggcttcctctccggcctggttgatcaggagggcaccaccgtctgcgtcgtcgccgacgggttcgtcgcatggacggtcggcgtggcgcggcggcgcgggtgcccgcgcacgcgttcctcgtgtcgtgcggcgcgctcggcacg

SEQ ID NO: 46559 - DNA, 468 bp, Oryza sativa
atagatctaatccagacgaacgtattttgacacacgggagattaattacaggaaggaattattattttaatagatctaatctaatggcggtaaataatgggtccaccaaatttaataaaaatcaatggtgagatgtttttcttttttctcagaatttatatatttttctatttttattagagtgtcacgtggcagtttgagagcgtttttagagcgccatgtgacggcatgagagcgtttgtagaaagtttaatggactttagtatataatagatggtgggtcaaaagatacaataccaatttatcacttttagatttagcgtttaataatttatcatccatatatctatatttatgacacgtgaattctcatgactatagatccggtgataaattgttaaacactatgtgcatcagagtgttaaatatctccctcccgagtcctatccgacgcttctcttctgtagt

SEQ ID NO: 46560 - DNA, 1501 bp, Oryza sativa
tgatcaaggctgccgcttgcattgctaaagactgcagcgacgactcatctgaaagttgaaagtaccatcaaacgattttgtaaacagactactccttgcactgatcgatgtgctagcttcaccattcgatcgatgcgctctactattagcaggcagcaggtgttgtctactcaccctgtgaaaataaaaacaaatagactatggctgtgtttattttccttcgaacttccaaaaatttcgtcacatcaaatgtttgaacacatgcatgaaacattaaatgtggatgaaaaaaaacaaattgcacagtttatatgcaaattgcgagatgaattttttgagtctaattacatcatgatttgacaatgtggtgctacagtaaatatttgctaataacggattaattaggcttaatagatttgtctcgcagtttacagacggaatctgtaatttgttttattattagtctatgtttaatattttaattgtatgtccgtatactgctaggactgactactgttactgccagtctctcactcaagtgagatcagatcaggtgtttgcatggtccactccacgcacacatcgacgatctctccttgttttttactcctcctcagataatgttgcacatctatagtggagtggtatatgatcatctatctgcagcacctgcatatgtttgcacgtctcgacgtgcgtaaactcatctatggtctctcgattcattacagtggcagcaaccagctgcagtactacacatctggcccgccatgcaaggtgccatctaggagctagtactgtactgtatctaagttgaacaagctgctgctaccatgtggggaaatagttttaaaattgagagggtagctgaaaacaccatttaaatagttataaaagaatctttaaaaaattaacaatattcgtacaacatataaaatactactgtttcacaaaatcttaaaataaaaatccactcacacatagagaaataaaaaaagagatagaattaatactactcagccgtcgagcttgtccccgctggccgccgcctttctccccacccattgtcagctcccttgaaggtttgggttgagatgggaagaaaggagagaggtgaaagaagattgtgggctgacatgtggggccgtactaactcagccactatgtcaccaaaatcggagagcaatattgctttgggatcaaaaggtgactcagtttataccagattaatgatccattacctctggtattccggttcagggatggttttaaaactcgacgacaagataagggaccttaggtgaactttacttttttcgtagaagaaatatttccagcctgatgggcctgtgcgtatgacccataggccataggcagccggccgcagagcgacctcctccatccatcccgtctgccgccggcgccgatctccatcctgcgagcagagcagaggtggcgccgtcgccgcagaggagcgggagcatggccggaggcgggagga

SEQ ID NO: 46561 - DNA, 1055 bp, Oryza sativa
aatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaaacagtgtgcgcatggcgtatgcccaatactttggaaatttctttattcacaacatacaagcttttttatagctgttttgctatgtgaattttcaataatgtagccaactttaggttacactcatcatattttacaaagcagttggtatatcactcggatcatgttattcagggatttacaccgcatatgctacatattaatatcaagtcgcttggttaactataattatcgaagccactcggttggttggattatttattccttgactatatgcttggtttgttcacttaaccgcatagtcgagggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgtgaaggtctcaggggctactgtggagattatgggtaccccatacccacacggcatggttatccgactagttataggggataacttatatttatgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggtaggaggccctctagggggcata

SEQ ID NO: 46562 - DNA, 1501 bp, Oryza sativa
tgttcgaaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacaaatctgtgtgattcgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattactaaatgagctgttgaaaaacatctcttaatgtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatatagttccccggccctgaagagaagataaagtgaagtgaagattagggtttcgtcctggttcccagccgtcgcctgtggtgttgggtgttagaccgttggttccgctgctgctgctgttgttggtgttcgcctcgtccgtgtcgtcggttgtattctcgggctgtctgagctataacctaagttaaggtaaataagtcctctatttatcttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtgtgacaaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcaacctaatgcactgtagttcaggtgggttggttgggcctgttcaacgtggtgtagcgttgatcagtggagatttaaggttactttaattactcaactgttttactgttttgcttaataaaatgctttacaaccgcttttatgcaaatagccacaaaccgtccttgtgttccccttgcacgtctgcatcattggtgtggcttgctgagtacggtggttgtactcagccttgctattgttcccccttttcagaagtgtaatacttctgagttgaa

SEQ ID NO: 46563 - DNA, 628 bp, Oryza sativa
tatttattgcaaaataatttggggaacaactgtacccccatgtccgcccctagcgggaaccccctccccagctctgtccaatcaattttaaaccgtagttttgcagcataagatattttgagaggcatttgaaacattctaaaaattccatgacttatctagaagccaaccggaaaatattccacttttatggacaaagctaacccagttcaaatccatccaagtttcctttttttattcaatgcccccttaagctctgttaatgcacaacacattccccggcctctctcactgaccagctggtccaaatgtccagggtggcctagttggaggcgtaacacctttctcccagccacttgccaagtagtgtgaagtgtgaatacggcgtcttgcatattttgcatggagttatttcattctataaacataatacacaagtatatctgtttccaacacatctgcaccttaaatgctaaccagcaatgacagcacgcagccaaatccgcacgatcgggtcaacctattgcgatgttgtccatgtgattttgggcctttccttttttgcaaattgtttgatgggctttgagcctttccttttttgcatattgtttgatgggcttcgggcttt

SEQ ID NO: 46564 - DNA, 1501 bp, Oryza sativa
tagcgtaaacttttcgcacgatgttttatcattcatgttattcaaatattttgtgtaaatatgtaaaagtttatttgatgaaaaaagtcacaataaaacaaataatatttatataatttttttaataacatgagtagttaaatatcacgttaaaagttaacggcgttaaatattaagaaaccgatgtattatatctttttggatgaaacgctgatcgatctgcattttatataatatatatatatgtatggaaggaatttctggtggaaactactcgtagatggtaatctcacacatgcccactgatttttcttctcttatagccacgtcaaagtccataaaaatggggaaaagaaaagcaaagtgtccttgtcttggtcggcttgatcaattggtcttggattagctcacctgcctgtgcccttccattgatgatgcctaattaaggtttagacagctgccacgtacgtaaataagtgactatactatgtattaacctctttcatattatatatatggatgttagcttgactttttacaggaacttaacacttagggagttgttaagattgtagctaaaacacaccttacaaattttggtatttcggtaagttgacaatattatcaaaattatgacagaattttttttgtatttatcaaagtttggcgaaaaaaaataaatccaagcaaatctttggtaactttaaaaaaaatgatatgatacattccaattaggaaaaaaaccccaccgttaacaatatttggattatatattatgaaagtatttatcattgtgaatatagatgctaattgcataggagtaacttacaagggacttttttttttataaatcttataatgttagtacgaataaatggatgaatggtgcatgccgtaaggctccccgaactcaaatccaaacacaaataaagatgctaattgcataggagtaacttacaagggactttttggccacgatctggataaacaaaaaatcaaatcatgctctttgattaatttgatgtcaagatcgatcgatgtgatgaattgtgtgctttacttgttggtaaccaagcatgacaagacactgcttggcctctgattccaatggcccggtgagaaccacgtgtcatcacggcgtgcgtgtgggccccactgttgggaccaatccacccccaccacgttctccactgcccaccttacgtggcatctcctttttctcatctcaattttaattttttttaaaaaaaattgataggagtagtaaaatgcaccaatcctttattcctcggaggaaaaaaaagaaaaagaaaacttaaaggacactgtagtactccgtatttgattttgcaataactcctgggggcttcttcccttccactctcgtctcgtactctctccaaacccaaatcaaaaccaaaccaaaatcgaaaccaaatcgaaaaagcgagagagagagagaggaaaaagtttggattcatcatccccttcttcttcttcc

SEQ ID NO: 46565 - DNA, 1501 bp, Oryza sativa
taacttttatgtattgagatgttgatttacaaagtttgcttgccccaaataagtccatccgtggtcactgcatatcagtaattaattcataaaagttttctgtcagtttgactaattgcagttaagaagttcgattgtaagcaccacatcctcaatctattaggcacttgctttgaactcacaagctaatcataaaaatctgagcatcatatttgtagcagtagaatgtattgagaaaaagacttcttttttaatttaacgtgaggcacagtggtataccgttggtctattttcttgacgtgcttatcttaaactatatctatttttaattttttttatcccatgattaactctaaccctagagaatattaattaattaggtctacaggatttaaggccactaacatgacgcaaaagtgaaaatacaacatgatgcaagtcatgggaaaactatgactctgtgtacaaaccaaattcaactatatatttgtaggaatttttaaaccatgaaaaatttatgattgagatcaaactaattatcacacgatatttattaagacaatttgtggaattattagattatgataatctacgatcaagacaacaatctacaatatcttgctataaaaattctaaatctttgaattgaataaaggggaaaaatacgaattctgatatgttgttaaattatgaaaatataatagttgagcctgcaaactaatgttatatcgggtatattagttctcaaattctaaactagactaaggaaaatttgttcatatcttgatattattaaagcaataatttgtataactaaggctgcacactaaggtatttcggtatattaaattataatatttcgatttaagttaataacgataacaaatggagagttcaatgtgagcataaatagtacttctgaatttggaattctaaagtttaagttaatacatatttacattaattttgttgtactaattgggcactccactgaagtttctacattaaacaagcagatttggatgtgcaataatattagcccgttcaacgcacgggttggtgactagtacccataatctggagtgtcctattatgatacgtatatgtatacttggtatgagcctactaagggatgtcacttgaacggttttttcaagttggtggtgaagatttggtttagggatatgaattaaactcgtgtagatatgagggattataagtagacttattcgttctttcccccaccatctgttaggtccaacccagcccatcagaggtcacattcctctttccttttcaccaggcccagctaggctagagtcttctcccttggcctgcttggcgaacgcatcgccctgttgccgccgggagcccaggacgaaccgcgagttcgagcgagtgtgcacaaagacgccacagccgtgaacactcgcgcgacgagctggaaagtttcaaatgaatatatatagtgattgctcggtcgcctgacgacgaagatagc

SEQ ID NO: 46566 - DNA, 1501 bp, Oryza sativa
aggctggataatcgaggttagagctggtggaaagaacatgaacaagatgtataaggtaccttttattttgtcctgtaatatagttgtattctaattgttctatgcccattagtagtttgaaatgcagtgattcatcatcagatcttagattattcttcatgacagtgctaggatgccaatccaataagctagaagcgagatagggaattcaacaaggatctaagcttgacatattataaaggaaaaacatcattttacgcctgtaaacttttaaaagcactccataacttcaaaaccatgcctcagctctttgtaaaccggttttttattccttgatataaactcaactggttttgaactacatagcgcttacttttttatatctggccagggctgggaaaaaaaatcccatagaggcccacctatcattttccatcttcacttcctccatcgaaaaaacaaaatcaaatcctaaggatgtatttggataaggtatatattttcagatacttccttagaattagattttttttttgggatagaaagggagtaggtagtattaattaggtcagaaatgagctctccaactgtgtattattcttgtctttggtgtgacagtaaaaaatcttgacatggtggatcatttgaatgtactataaaatagggggacatgtaccctcgttaatacaaattatgtctatactagaagacctcaactgtagtggtggtaaattcgccaccatcacctacccacttatacttgaaattcaaattagtgaatccatcatctaccactctacatcaaacgatgaggcatatggagcaacatccattacattgaattttgataaaaatatgatttttctcaattaactttttataaagtaacaaagtgattaattttaattcccttgcaacacatgggtgtttcactagtatagaaaatataacggcaaatctgaaaagccattgccaaaatgtaacagtccatttgcattattggcctgtacacataattgctgatgcttctattgactggaaactatgatgacgcttttagaaaactattgttgaaataattagttgtatatcttcaagggtttaaatatattttccatcataaacacatcatcttacatttgagtacaatataaggtcctctacaatataatagttttctcgtgttagtgaaaattttctgatcacctttaattatgcccaatttgcagttttatgtttatccaccagctggagttcgactgttttctaaagaggatgtactgctatatattaataagtccgagattactggatttgatacaaatggagaatgtgacacaagaaccaaagacaacgtgtgcttcttgctgcaacatctgccctaatcacttatctattaattattttaccaatttgtagaatttaatgattaatatatagatttttctgaatgaaactaatgattgaacttgtttttagattcttgcaaatgtggaattta

SEQ ID NO: 46567 - DNA, 1501 bp, Oryza sativa
atgcatgcaaaaacaacgctatcttagagaatttttgtccttttaattttaaattactagtaaaacttacttatctggccatgatgtacatatgtgttttaatgctacgtatgttagtcgcatatcagtcatctgattgcaaatgactattccaacatcgtcataaatttggcctgcataatcatatataattctttttcttattctctatcttttgttatgacttctattctagtcactctctgctaatattatcatttagtgtgctcggaatattgactggtcttgttcaacaaaacaggcagctcaatcaagaatgaagcttccttgctgatttttgtcttgcacaataccgtacaagtagatccatccaaaaaaaaaatagaaatcttcccaaatgcaattttcaaaatactgcgtgacagtgacaaacggggtgatatgatgataatataatgatgatgacgatcgaagggcaaattttccatcagaaaatgactatactagttaatcatgtccggaaatctttctagagatggttttggtttgcagccgccccctatcctagtactacgtttctaaatctctgaattagtcagagtaatgtgattcatatgtcattctacagaaacttacaaagttacggttgcatctagcgtgtgtctttttgtttagttgctgctactggcttgtaagcatttcaaatggctaatcagcagaaaggaacacatgaatctttttttgcccattctgccgctgtttagacgttttaatacatgctgattaagcaggtaagcaagattcgtcagtccaattgtgcaagtaataactaatgtattctcagagcaatcgaattctgttataacctgggtacgcttaagtcagattaccaaccctagctacctgcagatagacatagactgaatcttgatagttccagcctccaggagtaggttttttttttttccttcagaaaacaaaactagttgtatactgccagtagattgtaccgtaaaaatcttcatctgaatggagaaaacttagctgaagctacatgatagtattatataagcttggagcatatgctgggctttgtctctggaattctggattgaagcttgaagacacaagagcactgtttcagaaagcagagcccaaaaccaaaacaatgggcctaaagtaaaacaagagactaaactgaattttcagtgaagagaagcagagcgtttatacttaatttggcgatcgaaatcatgctacacagacggtgaaaagaaatcctaaataaacaagcatatacacacaacgaaatggatcgagcatgcatgaacggcaacgaaaacgattaattccaagcggaagacgccatgagcagccgcatatccctcctgcatattccttggtgacggaaaccccaatcacaatgttgcaattataattacgtgcattgcattgccgcactaataatccatggcgccgcctaatgacgccggagatggcg

SEQ ID NO: 46568 - DNA, 1501 bp, Oryza sativa
actcagcaagccagggaaataagtgtttaatgcaggcttcaaggaaaggcggctgtttttgcaattgattttatttgaactcttttctaaaaacaactaggtgagtgcttctcaaacgacacggatgagacagtgcatctcgtccggtcggagtatgtgcaatgtattagtctttagaattgaaacaagattggcacccggccaacagcttttcaaacggccacccgggccaacgactttacaaacggccacccgggcctagctgatcccgtcagctgctgatttttcaaacatcgaacccctttttcataacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccagggggtcctcttcgacaccaccccggcgaatccacatgtctctcggcatcatggctcccctgataagctagttactcagccaggggtgtcccattccacccatgtggtcgtacttgtcttatgttcggatgaaattccaaggaaacggtccttaagtgcaagagcgggaaaaccgtacccccggtacgttccccgatccgtggttttggaaattcatttagttcgcaagcaccgacccaggtgtcgggttttccaagtcttttgtaaaactccagttttacccaagttgttactcagatttttaagtttgaaggcgaccgtcgatactcgcacagagtgcacgaatatcgaggcgcaactgggtggttacaaggggacatagtatagcaattaacaatggaaggatcaaatgcaacaagtcaggtaggtccgccaatctgccttgcagacgggataaaagattaagtgcgatcctatcaatgcataatattttgcaagcaatataattaaatttcaaatataggctcaagatgttcgggtggcttgccttgctcgagatctggagcttgatcctcgaaatcctcgcgctacgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaatgaaaaggatttaattaaatcctttttggaaaagaaaaagaaaagaaaagaggggggggattatagacttttcctcgggcggctaaggcgcggcccaagggaat

SEQ ID NO: 46569 - DNA, 1501 bp, Oryza sativa
ttcattgcatcaatgaattatgcatgaatggcctgacgatgaactgacgctgatcatgcatgcatggtcctgctgagtgatcagtgggagagagagagggaggggaaaaggttggcgctgcagtgcaagatgcaagctgccatggagcccatctcttgcaggcctttttgctaagctgccccctctcagctcagccctacagccaaaagatgacgagtactacgactacaactactacagctgctgctgatgttggttgtaaggctagtaatgaatatcttaccaaagtgactgaatattgactggagtattactagctctgaattttgatttgacatggttttgaatatcatgggacacgaacaaatgaaacaagacacaaacctgcactgctagtgctaagcatggtggtacaattataattaactacgagtacagaactgctggatgcatccatatacttatgtctggatgcaacaaggggagctgcgtgggcgtggcctaacaaacaattcggcaggctctgctgcatctgcaaattctgcgtgccactacggcaaatatgatacgctggctttggtttttcagtgaatcagctcactctctcacatcttctcctcacttcggctcaacatgtgttttcatttcatttaggagtactacaactatggagctttctgcttgtctcttcccatgtcttcttgtactccacctgatgatagctcaaccacgcctgaatccacaatccattggcgtctagcactttcatatactcctccacaaacgaatcaaaatcaaatctttttaattaattaattgctgtttagtactagtagtagagcagtagtagcagtgttgttttcttcatctatttcccaccggcaaattgcactgcagatttgcagagtagcaagcaccacatgactcacacacacctttctcttcttccacactacagtattcagcaactaccttaccttaccttactggggaggggaccttcttaattaattacacagcatctactttgtgtttcttgcttccctaagagcaggtacaatagcaggctataagccagctgtaaacatattataaagagataaaagaaagagagagaagagcagcgggctacagatttgtagccagctgtagcacgaactctaagacgtaatatgtgtatggcatgtgggaccggatattgatagtatatatagtaagcaactattatatgaattggctattagattgactatagatgaattgaagttagcagtggactatactattaaacttgctctaattaatttcctactacaacagtttaattaatatcctggtcatccaaaagcccaaacaacacttctacttatacagtgaagagtgaagagtacataacacttgtgaggcccagcctaatgcagttgtttgtagctgctgctgcctccttttgctttccaacgagacagtcaagaagacgaagagaggtctccatgtcgagctt

SEQ ID NO: 46570 - DNA, 255 bp, Oryza sativa
cgcgtgtttccggggagtaaagagttgtcgtctgggccccacatgtcagtagtactggttgtccgctacgaggggatgacatgtggggtcactgatgagtttcacttgggttcagtttgctagtgccacgtgccaaggataggggcttttccgtcgggatccgcttctatcggcgagtgtcacccccgtctcttgatcgtcttcccgtcaacgtagcactagctcgcggttaaatttggcaaatcaaccgcttga

SEQ ID NO: 46571 - DNA, 1501 bp, Oryza sativa
ttatatatatgccccccttttgagttaattacatgtagctttcgatgacctatcatcgaacagtcatgatcagtaagaatgcactagctttgctgcataaaaatcaagggcaggtttgctggtgtcccaaaagtagtggtgtgggtgcgctccatggtttcaatgtcataatgtaatggcttttaatttctactatcaggctacatatattaatttaatttcacgattacattgtgtccatgtaataatataatatagaattctgttagttatactagtactgtttaactgtcgcttgctttcagatatatagatcgatggtgcaatccagcaagaaattcaacaacatcttatcaaataattcaggtcagactgactaaggatgggtttaaacaaacttttcgattgctagtcatagaataatcatttatcagtatataagacagctgagcatgcaaatcaatagatcttgctggccctaggcagcaaaaaaaaatcgaatataagatttgctatccaatatcttgtgggcgtgcaaaaaacaattagaagaacctgctagctagctatatacctctccctttccttagtgattaaggttttagagcttctcaatgagagtaactaggtcgggctttaactagtttttcttcccttctcgatcctctgtaaaattaaaggtgtttttattattattctgtgataaacaattgggcattggagattattggttttgttatttggaatttattcacgaagtggttttggagatgatcggatttacaggtgatcgcaggatctatcattttatgtggactagtcagaccgtcagaccggtgtgtattgcgcggtcagacaggcgcaacccgcggtctgaccggccgacactgtatcggtttcggtttcggattgtttatttggatatccgagtttatttcatgattatgacttctagatggatactatacgtatgtaatactattgtttgctgctaatgagtcaagttagagatagcttggtctcagaatatggtttctttgtttgttccatgtgtaggtgactcgatgtctcaggagagtatttgcagtgatggacggggagtcggcttggggataagacgacgtccgtggtggtcagagatcatgcgggatacttaggctagagttgatgcacgtggttgatggagattccatatggtatacgatggagttattgtgtgcgtatgggatgcggagtcgaatttggaaggagtccaaatttgatacgattggttatgtaaagtttctttcttgtactaaagggtttcctaaggtgtttaggactcctagtatgagtttggttcgtggctttaggctgcctacctcatgtataaatagagggggagcgtgaggcttcccggtatcgctttagagagcaatagaattgagttttgagttagggtttcgagtttagtcgaaatttttgtaaggagtgatgttgatacactttgtaaagacagaga

SEQ ID NO: 46572 - DNA, 841 bp, Oryza sativa
ttcacccttgatccaatccactcttgtgagccatgtgtaagttttgagtgtggatgtcgaggcaatgaaatgactttgacaaattaaacttcaaaatgttgcttacacgggaggcccacatgtaagtggaaataagcttctttgttatctattagcttcctttctaaccttctctcctctccccacttcaatgagtctcccctgtacaaactgtttgccgggcacttgtgttggacgcactagatcagccagtggtccagcctgggagactttgtcatgctgtaggcatacctctagtcgaaacacacttttcagaacctcaaaaaggatctcaacttcttgattcaattttggttcttggaattagtatctgctgagatgcaactcgtgatgagcattttttttttgtttttttctttgggctctcctttttgttcagtattcgaaaattttagttttctaacagtgcaaaccaaaattcatgtcgaggaaataaaccacactaaaaatacaaattggttcagtttgcggttaaaaccatatattgatgttagcaattcatcagttctgcaaagaaatgagaagaggatgaggagagatggggtgaggatgacatgtccatggggatccaataatttttttcattctgttttctgagtatttgccattccaacaaaaccactgataagtcataaaagatcaccataatttgtctggggggaaaatgcacagttttaatagtaaaaaggttgtgtagtagacattttaagttaagttttgataaatgaacttattcacagtttaataataatgtttgccatcctttacaagctatggtaac

SEQ ID NO: 46573 - DNA, 1501 bp, Oryza sativa
ccgcgcctttgttgccgcctagcagctgccgaccctcccttcgccgtcgcgcgtgctggtgaagccagcgtgtgcgcaaggagccgaagaggactccggccacccttcttcttccccttccctggcccaaggccgaagaactcgccccgcgccgtcgaccgcccatcactgcccgcccggctcggtagtgcctcctcccgtttcccttcctcgctctccctcgccccccctctagtctgcgtgatagctcggtggcactcccgaacacgcgtagacgccgcccctagacccgccgccgcccggcatggcctcgccgccgttgccgcccgctcccggaggccgccgctcgtcgccagccctccttggtgctcttccgccccatccgacgccggaagcggactccttgaaccccggagatgcttccaccgcctcgaattgaatcctcgtcgcccctccgccgtttgccctttttctcaccgccggcgagggccgccgcgtttcgtcgtcgccggtctcctttccgtgaatccgagccggtggcgcactttatctcctccgtctctttaatccgggtgctccctccctctcgaatcgtcgtgacaagctccggtgaactcggccgccgtccgccgtccatctcggcctccccttcttcctcctcccgccggcccgcgtggctgccacgtaggcgccacgtcggagccacatcggccgcgaccgggtcagcacgaccagcctgccgcctccccctccctcgaccggtgcgcgcggtccacggagagccctatggctgcgcgtgggcccgccgcctctcggtccatccggcgcaccgcccgtgcgccatcttcaataaaccctagcgccacccccgcgtgaacccattcccccgtgaaccttgccgccgacatgtgggccccacccgggagcccgcgaggtgcacccggtccaccggaccgccccctctccctcccgcgcgccctaatgggccgcctgcttgcgcccgcgtcggcccaatggcttggccgagcctccttcgacccttgggccgcgccaatgccaccggaacaagtctagtttacatccctccttcaattctctttccagaaaggggtttaataaattattaaatcctttctcctttgattagaaaatccttaaaccttagaaaatccatatcttcccaaccgctcatccgattgactccgctcaacctccagtaattccgtaaaattgagatctatttaatggcactaataattagtctaaataggatctttcttttggtcttttgtttaggttttcgattgtttgcgtatagttgcggtaatcggaatttcgtcgatcgcgggttctctcgaagattcgtgaagcttcgtgaagaccttaagcaaggcaagtcaccctttgatcaattgctcctataattgaaaagtcattattatttcgtttgcaacttgcattattagaatcacacacttaacttgcttggcctcggtttgcg

SEQ ID NO: 46574 - DNA, 1501 bp, Oryza sativa
gttacatttgtgcgctgtattacaagatagttatgttgggatacgtataggctacgatagtataaaaattaaaattttctatcacgtaaaccaggaaccatgcaagtattagatcatagattgttaccactcgacacgctgcgcagcggaagaagacgctgagaagtcgaaggaactctcgcgaagtagcgcgcgtcgatgtagaggaagtagtcgatcgcaccggctcgaccttctcctcctcgtgcgttctcctcaccgtactcccacgccgatcagcaccgcaaaccagcggcgcctttaccggtatccgcacgtacgtacagggacagaacgccacgcgcagatgtgctagcacccgcgcgcagctagggttttgctcggggaggaaagtgacggctagggtttctcacgtgatgcaatgctccgccagtcagacccctcacgaatatataggatccatcactcgggccttcaaggcccgtaggactcctattcggatccctatccgaattaagctcatattggatctccattgtcacgcccagaaatttagcccaaatttccagactattttgcgtattaaatccctgtccaggaccagccagggtacacaaaacgacaagtaatatacagttccaaacgtaaatacagcgtaaaatacttacagaagaggcacttagtcctcacaccgaaacagaacgacagcagcggaaaaaggcgatcttagcggggcttcagctccactccacaggcaagactcaactggggtctgagccttggtcttctaacttcgtcttcaactcagaagtattacacttctgaaaagggggaacaatagcaaggctgagtacaaccaccgtactcagcaagccacaccaatgatgcagacgtgcaaggggaacacaaggacggtttgtggctatttgcataaaagcggttgtaaagcattttattaagcaaaacagtaaaacagttgagtaattaaagtaaccttaaatctccactgatcaacgctacaccacgttgaacaggcccaaccaacccacctgaactacagtgcattaggttgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacaccttgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaagataaatagaggacttatttaccttaacttaggttatagctcaga

SEQ ID NO: 46575 - DNA, 362 bp, Oryza sativa
agccaagttttggtcaaagtagaatgggtccccacccaaaagaagggtaggtagaaatggtatatgtggtatccccttgagatataaaagaaggcccatgcctaccaagagaggggactgacggactaacagactggagggagctgaaaaagaagaaagaggagagcagaggtcgtagagagaaagagtgagagggtctctagagtttgaactcttttgatctccagctccttgtagctccttcgtacacagatccaccagaacacaggagtagggtattacgcttctcagcggcccgaacctgtctacatcgcccgtgtcttgcgcatttgctctctcgcgaaacattccacagatcgagg

SEQ ID NO: 46576 - DNA, 1501 bp, Oryza sativa
ggcttcttcgcccgtccctcgccgccggccaccatccccggcatcgacctcgactacgacctggacgacgatgccaccatcgaagtccactgcaacggcctcctcttgctcgatcgccacatcgtcaacccggccacacgccagtggatgcgtctacctcctgtccccccgtacgcctcactgcccaacataatgtacggtgatcggggcctcgtcttcgacccagcagcgtcaccacactacgacgtcctctggatgccctacctgattcttcatcgactccctgctgcgtctctgtcggatcagtggccgccgtcgccgttcatcctgcacgtcttctcctccacgacggggcgatgggaggagaagtcgtttctccgggaaggcgacgccaccatgggcaccatggctgatgtatccttggcaagggtaccttaccactgcaagactcactccgtctacctccggggagcgctctacatgcattgccagaatgattgcgtcatcaagatcacacttaacgaccacaagtatcgggtcatcagattgcctggcgactctgcatcaaacagaaagactagggaccctttcctaggaaaatcaaaagacagagtgtgctacgtattggtcaccggtctaagtcgactccaaatttggctcctcaacgaaacttcttcttcttcttcttcttcttcttcatacgacgacaacgagtgggtgctcaagcatggtgttgacctagggccaataatacaaagctacccctgcaaccatggtcgtcagcaatggatatggcataatgctgacactaaacaagacaaaaccagggaattaccagctgtaaatgatatggaggaatttgaatgggctatcgataaggactctgatgacattattagtggtgccaatgaaagcatccaccataatggagaatacatctccgctgtactcggatttcatccttttaaagacatcgtcttcttgcacgatacaaatttaagagttgttgcatatgactacaacaaggcaaaggttcaagacttgggtatgatgttcctataccataatacagatagagtggtaagctcatttccatatacaccttgctggatacgtgatttgcctggaatgcactacggttgattttaatgtatatttatggatatatgcccacgttggacggagcggagtttgattgccctatagctttttcactcgtttatcatttgtaacaaagagtgatttatttgtttgattgtatatccggaagactggtccggtatattttgaaattgacaaagtaacccaatcccttcttcctataaagttatcccccactaagtgcaattaatctcctaaagctcaaacctcaatgttccacgtcatcattaatttacagccgttggatcggtagattacatcccattttagccgtcggatggaaaggctcagggttcacagcacgtgaggcccatgtcaccttcctcctcccatctcattc

SEQ ID NO: 46577 - DNA, 629 bp, Oryza sativa
tcaatgtctacatgtcaatgctgtctacctccgtacggatgcgcctcgtcgattcagtgaaatagaaagaacaaaaattaagatgaagaatgcacagtcatatattaatacacgttgagaaaatacaattaggctgcgtttgactgttgcggttaggaacaaatccctcttaaacgcgtaaaacagagcgatccatcaatatgtgattaattaattattagcatttttttaaaaaatagattgatatgattttttaaaacaattttcgcgcgcgtgtatatacatatacatatatatacacacaccgtttagttgtttgaaaaactcgtcaggttctgatttactgtgtaggaggaatccaattcggttgcggttcgtgcagactgagactcaaaatccgactccgacggctggggctgtttgtactcggcttcgttcttcctgcccatgcactcttcgcctacataagagatagatagccacaggactaatttcttcaccaacaaacatcgatctgatccagcgaacgtgtgcgtggaattcacacagcttttttggtgctcagagtacggtatttttggtattttgatggatccgctcccttttccctgcctcgccctgtacgaaga

SEQ ID NO: 46578 - DNA, 564 bp, Oryza sativa
cggaaagggcatggaagggatccaaactaaaattcaggggtatgtaagggattcagcaaaattcaggggtataaaagggattaggtgaacttttatgggtacacaggggattttctctatctttaatgtagcaagatcttaatataaagggcaaatttagcatagcagtcaagcatataagatcagaatagctaaatcaggtaagatcggctgaaactccgatactatctttatgggttatcataaaacaagctagatatcacaattatagataaaacttaatagatcaaactcatctgatgcagcattaatcataaagataactgtaagatctaaacaagatgatgaaaacctctaagagatggtagagatacgatataatctagattaataacgagatctaaccctatcggctactttctaatagtaaaaaccagccgatggcaagttatataacgaaactaacagagattataaaacatatatgataactcgacgaattacataaacaagattatagtgtcataaagatggaagcactaatcccgagaacacaaaccgtca

SEQ ID NO: 46579 - DNA, 154 bp, Oryza sativa
accactcgctgaatggtagctgcatcatgagctcgatcatagcggaggaactgtcattctctgaattttctgcatctctaaacatgcctctgaacacttcgagtttgtgacttgtgagctctttggctttaccactgacctcttcaccaacagt

SEQ ID NO: 46580 - DNA, 1501 bp, Oryza sativa
taaagacatcgtcttcttgcacgatacaaatttaagagttgttgcatatgactacaacaaggcaaaggttcaagacttgggtatgatgttcctataccataatacagatagagtggtaagctcatttccatatacaccttgctggatacgtgatttgcctggaatgcactacggttgattttaatgtatatttatggatatatgcccacgttggacggagcggagtttgattgccctatagctttttcactcgtttatcatttgtaacaaagagtgatttatttgtttgattgtatatccggaagactggtccggtatattttgaaattgacaaagtaacccaatcccttcttcctataaagttatcccccactaagtgcaattaatctcctaaagctcaaacctcaatgttccacgtcatcattaatttacagccgttggatcggtagattacatcccattttagccgtcggatggaaaggctcagggttcacagcacgtgaggcccatgtcaccttcctcctcccatctcattctcatctcaccatcccacgcttttggactcccaaacgacgctgttgcctttcgtcaacccccacttctccttccccgccgccgccgctcgccgcccgcccgcccgcccgccatggatgaggagtacgacgtgatcgtgctggggacgggcctcatggagtgcatcctcagcggcctcctctccgtcgacggcctcaaggtacctctctcctacccaatccgattgatccgccgcctcccgtgctcggatcggtgcttgatccgtagaacggccttccgcccccttcatctcatctgggcttgacgcagccgcactcggatgagctgctgctggttgcttttttttttttacctcgccatttgatcgctgcacagagatcgaagggagggcctgccatggccgctcaacgtactcccgccccctctccgccctccactgccttctacacatcggctcctccctctccactcccccgcttttgcacccaccaccgcatcccccgcccggagaccggcaacgacggagggttagcttcgacgagcgaccgaccacgagatatgatatgagttcatctgcgccttccctcacagcgtccacctgctgatcatcctccaaaacccggcggaatggtaaagccgcctacctcttgcgtccgcctgagggatgcagtcgctgaacatgtgttgctcatgtttgatcattggcatgctttgcgtgaagcttcctgattgtagcaattcgtttaatgcggtttcaaatcgaagtgatttaatatttttttcccatgttaattcgttttagagttcaaaccgaaacatcattttagagagatttttattttgtagtttatagaggattacaatgtttctgcatatataggtaaaacatgaatgcatttaaacaccattgtaaatttcccaatgacgaatggaatcatgagaatatatccaattttttcttctattg

SEQ ID NO: 46581 - DNA, 1501 bp, Oryza sativa
gtgtgctcgccgccgtcgccgctcgagctccgtagcacccgcacgtcgccagcctcgctcggcgtagctccgtccaatccgacgctagcgtcgagttcccgaagccgcgtagatgctctcaccgccgggaatcgacccctcgtggcctcgtcgccatttccctcttccctccccgccggttgtcgccgccacgattcgccgccgtcaagctccctccggcgaatccgagccgttggctcgtctcccctcatcacgaacaaaagcccggtgtgctcgcttttgcccgtatcgccgtggttcgctccgtcgctcgccgccgccgcccgccgtccattcgcggccgggtcgtcgtctacctcccgccagcccacgtggcagccacgtaggcgccacgtcggcgccagctcagccgaggtcgggatgggccaaccccggtcagtccctccccgtgcgcgcgttccaccgcgagccgtgaggctgcgcgtgggcccgccgcatccgcgtccaccgcgagccgcgcgcgtgcaccgcgtccttcccccgcccgcgcgcgtgcgccgcgtgctccctccgcacggcgagccaagccactgacaagcgggtcccacccgggaccgcgcgtagtgagcccggtccaccggactctctctccttcctccgcgcgcgcgcgtcttgggccgctctgggctgccttcttgggccggccggcccgttaagatcggccggtccgctccaattcccttgggccgcgccttagccgcccgaggaaaagtctataatcccccccctcttttcttttctttttcttttccaaaaaggatttaattaaatccttttcatttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgtagcgcgaggatttcgaggatcaagctccagatctcgagcaaggcaagccacccgaacatcttgagcctatatttgaaatttaattatattgcttgcaaaatattatgcattgataggatcgcacttaatcttttatcccgtctgcaaggcagattggcggacctacctgacttgttgcatttgatccttccattgttaattgctatactatgtccccttgtaaccacccagttgcgcctcgatattcgtgcactctgtgcgagtatcgacggtcgccttcaaacttaaaaatctgagtaacaacttgggtaaaactggagttttacaaaagacttggaaaacccgacacctgggtcggtgcttgcgaactaaatgaatttccaaaaccacggatcggggaacgtaccgggggtacggttttcccgctcttgcacttaaggaccgtttccttggaatttcatccg

SEQ ID NO: 46582 - DNA, 1114 bp, Oryza sativa
accactcgctgaatggtagctgcatcatgagctcgatcatagcggaggaactgtcattctctgaattttctgcatctctaaacatgcctctgaacacttcgagtttgtgacttgtgagctctttggctttaccactgacctcttcaccaacagtgcgccacttgtgctgcacttgcaagcgcgcacaagttacacaacgagtgtccgtttcagatcagatccaaactgtccatggatccagcggccggtcaaatcgaatgcacatgcacatgcaaaacggatcttcagacagaatcatgggctcatggcctcatcatcatcgttctcttaattaacttgggttaaaatttttatctctctcgcaagaatgtcccccctaagagaagaaagatatttagggtatccttgtttgctccaaaaagaattagtcgtcactaaaatttgagttttaaacataaatttggagttaattttaaggtattttgaacatagtttctttttaacattgattattaaatcgctaaggacacatcatatacaattctttatttacaaattattttttactaataaattatttttgatttataatcagcatttgatcaacacataaaggcctgtttggggagtttgctgtagcttctcccagaatcagaatctttcccaaacagtataacttttgtttcagattttgagaagctgtagttgtagaagctagaaaataaactagaagttagaagctgaaaaaccagattctcaaaggctggctaacaacagcttgtgtagaattaaatgtccttttcgaaccacacgtaccatgcctccatttgaatgcaagtgcaactatgcatgttcatgtgaagagatgcatttctctatgagtagttgtatcatttttgttttcttgtgagatgccaatcaataacaaaatcgcagtacaaatatttgctggattactgttcactactcccatcacggcacactgattcacagcacacagtacaccatcgccaagctggcaggcccgggcccaccacccccctccctccctccctgcctcctctatttgagagagccggaggggttagcgggttacagttgtagatgcacccct

SEQ ID NO: 46583 - DNA, 1501 bp, Oryza sativa
ttctattgctctctaaagcgataccgggaagcctcacgctccccctctatttatacatgaggtaggcagcctaaagccacgaaccaaactcatactaggagtcctaaacaccttaggaaaccctttagtacaagaaagaaactttacataaccaatcgtatcaaatttggactccttccaaattcgactccgcatcccatacgcacacaataactccatcgtataccatatggaatctccatcaaccacgtgcatcaactctagcctaagtatcccgcatgatctctgaccaccacggacgtcgtcttatccccaagccgactccccgtccatcactgcaaatactctcctgagacatcgagtcacctacacatggaacaaacaaagaaaccatattctgagaccaagctatctctaacttgactcattagcagcaaacaatagtattacatacgtatagtatccatctagaagtcataatcatgaaataaactcggatatccaaataaacaatccgaaaccgaaaccgatacagtgtcggccggtcagaccgcgggttgcgcctgtctgaccgcgcaatacacaccggtctgacggtctgactagtccacataaaatgatagatcctgcgatcacctgtaaatccgatcatctccaaaaccacttcgtgaataaattccaaataacaaaaccaataatctccaatgcccaattgtttatcacagaataataataaaaacacctttaattttacagaggatcgagaagggaagaaaaactagttaaagcccgacctagttactctcattgagaagctctaaaaccttaatcactaaggaaagggagaggtatatagctagctagcaggttcttctaattgttttttgcacgcccacaagatattggatagcaaatcttatattcgatttttttttgctgcctagggccagcaagatctattgatttgcatgctcagctgtcttatatactgataaatgattattctatgactagcaatcgaaaagtttgtttaaacccatccttagtcagtctgacctgaattatttgataagatgttgttgaatttcttgctggattgcaccatcgatctatatatctgaaagcaagcgacagttaaacagtactagtataactaacagaattctatattatattattacatggacacaatgtaatcgtgaaattaaattaatatatgtagcctgatagtagaaattaaaagccattacattatgacattgaaaccatggagcgcacccacaccactacttttgggacaccagcaaacctgcccttgatttttatgcagcaaagctagtgcattcttactgatcatgactgttcgatgataggtcatcgaaagctacatgtaattaactcaaaaggggggcatatatataaacattctggttggccatgctaccttagctctttcatgaaggaatacagatatctggtcgatggagtatatgctcagcca

SEQ ID NO: 46584 - DNA, 334 bp, Oryza sativa
ttgatcatatcttcaggagttcagggataatggagtcatctagaatatccgtacaggatgtactttgtcacattagtcgttgctctccgactctatataaactactccttttaaagtgcatgaaaatgaccatatgattactttagtttgcatttagtcccattgttttcagcaattgtcaatctttcatattgtttggtagatcctactctcattcattcaacagctactacatgatggtaaccagaagacaaatgcataggacaatataaaaaaaatggtttcatggggccaaaccagtaagatcacccactgaaatcatctgcattgcaag

SEQ ID NO: 46585 - DNA, 1501 bp, Oryza sativa
atttcggcccaacaaaaacaggcctcttgtaggttagaaacccgtaccggcccaaacatttcgcccgcacgtcgcattaccgacttacagttcaggcccattttatatgggctgcacggatacaaccaacatgggccttcccttccagtgcaacaagaatgggccaaacttgtgacagggcttggaccaagatgggggtttgaaggaccaagaatgggccttttcaatattgatcgatctggttctgtggtgctagaattatagctaaaaaaatctatgtgatttaacgctagtcaataataaatgggagttggggatttgtttcatcaccttatttcttattttgatttatttttatctttaacaaaattttggatgtgtcttatgattgaaggcggagatacaatctattttcattattaaaaaataatacatgtttgacgattgattgatagaaaattttgagatgcagagcttactggtgaaccgctgaagcaaacatctaccagtagcaatttgtgtagaagtcgtcttgtaaaaataaaatgcgtggtagggcataaaagcccaggcatgcatcgcatttgttgatatgcaggaatagggatcgatggatggaaagagagaccgggattcccctgtcggccggcaacaatcctctactattaattctttcgtcaactgaacctgaatggatatctgtatggttgttcaatcccatccatccaagatgcaggccagctctgagctcctctatttcatctagtgcatgcaatgcactggctgcagtacttatatatgcatctgtctgaggttctcttttctcatttggaggggatcaaatcaaaacacaattaaacagaggagtatacagttagaaagagcatgaaaagttggtttacgtctgcaataaaattcaagcagggatcgcaaccactttactttgccaaagaaactactttaatacttctcttcctgtacgtgtgaaagagcagaaactacgttctactactttactactacgaacaaaatcatccagcttcctttccagcatgcacctgacctcgcgatcgaatcaattcgatcggccgacgcatccatcgatcaatccatgtcgctagttcaaaccgtttacaccaacatatactccctccactaatgtatgacgccattgactttttatctaatgtttgaccattcatcttattcaaatgttttgtacaaatataaaaatatttatgtcatgcttaaagaactgaatcaagtcacaataaaataaatgataattacataaattttttgaataagacgaatgatcaaacgttggataaaaaatcaacggcgtcatacattaaaattttaatgaaggtagtattagatggacatgaaatgatgttgagcttactggtagctttagcttattattgttagcaagtgtcgctagctgttgctattgcaaatgtggtggtggtgcgagacagccatctgccggccggccatg

SEQ ID NO: 46586 - DNA, 372 bp, Oryza sativa
tttttttattagtatccaaacactctatacgataccctatataatacccgatgtgacacgttaaaactttacactcctggataagaaaaccggaggtgccagcgaaaactatctaatggacgaaccaaacggaaattggacaaaccatattcaaaatagtcagaagccgtatttcaacttcaacgttagttcaccagccacatgaacagttgttgcatggaggctcccaaacacgaatattagggtatgacctataataataaataattagagggggtgagacttcgaacctagatcagctagcccaccattttgtaaagctagccataagacccttaggcgttactaaggggcttaggatgagtgtaacaa

SEQ ID NO: 46587 - DNA, 1501 bp, Oryza sativa
agagagagagaggcgaggaggcgggaagtgatcgatcgagtggggtcccactcccagacgcagaggcagaggaagtggagcaatggcgggtcgacatggcagcccccaatccccggcttttttctgctccgattctccccatctttttccatgtctttgccttcttctcctctcctatcctcttcttggcttcttgcttgttcatcctgcacaccacactagcagtggagtaaaactgtaaaaagtatttcagatctttgatttttgcttggtggtgagagataaataaaagacaagtcgtctgcaaccctgcatcaataacctccatacagataaacaaactgggccttgagtagttcccaatttttttttctaaaaaagtcgcatcgaatctttaaacacatacatgcagcattaaatatagattaaaaaatttaattacacagtttacatggaaatcgcgagaggaatcttttgagtctaattagtttatgattagtcataagtgctacaataacccatatgtactaatgacggattatttaggcttaataaattcctcgcagtttccaggcgagatatgaaattagttttttcattcgtgtccaaaaaccacttccgacatccgatcaaacatccgatgtggcactcaaaaattttcttttctcaaactaaacacaccttgggcctcctaacagcagaattactactagtactccagtatgtaaatcattctaaggccgacttcttttgtagattatttttaccgattaactgtacctaaaacgagaaacatgattattaactaaatattaattattgaaatttttaaaaatagattttatttgattttttaaagtattattgtcacggcatgcactacttcaggaccatctcaggaaggcgaagagcaaggcaggagacaagattcaaagcaacccttgttgcggcgatcgacacgtgaaaagcggcccaacagcttgtaccaaccgagtgtgtggacctagtagaattgggctgggccacagtgagggagagaggtccatagctcatcgctataagagaccggcagggaagagaacgaatcgaacattgtagaaacaaatatttggaaatcaattcaaatctctccctgttctattgctgcctctacctgttcttagctgttcttccccaaactctcaattctctccctaaatcctcaatttcttcccttgttgtggcacaaattcttcggagacgtaacaattatctatatagaaaattttcatgcaaaacgtataatttggagtagtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcaga

SEQ ID NO: 46588 - DNA, 904 bp, Oryza sativa
ctgcaccccttacctgatcaatgattttcaagaacagctcgtctgcttgatgaacctggcatgctgtttcatcggtcggtagcatcaccatccgtttaccatcgcaacgacatgatcgattgtgctttaacttcagttttgctagaggggaagctatcccatgatttgcctcaaccggttgatgctgatgtactttgcctttttgtgcaaacttccaaccgcaaactcatcctgttgtagcgaattcggcttatgtttttttttcatgaataagaataaataagtttggtttgtactttcggccaattcggccccagatgttatcgttgcttgcttttgtttcctgatagacccgtatccgtgtggttgctgctgttgattggtccctttcatctttcttagcaacagctattactacatcctttgacatccatgatccatgcgttgcttggattaccagtcaagcatcgctatcatccatgatcctcttaaattgccgtcacaattcgatatctaatcatccttccttcagctacacaccctatctcacagggtgtgtagtacgaccccaccacatccgtcctctctggcttatgccatcctggcaagcgggacccacttccatctgccgctgcaggtgggccccccatattcatcttcggttgcgccaggctggaaccggggggagcgatacctctgatccgcttccagaaacttcaggtccccgaccgtccgatggcgaaacgcacggtcgagatcaataacacagccacggcacagctggtgtcgcctgcccgtgggccccacgtcaactggatgctgggtcccaccgaagtcacgcgcctctccacccacggaggcgtccggcggtataaagacggcgaaaaaaaccatttcgaattct

SEQ ID NO: 46589 - DNA, 1501 bp, Oryza sativa
cttttatcaatcgcattcatcagaaagatgcggctccatttgaaccgttgaaacacctccatcaaatgatatgatgatattgactacatagctcctgaaatttgggaaaccatacttttgaatgagattgaagtgaaaagttgaaaaccttccactttgtgctagggaaaatgtatagtgtaaaccatatacatagtggaaatctgaaaactagagggttgttatacaacggaatcccgttttcgaacgggataatacttgttaggtattaggtcctgatacctctaaggtatcatgtcctgaaatctaaccggtatcaagtgatacctatcaagtatttgactattcctaccacgtttcagatgatactagtgaggtatcatgtgatacctatcaggtatcagatgatttctaccacgtaacgggtgatacaagtgaggtattacatgatacctaccagatatcaggtgattcctaccaggtataagaagctgagaaccgaagcgtcgtcgttggtggccacaccctccacgccccttgcctcatgtcggaggtcgtcgccggcggccgcgttctgcgtcgtccacgccccacgtcggagctcgtcgccggtagcctcgtccttcactgccacgccccacaccaggcttgttgctggcggtcgattccgccgccctcacgccccatgccaggctcatcgcttggggccacgtcctccgatgtccacgcgccacatcacaccggagctcgtcgccgaaggctgcgtcctccatcatccacagccatgtcacgccgggagctcgtcgccagtggtcacaccggagctcgtcgttggcgacgcgtctccgccatccacaccccatgctgtgccggagctcgtgcagcagtacgcatgctttaagagagatgtggtagaatggatgaggtagaaggagatagaatcggtggatttgttggttgttgtcctatcccgtccatcacggttgggacgggattccgtcaaatagcatttctggaaaactattgttggacacatgagatttgtccaagttgcctagaataaaagttttactcctagattcaaccatgactcttggtgacatagacaaatctcatgcgttcattttttttatccaacggtagtttccagatttccactacatatgtggtttgcactacatattttccctatatgccaggaccaagacatgttagaaacagtgataatacataccgctagcaatgaacatcacacactttcagtaaagggtaagctcaatcctagtgcatgtgttaaatagtgccataggatttgtgtactactcagactataggttacatagcagattacaaaacaaatgaaaatgtaacaataataatttaatgcagaagaatctgtaaaaatagtttcattgcataattgaaagattatgcaggaaaagagccactaggagcagaagtagaacaactaaaatatgtacaaggagggcaggaggctcac

SEQ ID NO: 46590 - DNA, 432 bp, Oryza sativa
gggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaagg

SEQ ID NO: 46591 - DNA, 684 bp, Oryza sativa
tatttaaaaaatataaaattattatttattttatttgtgacttgatttatcataaaagtattttaagtataactttttttttatatttgtattaacgttgcaagaaaaaaaataaaactttatttactgtgggacggaggcagtaactccctcgagtgagacagatcaatgacagccaggtggtccaaatagtggagctccaggctaggaagcatctgtgcctcatgtcccctgtccactgaaccgtacgcttccccatcccaaccaccctagacccagctttcatacaccttcacatccggccccacctgtcatacacccggtgtacaaacaccaggtccatgcaaccatcggccccaccacaaaacccggcccattttccccatcaaattactacttatccgaaattcccaaactacatttctttttttttttattttcgttttaaaaaccgatcgagagagagtgagaggcgagcgagaagatcccgaccaaaacccgcgaaggcagcgagatcgatcggcggcggcggcggcggggagatcatgccggagaaggcggtggacgacgtcatggactcggcggtgggggcgcacttcagcggactccgcctcgaggcgctccgcctctcctccccctccgccccgtcctccccttcctccgccaaggcggccgcggcggcgg

SEQ ID NO: 46592 - DNA, 1501 bp, Oryza sativa
gtatagaaatccaacatatatttattcacgtttaatatttatatttctcttctataatatactcctggagtatgtgttttggtttctggactgtttttttagttaaattatgttttgtggttgataaaaacgattgcaatatgtcccgtgtgatttaatgaagtattaccaacaaaattgttgagaatgaaacgagagggagagagatgagtaattctcattgatcaaatgtttagtttatacatagggaaatggtttcaatcagaggacgtgatggttgggtgtgaggagtgtctgagagaccgaggatgtgcgactaaggccttgatcccaaaaattttggcaaaaaacatcacatcaaatatttagatatatgtatagggcattaaatatggggaaaaaaatcaattgcacagtttacatataaaatgcgagacgaatcttttgaacctaattacgccatgatttgacaatgtgatgttacagtaaacatttactaatgacggattaattcaggggtggatctcaaaaaaatagtagtgggggctgaataaactacatcaacataaattgaaccttcagtccacacatcctatgaatatatggaaaaaaattagtgggggctttggggggtctctgtcccggggcggtactagggtctcaagacccccattgtgaatacgcccctgagttaattaggtttaataaatttgtctcgtagtttacatgcggaatctataatttattttgttactagtctacgttaaatattttaaatgtgcgtatgtatattttaaaaattttacactcaaacacaccctaaaccgctgtggttccttgcggtagagtagaagggtgaggtgcctattcactgggtcaatcccatctaatgatatggatgaaaccatccaaaaaatcgtaacacttcctttgactgaatccaacatttgatcattactcacttattattcacttattattgttctacatacatgttaagagaatcttagaaataatatttaatatttatatttttcttatatacaagtcatgatatactttcggagtatgtgttatggcttccggaccaattttaagttcaattttaaggtaggagtattagcaacaaaacaactccattcctttagcgacagacaattcaaaagccaagttctcaaaaaaaaaaatcaaaagcgtgtaaaccgtttttaccatgaaaatatctccgatgatgcaagactcgcaggcgggcccgatggcgagccgaatgcctctccaaaagggttacgtgggacccattcgtcggtcgaaaaattcagacggcctaacattactatgggcccgtacgtcatccaccgagcgctacccgccaaatgttagccataaaccctgagccgttcacgtttcccatcccattctcatcatcctcaccctcccccgcgccgaccccccgccgctgccgccgccgccgctaaaaccctaaaacctccaacctcaccca

SEQ ID NO: 46593 - DNA, 678 bp, Oryza sativa
acatttttttcgcttattaattagagtaataattgtactctattatcaatttgttattgtgtgcctcggctgattcctggacgagggttcacacacatgtaagcgtttggaattttggatagaaattccgggcgtgacaagttggtatcagagccatcttgactgtaggataagccaaatggtcaaactttaatgacgaatttttccgacaaaaatgatttgtgaaaatttctcctttcttccttatctagaattctttgcaaattatttcattgtctactcccctctctctttcaacttgagtagttctgagacattgaaacttgaagacgccaatgaggtctacttatggaggtcagtcgagtggatcgaggaaggaccgaagtgccaagtggtcaagatggaatgaagtttggatcctaccttagaacctatgccgccaaagtgtctttgaagaatagttagtaggatagaacgtttgttgcttgtttgtgtgtaggtatggttgcattcccatcattggagtggttcattgatgagtgtgtaactatactaggttgcttgcttaatcaacttgaacaatataatggtctacacacatcagatcagtgttaaactggttaaggtcttgtctttagtgtaacctctctccttctatcttctctaatatgcaacaga

SEQ ID NO: 46594 - DNA, 633 bp, Oryza sativa
aataaatccaagtcaagcggctgctgaagaacaatgcctcattccccgcccacaaaaccaaactattatctcgtggatactttccacaacgtgttttctttcatttctaagtctcgcctattcccaatcagtccctttcatttctgtcttgcctattccccgaccagtttctaatgcattacataccatcgctccctactgcaccatctcacaaatatatacactaagataatgagagaaatcatataattgcagtcaaaacagagaaaccgttaggcatgcaatgtgaccacgaggaatctaaaacactaaacttcaaatacagtaaccaactttatctaatcccaaactagccataaacaatttcacataatcaccccttaaaacctctcatctacctgctagccagaaccgtccacaaatcacgtcatcaaccacacgaaaccaaaacgatctccataaatccatcgcggcacacaaagaaactcctcccacgccagtggatctcacgtttagccgttagatgaaacccattcgaccggatccgaacaacacaccgtgagaaggatcacgagggggccctcgatccagaccacgcagatctaaaccacccccgccgccgccgcccgcagg

SEQ ID NO: 46595 - DNA, 1501 bp, Oryza sativa
tgtcactaaatgcatgtctgttgtgaaacacggtaaagatacgttgaaacatgtatctatcatgtataaaacattaagtttaaacggtttgaaacacatatttttattttattagaatataatcttgtgcttgttgtaaatatttaattacaacaaatataacagtgtggttggatcgtagatcgaataattagtttaggaaataaaagatttaaacagcggaggaaggataataactagatagttgagccagatttttattcactgcgattctaaatattctccatggcttcttcttgtcctccaccccctccactagattgagataagaaaaagagggcaagaaggttgtttctcatccagattgatgagttggttaagctaaaatggtaaaaatgaaaacaatttttagtagacctaggtagcaaataatcaaaattctttgaaagagtgctatttgagattgcgttattggaaagaatagtatatagaagaactcagtatatatgatgttgagtttatgaccaaactaacataaaattgaaaaaatatatattgggagccacctaagggtgagttcaattttatcactttcccaactcacctctctcatctttcgtgcacacatttttcaatttactgaacggtgcattaattatttgaaaaagaaaattctatacgaaagttactttaaaaatcatattaatctatttttcaaattttttagctaaaacttaattaattacgcgttaatgtgcaacatctttttccgtcccgaacacaacctaacaacttttcttttaactcacgaaaacattgtatattccatacgaaagtagtagtaaaactatacttcttccttttgatgtataaagctaaactcgaaaacttggaatggcatgaaactaaattttcccttgtagtaattttgtaaacaatcgccgttccaaaggtccaaaccagacaaacaccggtttccaaattccaaaaccgagagagacggaaagagagcatagctgaaatcgctgaaaaggcccagggtggaagcggaggttccaaagccggaagccaaacccacaaaaccccccatcgactctctttgcagtttggaccagcctcgttcctatcgcctcctcctcctcctcctcgattcgcatccccacctcgccgcgccaatggaggccaccgccgccgccgccgcagcgcccgcgagatccgcgctccccttccggagccgcgtcgccgccgcagcacgcccaggacgcgcgccggcgctgtcggccgccccgggaaggcgcctcgtcgcgcgccgcgccgcgggcgacggccaggcggtggaggctcaggaggcgctccccatcgagaaaagtccggttcccctcctctctctctctctctctctcgctccgtatggcatcggttgcctgtgttcgccattaactgagggagatatgttcgtttattttgcctctcgcagggttccctcccttcccgagcgtca

SEQ ID NO: 46596 - DNA, 1501 bp, Oryza sativa
tagaacaataataagtgaataataagtgagtaatgatcaaatgttggattcagtcaaaggaagtgttacgattttttggatggtttcatccatatcattagatgggattgacccagtgaataggcacctcacccttctactctaccgcaaggaaccacagcggtttagggtgtgtttgagtgtaaaatttttaaaatatacatacgcacatttaaaatatttaacgtagactagtaacaaaataaattatagattccgcatgtaaactacgagacaaatttattaaacctaattaactcaggggcgtattcacaatgggggtcttgagaccctagtaccgccccgggacagagaccccccaaagcccccactaatttttttccatatattcataggatgtgtggactgaaggttcaatttatgttgatgtagtttattcagcccccactactatttttttgagatccacccctgaattaatccgtcattagtaaatgtttactgtaacatcacattgtcaaatcatggcgtaattaggttcaaaagattcgtctcgcattttatatgtaaactgtgcaattgatttttttccccatatttaatgccctatacatatatctaaatatttgatgtgatgttttttgccaaaatttttgggatcaaggccttagtcgcacatcctcggtctctcagacactcctcacacccaaccatcacgtcctctgattgaaaccatttccctatgtataaactaaacatttgatcaatgagaattactcatctctctccctctcgtttcattctcaacaattttgttggtaatacttcattaaatcacacgggacatattgcaatcgtttttatcaaccacaaaacataatttaactaaaaaaacagtccagaaaccaaaacacatactccaggagtatattatagaagagaaatataaatattaaacgtgaataaatatatgttggatttctatacatttaaaattttgaaaatattttttaagtcataagtcaggagttcaattatatggacgcgtgtaaaaccatcaatccttctgaacaagtaatgaaacaattaacttatatatcaacaggcgtgtaaaactgtatattgaagaagttgtccctacatttctcctttccccatttttccattcgaattcctcctcattttattcttccccaaaaagtcaccctttcaaacacttcccaactcatcacgcctctggcaaagggcccacagactcagtcagagccagccaacccgaccccatcccagccgttggattagcccttcaccgccgtccaaaccccacgtctcctcaatccccccacctcctcacccaacccagccactgacaccctgcccccacattacatgaaccccacctgtcagtgacacaaacatcccacacgcgacgtgcaactccccgcctccacaactatatatgaacgcgccccttcctcgcgaatttttcctctccacacca

SEQ ID NO: 46597 - DNA, 618 bp, Oryza sativa
tccgaacccctcctcgccttgattcgtacagactctggttggattgggacggatttgcagcgcaagtgcagctatattgtatgggctggaacgggcagcccacactatttagggcataacgtgattgcagttgtgtatctggccgaaattatttgggcttttgggtctatttggttctctaccctaccaattaattggtagtgccactaccaatttttttttgatagggcaaagttagctagtctatataggccccgttcgttagtcctgaaaagtgtggattaaattttagattaaagttgcacgcttttcaaactaataaacggtacgttttgtgcggaaactttctatatgaaagttgttctaaaataccagattaatccatttttcaagtttataataattaaaactcaattaatcatacgttattacaattaatccatttttcaagtttataataattaaaactcaattaatcatacattattacaatctcgttttacgtgaaacacttcatcttcaggagattcaaacaccacctatgtttggtttaataccaataaaaagccaaaatttaatatgggtgaagaaaattctagagtatagccaaattaagca

SEQ ID NO: 46598 - DNA, 1501 bp, Oryza sativa
ttgtttcgttaaatcatggtcattgttggttgtttagccaccaccggccaccacctatacacgagcggtactggtatactacctccgttttttaatagatgatgtcgttaacttggttacacaattaaccattcgtcgtcttattattattattattattattattattattattattattattattattattatttaattgaaatttattttgttgttagttattttatcacttaaaatattttaaacatgttttatatcttatacatttatataaaaattttgaataaaacgaatgatcatatattcagaagtcatcagcaccatttattaaaaaacaaagagattattttctcaagatcaaagaatgatttgatcttgcgagcctgtaaaattagaccaaggcttgatttagtttccaattttatcttaaaaagctttcaacttttccatcacatcgaaactttgctacacacaaacttttaacttttccgtcacatcgttccaatttcaatcaaatttctaattttggtatgaactaaacacaccctaggctttatttagttcccaactttttttcttcaaactttcaactttccgttacatcaaactttcctacacacataaactttcaatttttccgtcatatcgttctaatttcttcaaattttcattttttacgtggaactaaacaaagcccaaaggtaaaattttcattttaccaaccgagataaaatgatcttttgacctatactcctatacacattcaacaaaccgttgggtcgttgggatcacgtggtggcgagagtgaagacgacgatgatcacatctcgatgaaaaaacaacagcggtagaaaacgaaaacccttctgatcatcacgaccgtcgattcggttcgctagagagaagagagagagatctcgatccatgtctgcacaacacatgcattgcactgcgagatgatgaagacgactctaggtaagtgtgttgtgtgtgtgaggatgcagcatgcttacaaaacaccataaatgctctccccccaattaataccagaaggtgtctctgccccccatctcaccctccccactctgccctactttctctctctacacccataccacaaccatagtattgtctagagagagaaacaaacaacaatggccagtagtgagagagtgaagctagagtgagaaagagagggagatgagcaacaagaagaagaaataaagaagaggggagagcaaagcaatgcaccatttggtactcctcctactagagtagtagtagtaccactaccactagtaaacacactctcaccttcatcttcttctccttcctccatctcccaatctccccaagaacacctaatctaatctctctccctcctctctctctattgtccatcaatggagatgatgatgccatgatcaaatgatgagagaagaagaggagtagagagggagggggtggggaggagagagagacgaaggaggaggatcga

SEQ ID NO: 46599 - DNA, 1501 bp, Oryza sativa
aggaggggccgcggagggagaggcgggcgagggcgacctcggcggcggcgtgctcggcctgccggagcgtggtgcagttggatggcccgtcgaaggtctcgccattgaaggtgacggtggccttgaaccgcggcgcgtggtcgggcccttccctcgtgcacacgtacgacggcaggctgaagcagctcctctgcgccagctcctgcagctggttcttgtacatcgatcctcctccttcgtctctctctcctccccaccccctccctctctactcctcttcttctctcatcatttgatcatggcatcatcatctccattgatggacaatagagagagaggagggagagagattagattaggtgttcttggggagattgggagatggaggaaggagaagaagatgaaggtgagagtgtgtttactagtggtagtggtactactactactctagtaggaggagtaccaaatggtgcattgctttgctctcccctcttctttatttcttcttcttgttgctcatctccctctctttctcactctagcttcactctctcactactggccattgttgtttgtttctctctctagacaatactatggttgtggtatgggtgtagagagagaaagtagggcagagtggggagggtgagatggggggcagagacaccttctggtattaattggggggagagcatttatggtgttttgtaagcatgctgcatcctcacacacacaacacacttacctagagtcgtcttcatcatctcgcagtgcaatgcatgtgttgtgcagacatggatcgagatctctctctcttctctctagcgaaccgaatcgacggtcgtgatgatcagaagggttttcgttttctaccgctgttgttttttcatcgagatgtgatcatcgtcgtcttcactctcgccaccacgtgatcccaacgacccaacggtttgttgaatgtgtataggagtataggtcaaaagatcattttatctcggttggtaaaatgaaaattttacctttgggctttgtttagttccacgtaaaaaatgaaaatttgaagaaattagaacgatatgacggaaaaattgaaagtttatgtgtgtaggaaagtttgatgtaacggaaagttgaaagtttgaagaaaaaaagttgggaactaaataaagcctagggtgtgtttagttcataccaaaattagaaatttgattgaaattggaacgatgtgacggaaaagttaaaagtttgtgtgtagcaaagtttcgatgtgatggaaaagttgaaagctttttaagataaaattggaaactaaatcaagccttggtctaattttacaggctcgcaagatcaaatcattctttgatcttgagaaaataatctctttgttttttaataaatggtgctgatgacttctgaatatatgatcattcgttttattcaaaatttttatataaatgtataagatataaaacatgtttaaaatattttaagtgataaaata

SEQ ID NO: 46600 - DNA, 1501 bp, Oryza sativa
ttaaggagacaactttcaaatctaactatagtataattacaatataatttcgtatgtaagtataatggaactcgtatataaatattaaaataatatatgtaacactatatctaaattaaattatatagagatgataatatagttacagttcagttacacagtagttacgatgcagttacgatgcagttacaatgcagttacattgtaacagggtgtaactggaatataactaaaatataactcatctaacttctcaaactacacttccaggatggaggtctgggttcgatcccctgcaagcgcacacgcgctgattttttccaaatctcacacgaatcacggcgcggatcgcacggtcaaaaaatcgaaaacccgatcacggcgcggatcacacggtcaaaaaatcgaaagttttcagcctcaaaaactgtcgacagctagctagcacaaccgcaaaaaatagttttgacttgtgtttctcccttcttccggtcttcctccgacactcctctaacgtgccccctgctgcgcgtatggtcataggccatgcacgcatgccccgctgccccatcctcactgctacaccgctttcgccgcgagggcgccgcggccaacaccgcacaatcacgctactgcttctcgcgcacgcgcgaggtaacaggccgcctacacaacggagtcctcaacgtttccgcggtgaccacgtcgtcaacaccgccatccacgatgccccgcccgaaggcctccgcaactgtcatcttgtcactcgggaggcgctcatgtccactgcatcatgcgcaattgtgaacgcgtggctggtgacggcggcaacggtgggcatcgggagtgcgacgagatcggcaaccagtcccgaggggcaccgcctatggaggcgtgcagctcggcgggcgcgtgcgcacccaggcaggccaaagccgttggagaagcacttctccttggtggcaatcactggtgcactggcacccacagtggcgcagacatgagggccaggccaaggcagtgctcaccggcaccagtgagggtgatgacgtggacatacggggatgcacttctccacggtgcacaagctcgccgtgtccatttgcattacttggtaggctacagaaacatttttttttctattacgttgcatatatagtcattctctttggaaatatcataattggaaaatttaaaagatctatacatataattggaaaatttaaaagatctatacatatatagaagtgagtgttctaaagaaacattctctcttatacattcattgtggattaggtgcaaaaagaggccgtaagtcaagcaattcgattaagatgggggaagtaggaagatacagtaaacccattcatcatgagcagagacgaccatttcatgcttatttagttcatagagaggaatcaaattagttcatttagatcaaacacaaagacaacaggccgtgtaggaaatgcaaaataggtgcacccattaatcaatcgtt

SEQ ID NO: 46601 - DNA, 655 bp, Oryza sativa
gtttagaactgtgattgatagctactactaaatgttggaggagttttgtgtagcttgtacagggatgatccctagtcatctaatatgatgataacctgccatgtgcaaagtttttcttgggcattattttgtcacgtgttacgagctatgatttcggtttcggatgattattgcatatcacttctatcctaaactatcctaaactataagagatttcactcatgtaaggagggcaaaacccttgttctgtagaaccaagttagtaatccctcattccctaaatgtttgacgccgttgacttttttaaatatgtttgaccgttcgtcttattcaaaaaattttgtgcaatatgtaaaattatatatatacataaaagtatatttaacaataaatcaaatgataggaaagaattaataattacttaaattttttgaataagacaaacgatcaaacattttttaaaaaagtcaacggcgtcaaatattttaggatggagggagtaggacagaatagcctgcggtgtacaaagttttgtcagacattttcttcatcagaattactactgctttgtcttgtttttttaaacaaaagagagtgcatcttatcgaattgaacaggttcgataaaattgtccccctgtggccttgtgcacagc

SEQ ID NO: 46602 - DNA, 466 bp, Oryza sativa
caaccctgggtcctgggcctctgtgctatttgatttaaatatttgtgcattttttctgtgtgagcatgttcttttactgcctatgagctgtggccaagcataaaaaaatatacgcaagccaagttatgttactgttaacaattttacaacaagtcgattactgatattgtagtttgttataccaaatatgagtgttacatattttgccattggcacatgtggatgttcagggctcaatgatgcgcagaatgcgttagcaatctcatggtttcttacaagtttacaatgtgattctgaaagtttagcaccactctatcacactaaataagatttatcttgaatggtctttgcttctatgtaggtttacttcactttttttttacttgaatactgaattgacatgtgatgttgaattttgaacagtttctcttattattaggtcttgtttttattgatcatgttctca

SEQ ID NO: 46603 - DNA, 723 bp, Oryza sativa
gtgattagtccccttaataaatcgactcaatgcactgtagttctggtgggttggctgggcctgttcaacgtagtgtagcgttgatcagtggagatttaatgttactctaaatactcaacagttttactgttttgctcaataaaatgttttacaaccgccgttatgcaaatagccacaaaccatccttgtatccccttgcacgtctgcatcgttggagtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacgcaaaatagtctggaaatttgggttaaatttctgggcgtgacaaagtggtatcagagccaactcgactgtaggttgagccaaacggtcaaaccctaaggacaagctttctgaaaaccctatttgaaaaatgtctcccctcgcccttcgtcttttctttgcgaaacggtttttcaaaattctcctccctgtccctccaattcttatagt

SEQ ID NO: 46604 - DNA, 298 bp, Oryza sativa
gtgattagtccccttaataaatcgactcaatgcactgtagttctggtgggttggctgggcctgttcaacgtagtgtagcgttgatcagtggagatttaatgttactctaaatactcaacagttttactgttttgctcaataaaatgttttacaaccgccgttatgcaaatagccacaaaccatccttgtatccccttgcacgtctgcatcgttggagtggcttgctgagtacggtggttgtactcagtcttgctattattcccccttttcagaagtgtagtgcttctgagctgaagat

SEQ ID NO: 46605 - DNA, 841 bp, Oryza sativa
  unsure (1)..(841): unsure at all n locations
aaatgccagggagttaatcgtgtggcagtattttttttcaccatacgacattgttgccggtcggtttatgacaaccaccacacgaccggagaattttacaacccgagatctacagttactgtgaagaatcgtgtgaatttttctgtttttttttttgtgaatcacgtctatattaagttttcagagaccatggattaaaagtttgagccgagtcataaaagaaagttggccagcgaccatgtaatatgtatgaccaattggcaaaatattcttctcgaagcatctttccaggcttccgctgaaacgcgtacacgttttctcgatcaaaattattgctacagatgccatatctttccagccaaattggcaatcaaggatcgtaacgaaacatctctaaaaaattcagttacgcgcccaaacggcgccttggggtctacagccatggtaattctgctctacgtggcagagcctgagagggataataactaaactgggagcatcccaggtgtgcggagacaaacctagtagtaatcaacaagatagctacaggaggagaaatcaaagatgagatcaggagacacgttgtgacttgcgattatctagtcatcagtgacgagaccaaagaacgttccgtcaaaggatgactgctaatctcagtcaatctctgacccggccggtccaaacgaggccaacgaagctttccatgactgccgataccttgcgtaatactccgatagtactacaactacaactactgctcgatccctggagaagcttgtagattgaagtaggggaaaattagaagaggggaacaaaggatanccgcttgcttgggcaaaca

SEQ ID NO: 46606 - DNA, 199 bp, Oryza sativa
catcaagaaaccactatgcatggatactgcctccgctcagccatctactccgctaggtctatacccatacgagaagcgcggttgtacgggggtcgtttcatgcttaacttcatggctcggtccttaattgaccagggacggcactagccttttccggataccacccaaatcctccgtccgccccagttatagttggcca

SEQ ID NO: 46607 - DNA, 474 bp, Oryza sativa
agggggtccccttgcatagagagcatcgagtggttttctgcaccgatgaaacggtccaagtctgtgtccaatgttatagtttttggttgtaattagtacgatgtgagtacatagttatgtgtatgacgcggttcatgtgatgaaaaaagttgagagtttgtatcctaacacagcgtaaaccgtgttatagcataggaccattcgccatatagctatggcgtatacatatcatatatgtgtatgatttaacatttatatgttactaaattatagtagtgatattactcctaaattgtacctacaatagtagcattagtctataatatcatcatcgcgatcgtgtatatccatggcatgatgaagccagggattctcagctaaagaaattcttcaattagtagttgtgccaaagagagccttagcgagtagaaaatctactccctcgttccaagcatgttacccaggttttagaga

SEQ ID NO: 46608 - DNA, 503 bp, Oryza sativa
tcatctaaagcaagaaattgatttattcaaatattatacacgtaatcgtagatccaaatccatggatgtattgtggaccttgaaatactcagctccgtaaaattttggagctctgctaaagaggaccttagctctaagaaatcttgaatattgagttgtacaaagaggaccttacctctaagaaatcttgaattttgaattttggagctctgctaaggccgtgtttagtttcaaagtttttcttcaaacttccaacttttctatcacatcaaaactttcctacacacataaatttctaatttttccgtcacatcgtttcaatttcaaccaaacttctaattttggtgtacactaaacacagcttaaagaggaccttagttcatggcaccatttgatagggagaagggcaggagattaaatttgctaaaaggcccctgcaaaaactacaaataagtactagtcctactttattacaaggcgttctctcttccttccttctcagc

SEQ ID NO: 46609 - DNA, 1501 bp, Oryza sativa
ccggagaccttcagtgtgttagactgacgtgataaccaactacaccacgaaaccattgctgattgtgaattaaacaacataaattttgtcatatgctgagttttgtcaaaaaacttcctacaaaaatatatttttttctaaattttttcgttttaaaatcagtgtttgtcaatttgtaatgaacatccttaatctgatcatgggtttattttgattctcgaatagcacaaaagtttagaactacaaccatccccaaattctttagacaaactgtacactatctcagcaatccactactactgagaaaacttccgatagccttttttttttccttttgggatggggggttacgttctagttcgggacatggacagacagaatagcacaatcagcttattgactctgaaacaaactgaacacctttcatatttgagcggggcatatacagataacagagtccacttattgacaaataataacaagatgcacactacgtactgtccatcaatcacagaaaatcaaattcacacttaaaattttccattcaagaatagttgataacaaggagcttcaaagcattcaggccatcagcagcagcagcagcaacattcctccagcacgcagcagcagcaaagaatggccaacctaataaaaagaaaacagagattaagcaattttaagctaggaaccctactcacagcagtcttctcaatataaaatgcctcatctattaattatcattctgttaaaaccctttatcaaacataaaaaagtatcaacttaaacaggtacatttggttaaaagaaaactacacaggtatatcaaaaacgaattctggaaccttacaaatggcatcttttggtgcgcggaagtgattgatacaaaatgaatactcccaccgtcgcagaatatatgacggaacatgtatgacttgtttgtcttcttgggatgggtgaggtgtaggcccagactataatagggctaagggatagtagtggtagtccatatagtttagtggcaaaagctaccttttacatgtcatatgtttctagatttgggacaatgtttgaactctaaaattcactacgttttgggacggagggagtattagctaattgtatgtttcatgtatacattattattcctataatcatacaaaaatattcaccataccgggagagcagggcagagcctttttagggccaagcttggccatggcaagttgctaaataagtgattagttttaccatgtagattaatcaatggaatcaatgtaaatactaattggccttctcttctcaagttatctaagcatgtttattagatagccctttgcaacaacctgcaagctccaccaatgcaagagaggacatggagaagagttatcctgttcagtgggaagtcacggtgattcttctgaggtgggttttggaaggcggtttttatctagttggagggttagatggatgaatatccctcttaaaaaaatagagatagaga

SEQ ID NO: 46610 - DNA, 266 bp, Oryza sativa
gcgtgagtcgtcggatcagaggaaaccggatctgggatggcacgatttgagccggggattctttcttttgtgtggaatttaagtaggagtttttgtactgttattctagttgcatgttactctgttcagtgaatgaaaaccacagaaaattagccccacaaatttcctatctgctattgttttctgaaacttctcaatttcctgtgttcttgttctgctctgtattcctctgaatctcgttcgttgccgtgccggattgctgcagt

SEQ ID NO: 46611 - DNA, 1501 bp, Oryza sativa
atcatctgggtagatatctattcgattattcatgtcaactaaatagtaaaaaaaaaacggacaggataggttaatgtgtaaggagaaatatcaagtgttagaaatgtgaaaatcatgtctaaaagttttgaaaattcataaaaaatatgttttgtaagttcatttaaaataatatagataaatgtagatgtaaaataaattctcaccaaactcaacttcatttgagagaaaaaaacaaaattcaggtaaatagtgtcacgttactattcaaataaagttgagtttaaactttagatttgatttttgtgagttttcaaccctcaactcgttttctcttatgtgtccttagtgtgtaataaattagtacacaaacatgcaacttttaaattcaacttgtactaatatacatatattttaagttaattttgtcataatttataggatgagtctacgagtcaggcgcccgatcggtttggagaaaaatcgggcgctaccgtcaacacccgatttacgtgcaaaactactttaaactgatttttctcttaaattacttatccaaatcatgatccgattgcaccattaaattcgttgcaattaaatattcaaaacaagaccacacatggatatattccgacgaatttttttaagcttattattgaattattttaaaatgttgcacaatgttccgctatatatatcggaattgtttcactaagtagatcgaaaatgtttcactcgtttaaatcgggtgttgttttatcttatataaaaacaatgttccagtaaatagcgaaagaatatttcagttcactgcaacatttgatccatacatagtaaaatattataagtacactaggtgaaacatttttcggtggaaaaaaaataaaacgaattctcttaatatggggttttaaaaatatgtgggtttttttgttgcaatgcaatatttcacttcactgcaacattgggtttatatatagtgaaacagtacgaatacactaggtgaaacatttttttatgaaaaaaaacaaaccaaatttccttaatagatggtttccaaaatatgtaggtgatttgttttatatggataagtgacaggtggggacacgggatatgtggtgggaccaggtgggcacgtgatggggggaggggggagcgaccgatttttttcccctcccccgcgcgcccgacgttgagcattctcgcaatttatacaagttgaattttcaacctgtctgtctgtggaacgctatatttcgtattaatcatcttattaattttggtcaacttacaataaacgagtggattgttcatcaatccctctccggtgcacatgctatttagattccgacgtggacggtgcacgtccagtcgtccaccaccaccaccacgggtcggacgccgtcgtgcgtacatatccagacgcagacgccgacattggcgcaccaaacgcacacaccgcgcgcgtcggcggccatggccacgacgccgtctcctcctc

SEQ ID NO: 46612 - DNA, 1501 bp, Oryza sativa
ttaattttgagtaaattacactttgaccatcttttattacccaaattttactttggaccacctttaaacctatcttttcaatatggatcgggtaaatttagcattgttatggtttggattaccctgaacatcttttctcgccatatctaactttctttttggcaaatatatcgaccatgcatggatgagttaacccgtataccagagccgatgtgtttaaggtcattgatgtgtactgaaaaaatcgtttgggggtgatccaaactgcaaatttacctattttaaattgtaaagatagaaggtttaaaggtggccaaagtgaaacttagataataaaatgtggcccagaacgcaatttactcaattttttgccccaaaatgggccactggagacattcttgcccagcacggttgggctgaggcctagctgtaaccgctcacttgggccaactgctcaatattctcgtgatccccttgcgaaattcaaattttgatttctcctttccagaatttcttctccagcacggctccctaccggctataaaatgccggctcgcaacgcccacccatagccacgtcatccactcgcgtcgcgtctcaccaccgcgtcctctccgccattcccacacctcgacgcgatgaagaagaagagcggcgccgcctctctcggggaggccgagacctcgcgcgccgtcgtctcgcccgcgcgcgcctcctcctcctccgtcgccgacgcgcctgcgcacgcctccagcatcgccacgaagacctcctctgtcgccgcagtcgcgatggagatgagcgccgccgcctcgctcgcggtcgcgcccgcgcgcgcccccagcgtcgcgacgaagatccagactccggatgacgctcccccatgccgaccacctctgcctccgtcctctccgtcgcggtctccaccttcgcggacttcgagcccgtcttcttcagcaatgtcgagccgcacccgcacgcggtgaaggtgctcgccgttcgcgagctcaagcacgcgcccgcgctcctccaccttctcgagtccgcgtcgtccgaccatgggtgtaagatcgtcggcctccgcctcgtggagaacctgtccaagctcgacgccctcctcgccgtcgtgagcgagggtgtcatcccgctcctcctcaacgacctccgcgacccagacgccaaccgggagcttcgccgctgcgcccagagcatccaccgcgtcggccgcctcatcggaggctacgcgcgccgcaagtcgaaggcgctagcgctggttctccggcgacatgtcagccatgtcttcaagggaacccgcggcgatggttggctcctcaaaaacctgcaggccaccgttccctcccgcatcgccaccatgaggactcaccgcatcgacctcgcgcgcgcgcccccgcctgatcacctcgcgagatcacgccgcggccggtgatcgcctcatcgacgaggattgagtacgtcaccctgatccccatcgcccctgacc

SEQ ID NO: 46613 - DNA, 1501 bp, Oryza sativa
tgttgtaaaaaaaatcggacggataaatgtttcagttgaccgttggtgcaacattaagttatacatggtgaaacaaaaaatccagcctctaaaacatataaaaattctgtgaaacacaataaagtcatatggtgaaacatatttctatcacgtatgaaacattacgtttttattgtttgaaacacatgtttttctttcatcagaatataatcacgtgatatcttgttataaagatttaattataacgaattcaacggtgtgatcgaatcgctcatcaaataagtagtttggaagattctttttaagattactaaatagttgtatgcatgtatggtgtggggagaaagtcaataaaatggtacgagagagagagtggaggcatatgtgtctcatattttttcagcgcgaagcattgagttatacgtggtgaaacaaaaaaaaatcagttattgaaacatttaacttttctatgaaacacaatgaaaactcacgttgaaacatattgctactgcgtctgaaacattaaacttaacggactgaaacatacatttttctttcattggaatgtaatgatgtgatatcttgttataaagatttaattataacaaatataatggtgtgatcatatcacagattggataagtaaatcataagaaaaaattattttgaagatcattataatatgtatggatgtatggagtggatagggaggtagtagtttgcccgtctaatttttgtttgttgcgtcagacgtctaataggaagcatttccggagaaagacgggaggggagatgggtgaagggagataagaggcgagagagtgaggaggcaccatgtggattccattgatattttttttgcttctattgttatgtaagtgcacataaacgtcacatggaattaaaatcaagtcagcaagccatgtagatgtcgtgctagccgaaaccgctgttaatagtatcgagtgacttaatttgtatcctttttagaagttgaattgttgaaacgtaatttttacctgattctacggttcagggacgccaacgaacgaaacttgacccgtcgttgggttacgtggactttctcctattttgaaattttcatgttgagttgtctacacactggcccgactgaattgtcgtcaatgcctaagccgcagtaaagtactactactagtttactactgcagtgtaccggcgtgcggtgcggagcgcggccacgtccgccgccgcctcgcctcggcgaggagccaagccgccggtcaaacaaaggctactgccaatgcgatccgatcccatggcctctctccatctatctctcgatggtagactagttcgatccgccgctgccataagtacggccgcgcctggcagctactgtcgcaaattgcccccgattccctcttctcagtcgcagaacggtacccctcgtacgaaaacgaggctcagtcggttaggaatttctgtaaccggtttcacctctgggcaagggccatggcca

SEQ ID NO: 46614 - DNA, 1501 bp, Oryza sativa
  unsure (1)..(1501): unsure at all n locations
acatatatttgacgtttaggataagatttggtcgaacttttgaaactttgataatcaattttatatcataacaagtttataaaatctaatgatattataatattatgatagtacttttgaaggcaaaactaagcatttgagaaattattcatggccaaagttccagaagcttgaccaacccttgttctaaacgccaaatatttgtcagcagaggaagtacgttgtaaaggagaaaaataaagaggcagtgtctcagcatttttccccactcccaaatgtccagctgtctaagaacagtttatagtcatggccctgncaatgcctgtgtatgctttgcagggatgcaggttgcaggcttgcagttggccttactcaaggctatgcgaaatgtgcaggtgggtttgagtcttttgaccaaatcaatatatggtccaagttcacaagcatgcgagcatgtactgtggcatttggatggaaggcaacccacggatcatactttgtccgcagtaatgacagccaagcagtcagctccattcgtctgaatgaatctttcagaacaaatgtgcagactgaaaatcttttggaagtgagccagggagagacaaacatcataaatagatcctaataaagatgccttctactgtatatgcactacgcaaatgactaatggggaattttggggtattatattagcatgaacaaatgaattagcttctacagtagtgtttaacatatgctcattgttcaacatggttcagaaatttcattctttaaaattatactttatcatttaaattaagtaccaaatgtatgttccaaaatcctagcgaggagttccaattataggactacacaagctacggtaacccaaattctaaatatgaacctatctgaaaacactagcattagatatgcttaaattagtaacattcaaaaatcaaaaccaatcgggatcgagatcataatgtattgggtcaactgaagtgctgttgattaatattatcaggtacaattatatcctgggcacctgtaatctgattccagcaaatagtttcttattgacaatgcacttgtaatcctactgtcctagaaatttcatccttctccagttgacactgacttcagaagtcatttaaataatcaaacctaatcccaggagatacgtaagattatttgttttcatcaacccaatcatcagaaaagacaactaaacgagaagacatcgcctagtgctgtaatgctcacaaaaaattgcaagcttgaccagctttcacgagttcatcaccaatgccataaagacatcgcctttattccctcaccagcaaaacgccacatctattctagaccttacagaattctaatttctaaagaaccagcatccaaagtaaattcatccatcaacctagatcactaaagatggaaatcataaattgcatttgcatgtatcaatcgaaatctgagcaaaaatggagtaaaattttccagatatttttcaggctta

SEQ ID NO: 46615 - DNA, 387 bp, Oryza sativa
tattattattattattattattattattattattattatcttcttgataagtgtggagattatggataccccatatctacatgacggttgtaatttagtcggatatacagtaccaaatatagatggaatatctctatgaagactcgggttaggttctaaacttgtatgtcaaggaaatacccgggatcttagtcggttacgattgtattttatctataattccatattccgttaggatatggactgtattttgtaaagcggactccttcccctatataaggagggtccgtgtgcctcttggggggcgattcttttttccagtttatacaatcaataacatactcggcggaatcatccccggacaggagtagtgtattactttttgaa

SEQ ID NO: 46616 - DNA, 360 bp, Oryza sativa
ccggttctcctcatctgtgacagatcacaactacgtacaatttgatagtgtggagtacaatatcatctgcaatactttacatcaccaaatcgtcttaatattttttttcaagctaagttcagcagttctttcgagattacaggcctccttttgaacgaagaaattttgcgaaaattctacaaaaattgaactaatccatgtgaaagtcctactgaaattcccacgttttaaaggagtactggacatcctctcacgttctgacgtgtttctagtattctaccgattgccatttctaaccgataagagtacagcctcctaatagcattgacctctaacttgtgcacttctgactgaaaaaaa

SEQ ID NO: 46617 - DNA, 317 bp, Oryza sativa
tagttgccagaagttaaaaggctgctaatactccacatcaatagagcaaagacgaggaggacacctatccgcatggccaatctagaagagccactgcacatatacccactcaggagccttgaccatccttgttagtcgtcagatttgcctatgtcgtcgaatgtgttttcctgacacatcccatttctgaggccaaaacgttttttttttaagagagagagagtgagaaagcaagaccactactgaattgtaatgtgttattttctgtagcgaccatgtccaaagaggagcagcgtgggctacagggaagtgggaat

SEQ ID NO: 46618 - DNA, 1501 bp, Oryza sativa
aggtaaatttgcagtttggatcacccccaaacgattttttcagtacacatcaatgaccttaaacacatcggctctggtatacgggttaactcatccatgcatggtcgatatatttgccaaaaagaaagttagatatggcgagaaaagatgttcagggtaatccaaaccataacaatgctaaatttacccgatccatattgaaaagataggtttaaaggtggtccaaagtaaaatttgggtaataaaagatggtcaaagtgtaatttactcaaaattaagcgtgggcttctatagggggctcgtgggccgggccttggctatttgcaacctctgcggtctgtacgagttcggtatcttccttctcgtctcgcctctccagccgcgacggcgccggcctccgccgcgccgcattcttcctcctccggcggcggcgcagaccgaagccgagatcgcgcgcgggtggatgccctggatctctaccccctccccgacctcgcgcctcgatcttcgtaggtaggagaggggcagggaggagagaggtgggccgcctcggggtgctctcgatttcctcggctcgatcccgcgtatgccgccatggccctgctcgcgctgaaccggctcatctccatccggcgggagcgccgtcgccggcgaaacaaagcccgcagtaagcgctttcccctcggcctctctgcacttcatctctccggtgcgttgtgtgtgatgtgctgctcggactttttttgggagattgcggccagtatttttccagaatggaaaattggattggtttggtgaattgtttctctaaaattggaagaatttggtttggtgaattcatcagcattctcgcgcaaaagttggataaggaaacattttggatttctatatgactcgtttgtgaggttgaatctgttgttctcttctgttaatgtctgaaattatctattacaatgcatgatatgcagaaggaggatcaattactaaatcggtgagaaggaagtactcaccctgccaacaagatgattcccagggtggtaaaatgatgacaaattcaggggtaactcttccagaggtactgcactgcatacactgttttttttaaaaaaaaaaatctatgaattaattggaacatttcaaaatactactatgcattccattcttaagtatgtgcccttgctagtgtccttttaagactctaaagaggaccagagacctacctaaactatattaaactaccaacactgttaaaggaaaacagctctacgcaatgcttaatttatgcgccattctaatgcacaacatgcctatctaatgcaacgcaccttgagaaatcatgtgcagtactcctggggttgaaaaaaaatgatacgccatatggttctattcatgtttctctctaatcaaagtagccatttaggtttataattgcaatgttgaaatgttatcccatgatggtgtctgcaggacatctggagttatatactttccctgatgccaa

SEQ ID NO: 46619 - DNA, 270 bp, Oryza sativa
cgtcttaatattttttttcaagctaagttcagcagttctttcgagattacaggcctccttttgaacgaagaaattttgcgaaaattctacaaaaattgaactaatccatgtgaaagtcctactgaaattcccacgttttaaaggagtactggacatcctctcacgttctgacgtgtttctagtattctaccgattgccatttctaaccgataagagtacagcctcctaatagcattgacctctaacttgtgcacttctgactgaaaaaaa

SEQ ID NO: 46620 - DNA, 1501 bp, Oryza sativa
agtactcatatgtagtactgtacaatatatgacactgcacaacgacctacatgtgagggcacttgtcataccagccaaagaaggcctaccagagctagctacagtgtcatttgccagggccctcggtgaaatgtatttcccgatgacttccaatttaatgggaaaaggggagccccggttggcaatgattaaggccatgttcggtttagaggggattgagggggaataattccacaccacaataaatcccctccaattcctccctcgtaaggattaaccaaataaggactaaatgtttttcgctgggagcaatcaataaatgttatccggataaatatatattaagtaatataatgatgaatagatatgttaaaatattatggaaatgatgtaaggtgtgataatcacatatgctttgcatgttgatttgtagaattcaatgaattgtaaataatgttgaatacttgtatgagtttttatatgtaattattgttagtgaatgatgagctagtatatttgtatgttgagttttaaacttagtgggttataactatatagaatgtatagatgtcttagttttgacatgtggaatatgggctcgagtgttattgagagaacgagggataaataagggaatgagcacttttggggggtaaataggcattttatccacagcaatcctcatgttacaagacaggtatgaaaggttactcctaccctttgtttatttaaatcaatgttgatgatgtagcacttttgaattcatggttgttatactttttcaccttttagaaaaaaagctaatataattcatggttggtttttaattatatttccctccttaaaaaagagctccaatttgcttgtgaaaacaaagtgtttggtatgtttgcccaaaccaaccatagcaaatttctggaaggtagcaatccaaacaaaccctaagtaccccactataccaaaaatgtaatacgaggtaccacatcttggaaggcatcaaaccaaaaatactatcacatccgcattcacatacctctaccatacaagttccttttttgtcacaattcagaattacatttttgctgacgcaacaacaaaatagaggaattacataatttgatttatcatgattgatttgggtaacataccaaacaccaaacagttcaaggccctatttgaagagtttctatcacctcccgcttctcccagagcttttcgtccagattctaagaatctatagttgtagactaaaaaaatgaactgaaaattagaagttgaaaaacctatttttttttcattatcaaaaactggttaccaaccaattatttcttacaatcttaacattccccagagaggctcctgtaattttgaactttaggaggcaaaatactagcgaaatagtgaatcggcccatcatttggtctgggccgagtaagcctcgaagagcccaaagcccaaacggcccaaaactcgagcctgataaaaccacctcctaatccat

SEQ ID NO: 46621 - DNA, 1501 bp, Oryza sativa
aagcatcaagcacacgcatgtcattttcgatggagagcatgccactttatgacgaagcatgctctccaatccatggcagttgcaggcttgcaaagggggaccgtttggttgtcactgaaagcctgaaaggttcttggattgaatgcagagaatggaaatgatgccattgacatatataatcctgatatttagtagtagtactacgagagacacgagtgtaggtcagacagattaaggcgtcaagctagatgcaattatgtctgtcgatctccgtataaccgtattgattaattcttgcatcgaatatgtatatgtatagctgaaacttcatggagttaattgctagctgattccaacgataagtatttgccctgataagtattgtgtctgaatatgcatagatctgacgaacatatgtccttcaaaagtaccatgatttattggtgatctgttcggtgttgcaagaatttatgttcttcaggtacaggaagacttatggcactttcaggagaagggcaggcaatgctgcaattgcgaaggagctgccatgtcaggttgatcaatcttggcgaaacaaattcttcattgcaatgtagtactcctcgttttgaatgcgattatactacagtacacatgcatctactcacttgcagttgcagattgtaatgtcgcttgattgatcaggagctagttgtgtttggcattcttaatttctgatcagtgtggaaaaagttcagtgttaggttctgaatatttagctggcaatggacgaacaggcgtatgcacatgacatgacggatgttttggccatgataaattgataatcctatccagacaagtccaatcagatccaatgtggcatctgttccaatcgctgcactaaagtttatctgatttgaggttggattccttgacttttttgaagccaagggaccctacggcctgcgtaagtacaaggatcatatgggtggctgcatgatgaaaatatctttagtgaaatctaatccatagagagatgcaaagttggcaatattttagttcaaaaaaactttggaagattctgaaatgagtatgccacacttggcaatatttagtcaaaaaactttggaatattctgaaacaggtatacacacatggcagtatttggttaaagaaactttggaacattctgaaaacaagtgttttcaatgggtgttttcaatggacagcaatccagccagagatgcaaaagttgaggaatcactggagttgagtgctagacatatgggcaataattactgaaaacagtataatttacatgattctgaaagactgaaacaaacatactcatactagtgaactgtaattcagagtttcagacagtgggagatagataaacagcactctacaaattttcagccaaacagaaggaactagaacttagcaagaatctgaaactgaaggataagctagacagcccatctcatgaatgagacccaatgcagaaactaaccatccatca

SEQ ID NO: 46622 - DNA, 367 bp, Oryza sativa
cagtagttcatcagaaggagggagtactatttttgtgaatataaacagatgtcaatattttaattgcatcggaatggtgttcaataaatacctgctgtagctgattaagattgttggcgtggtaaggagcataggagccatcaaccgacataccgactagagcaaagaaatcattgaagaagattatagtattttctcaactctgtaagaatggatctcatccccaggatcagacgtggttgcatgactaatcatggtattccaatcttcattcttcatgccagtaagctggttgcaagaagatgtgagtttcttagcacgtgaatatatatagcattactagcaattttcctttcaggagcaaaca

SEQ ID NO: 46623 - DNA, 1501 bp, Oryza sativa
gctcatttttggattctgtagcaaaagtcaagtatagtagaatatgcaacatcactggaatctgcagcatatacacaatttttcacagagtacaatgatgttttctctgctctttttttggatcatgtagcacaaatctagtagtagaataatggaacaacatcactggaatctgatggccccatgcaaagaagcagctgtggtgtaaaggcaggaaatggacaagaatcgtcctaggactaaggcttagcagcatgaatgcatgatggatggttcagaaagggggccattcatggacagattgccagtgcgaataaatagggcttataaaaggaatccaaagttcaaaagaccccgtttagttcagctgcagattataatccaaaaagaatttgatttttaaaaataatcttaggtagattttctaatagtataatgtagtacggtgtaccataaagggattcttatagagcaaccaaagtgatgaatcatgaagaaaacccctaaaattgagtatgaatttaaattataaaattcctttcaggttataatctgcggcagaacaaaggagagagtaaaactatatctctaattactgggaaaaaactgcaaaaaaaaagcacagttgcagacaatatgcagtgtctctatcaactatcacaacaagatgattgttactcaccataaacaaaaaaagtcggttgtcaattgtcattcattcagtcatcactcactcactacgaacgagtgaagtgaagatagcctggcactcttgattaatatccatttgctgaaccctgtgcctgaaaacgcaccgaaaattctgaaaactgtagcctcgtgacatcgtgccgacattctactgaatttacgctaaaaacaccgcacaaatcggcaggaaaaatactctcttttcttccttgtagtacacttgcgtcgaagtctccaagcacaaaatctcgcaaacagtggccgaactctgaaacggcaagcagcagcagcggcctgtactgaatatgtgctcatgctgcccatcaaagatgctaaaaatgagcagcaaattagagactggaccatgctgatgatcccctcaccaaccagccactacctgctgcctcattgctggacgaatcaagagccatgtgattcagtgattgatcacacaaacatacatacacactctgcagaagtagtaaatgtcagtggttgatgagcctcactgaaatgcagagtcagggcctgaatctgcacaagtttctgtagacagaaagatatggttttatctattaaaagattgtgatgattcagatttcagaaataaaagtagaagtgtagaagtgaagttctttcttgcttgcagctgagcttagcttcatgatgtggattggattggattggattccatcagcaacagcatgttgatatggcttacatcatcaggtggaacaagaacagaacaagtgatgacactgtaaaagaaaagaacaagaaaaaaaagaga

SEQ ID NO: 46624 - DNA, 1501 bp, Oryza sativa
tgtgtacgaaaaatggagttggccgtacctaagacatcgaatttccgatggacttgactggataatatctgtgcccaacgtttgatcgtacatcttatttgaaaactttgtgaaaaatttaaaaatatttagtcacacataaagtactatttatgttttaacatctaatagcaataaaaaatactaatcatacaaaatttttaaataagacgaacgatcaaacgttgaacatgaatagtgcaaaactgcatttattttgggacggagggagtacatacttaaggctgtgctcgttctagctgttcccaagtcctccgtctcgttttccgcgcaacgctttccaaactgctaaacggtacagtttttttgtaaaaaaaagtttatatattgaaagatgtttttttaaaaaatcatattaataatttttttaaaaataaatgtttaattaattataagaaaataggtcgctctatttttcgtgcggagggaatgctatcccaacttaggagaacgaacgcagacaggccctctatgagcatggcccattagaggcttcacttgaagctcggcccattagtttcacaaagccgtcaaagcccacgtcgttcccaagcatatgccctaatcggctttaatcccctgcagaaagaatccgccgccgccgccttctcctcttcctcctgctgctgctggctcccaacttgctctccgggctgaggctgcggctgctgctcccccgcctgcgcgccgccgccgccgccgccgccgtcgtcaggtaccgaccggccgatcgatcccatcccccgcgcctccccctttgcagagctgctgctcggaaatttgttttctcgttgatgctatgcaatttgctgtgcggtttgtgctctgctccttgtgtagacgggtcggggaggggtctggatgggtgggtgggttagcacatcagtgttggggattttagtttttatcatgccgttttagttgatagggggtggattgattattttccgtattggttcgtgtggctttgggcagagtgctcattactcaatgtggttcgtcgtttttccgataagatttttagttaatcgtcgtagctgatcaagagtggaagtttagtgtatgttgattctctgcttatgtcactgggttgcgttatattgttggggatctacttcctcgtgtagttttacatgagcatttctagggaaaaaacccccctaaaattttccttttgttatggtgagccgttggtaggaagtgtatttttcacactttatttcctggaggtggatttcttctttccatcatttgtctgccttggtattatgtggaattgtggatatgctgtagtatccataggatgcatgatccacctagtctttaggtttatggaacacttgagttagtgtgaattttcttctcttcaagctattaagtgtgtaaattaactaattctttctgatctttctccccccccttcgcttcttgaagatgtttg

SEQ ID NO: 46625 - DNA, 836 bp, Oryza sativa
aatgctagaatgacttacattgtaaaacggagggagtagtaactgaatttcagttttgcctggcaattttgatatgtaagtactcctgtcaggtgtcaacaatctatgctcttcttctgaatttttttgactgatacatgttcagctacacaagaaatcaagccacaaccttttcttccgtataacagtatgaaagagttgctaattcagtacttcagttggctaaagatgggtgacgcctaatgctttttttccatgagaaaatcgtaagatacatttatttctttttaataaatctgaagatttgtccatacaagtatgtttaagactgcaaaaaaaagaagaagaagaatgcgatcgctatctgtacgtgcaaatgaggacattattcttcctcgcttccctttcgtattcggctacctttcacttcattttcatgtacattttcgtccttttccttccctttgattgcttttcggagttcattacatcacgaaaacggcgtgattgggaaatggtcggatgctcaacaacgcggcagtagtagttggctaagatactcgaagtagcgtgtagtaacttatgttcactttggtctaataatttaaaggtagttaatggtcaacgagaaagtaaaaaatgtcaattattaagaaacggatggagtatttcctcaagaacaaaatggcattgatatttactcctgtaaatcaccatcaagtactctaactactcattgattttgtagaagaagctattgaaaatgttgaacgagatgcatactgattactgagcaactgttaacagatgccacttttaaagttcagactaatcca

SEQ ID NO: 46626 - DNA, 1501 bp, Oryza sativa
cctcgaagaagacgtgctgtacattctcgcggcttccgcgctccggtcgatcgccagcctcgtgatcaccacctgccggctccacctcgccgccgttgtcgtcgccgccgccgatgattcttcctccaacgtccacaccgagatcagctcgcgctccgccacgaccaggctcaacgccgtgccgccccgcgacgcggcgagcatgagctgatggctgtccttcctgcagcccagcatcttgtcggcggagcccggcggtagctccatcgtcgcggcgcacgccgcgtcgacgcgcagggagaagatgaccacgccgtgggcttggagctcccagtaccgctccgtgccggcgagccagtgcacggcgcgcccgacgacggccgggaacgtggtgaaacggcatcgggatggagggcttccggtggccggcgtccatgcggatcgtacgggcggcgccccatccgccgccgccgtccttggacgagaatgtgaatgtctgtgtgtgcagctcgttgtccgcgacgagcagctcgaacgagcggccggcgtcgccgacgtcgagcaacgccggcgggtagatcaaccttctcttgactttcatggcaggatccatggcagggagagaggtgacgtcgccggtgatggtgttgcagacgcacatgttgaaacggtcggggccggcgtagacgtagtcctcgaggacgacgacgaggccgtcgcgcgacaccatgggctcgaaagtgttgaggataccggcgtcgaagcgggggagaggcgaggacgatggtgacgacgcggcctgtgttacgcccacaaaggtgttaagatcacagcggaacctgtaggagacgccgcggaggagactggtcgcggcgttgttgtgccggcggcagaattcctcctccaggatgcggccgcggagcgacttgcaggtggcggcgcaacgaactatggacacaatgtctgagcgtacggcgatctcaggcatgagatcgtccgggaggatcgtcgacgccatccgtgtgatcgagcgtggtacacgattgctgatcgactgcaggctgacaggttacctgtttgtactagtagtgattattaggaaaagagtttgaaggtaacaaatataaagaagtctatgggcctgtttagatcctagcaaaaatttttcccttaagattaattctactcgaagcagaataattcaagtatattgcaccagagcatctctcttagacatatgcatgaaacattaaatctctatctctactattataaaaattgaaaattgaagatgtttttgccggtattttggtacatcattcgtgtatgaatcggtttttaagttcgttcgcttttggaaatacaaatccgtatttgtgtcgatttttaagtttattcttttttggaaatatagaaggaatctataagaaatctctttaagaaaaactcgcatactaacttaaaacaatcaaacttttagttgcagctcattattttctaa

SEQ ID NO: 46627 - DNA, 1501 bp, Oryza sativa
agccgggttgcacacggcgtacgcgtcgtcggcgggggagaagcagcaggcgaccccgcgcgacgacgacagcacgacgagctccgacgaggccggcacgaacgagagcgacggggacggcacggcgtcgtcgtcgccgtcgaaggggaggaaccccgctgatgggacgaacaccccggagacccgcctcggggcggccgcgtgcgcgacggcgaagagcggggacgacatgtggctcgcccacgacgggtgcacgacgcggaggcgcgccgccgccgccggcgggaggtgcacgagcgagttctccctgaccacgtcggcgagcggcaccccgacgaatcgctcgaccgccgcagcccgctcccgccgccgccgctgccgcgacgcctcgcgggactctgcttcgccggacatggcctcctcgacccgctcggacgctggtggtcgtgggggaagtggacggcttgatgtgggaattgcacggtggtttcgtggtatcgttgtcgtcgtggtcgtcgtcgtggtcgaggcgtgtaagctatcgatgggttcgcgagtgggggcacggccggtgcgcgacttcgtcgtccacgcccgcttgactcgtgcgagaggtcaatctctaaacctgcacgtacgtactacgtaaattccggtgtgttttaggttgatgaagcgccggtttgcgcggccggcccggcactgagccacccgtgattttagatgtaaacagcgataaattttggaaatttaggtgatcgatatatacgatacgtgcaccgtctggtttctttattcacgaaattatctcataaggaaacagccgttcgagagtatctcgcatcgcacacggccgctagataaatccccgatctcgtgtaataatggtataggctgtgtttagatctatgtgaaaagatttggtgtgccatatctgatttacggacacacatttgaagtattatatgtagactaacaacaaaacaaattacagatttctcctgtaaactgcgagatgaatttattaagcttaattaatccatcattagcaaattaatgtttacttagcgcctcattgttagatcatgaagcaattaggctttaaaaattcgtctcgtaatttacacgtaatctgtataattagttttttttgctatactagaaaaaaaatatccgtgcgttgcgacaggtaaagactatttcaatcttattattattgttatatgagttagttagggtgaattcactctgttaaattcgcttggatatatattttgttagaaaataatgagctgcaactaaaagtttgattgttttaagttagtatgcgagtttttcttaaagagatttcttatagattccttctatatttccaaaaaagaataaacttaaaaatcgacacaaatacggatttgtatttccaaaagcgaacgaacttaaaaaccgattcatacacgaatgatgtaccaaaataccggcaaaaacatcttcaattttcaat

SEQ ID NO: 46628 - DNA, 1501 bp, Oryza sativa
acaaagagacttacttttggatcctatactagactttcagtaatttagcagtgcagtaaagaattcgtaccatatatagttatccttctattttatgatttctaactcactttcatattataagtcctgttgatatttttcttaatcaagttttttttaagttcgagcaagttttaaaaagaattagcaatatctaccgcactaaattagtttcattaaaactaacgtttaatttattttaataatatgcttgttttgggttgagaatgtttctatattattctataaactttgtcaaactttttagaaaaaaaatcaaaacagtttttaatacgaaacggttgctactctctccgttccatattacatacaagtcgttaggactttttcttcaaactaagtcaaattttgatcgaagttatagaaaaattaatatcgtaacattttaaaccctaaataaatatactatcaaaatatatttaatggtacattaaatttactagtttggtgttataaaagttattatatttttatataaacttgatcaaaatttgatcaagaaaaaaatcaagtgttttgtaatacgaaacgaaaaaggtgttaatctgttttcctattcaccaaatccgcgatttataccaactgacaaaaaaaacaaccattctctatgaagtatcgcgtcacggccgggaaagcaattcccgagcttgttaccttcacgactcatttaatttcctcatactaatacaaatgcgtcatataaaacggctggatttccatcttcttctttgtttcttcaccatcaacaattgtgtcttctggtgaaggaccatccacctgaaatactccctccgttttttaataaatgacgccgttaactttttctcacatgtttgaccattcgtcttattaaaaaaatttacgtaattataatttattttgttatgagttgttttatcactcacaatactttaagtgtgatttatatcttatacatttgaaaaaaaattttgaataagacgaatggtcaaacatgtgagaaaaagtcaacaacgtcatctattaaaaaacggaggtagtacaatcttgtcgcaatggttcactgggctgctgtagccgtgggttatgcttcaacaactcccggatttgtcacaaacatcgccggcgttgctccgagagacaggttgatcaatctgatctaacactaatattgataaagtagctaattgatgcggcctcctaagaaaattataggattgatctcatctctccggggatgtatcaagcaacgttagtctaaggctctaatatatctatctctactattataaaaattaaaaatgtttttaccggtactttggtacgtcatctgtgtatgagtcggtttttaagttcattcgcatttagaaatacagaaagaatcgtataagaaaccttttgaaaaaactcgcatgctaatttgagaggatcatatttctaattaaaacttatgattttctag

SEQ ID NO: 46629 - DNA, 1501 bp, Oryza sativa
cggtatctttagtggcgattgatgagtgtaaccggtaacgtcagaaatgacggtcggtgcgtcgtcattggcgagctggcttcgatagccatggtagtggcaagatccgacaagtgactgttttacacttcaattactcttcagtgatatttttcgctttggcttgacatcaatcatcggcgctgatgtgcacaaaaattgatttgaataatgatcggacgctgattttgagattctatattccgttttgtaatttgatttatatcgacggtgttatctatttctttagactaatgttctagctagttttcttattagctatcaagttatgatttgtaatccgcggatgcccgatctataaattctataataattaagtttagcttctttaaatgcttcggtccaacgaaaaatatctcgaggtaccgatatctcacggtaccaaatcgttttcgatcgttagatctaacaatatctatcctgtctagttagattcaatgattgaaaatgatttgacaccatgaggtaccgatatctcgagatactttttgcagtactggagtatatctcttattaaacaaactaattgtctcaaaatcctcacgaggaagaggaatccgacgttatggcccgtgagaaagatggcatcaatgcgcaccccccgcatcgcctcatgggctcccctcccctctcgctacacccccggaagcaccgacccatcgacccccagcacgtcacatgcgctttgacaacgatctgagatcgatcgatgtgccgccgcccgccggcggccgcaaccgcttgccggcgacaaaaaaaaccggcgatccccttttgaccttgccagtctccacatgtgcaggcaagtccgtgtgtgtgtataaactagttcagcacggaacgaactcacagcacagcacaatgtgtcattctgcctgctttttttagaatgatattttttatccggtctctacatccaaccatatatatatatatacaactcttttaaattgaaaacttaatctctcaaacaacctaatctaaaaattcactcatatgaagatttgaactcagaatcataagatgctacttagtcagtgcaaaattactatattttgatcaaagttaaaacgtctttgtaatctggaacggagggagtagaatatatgtgtcattctgcctgcctagcttgctagctccactgccgtgcggtgcatgcgaggtcggaccactcccactaccgcgtttcgcccaagttgcgacgagccgaacgaccaaacacaaacgctggatgctgcgattctaccgaattttcgcctgctttctcccgtgcgatctcacccgaattcctctctctctcgtctcgtccccgtttttttttacccgtctccacgaaccaaaaagaattcgaaaccaaaaaaaaaaaaaaaccgcagcgcgcgtcctctctctttataaccttcaagtgttcgtccactccctcctcagctagcagcagctc

SEQ ID NO: 46630 - DNA, 1501 bp, Oryza sativa
gtacagatctctagtcttaaaataagacatcactgaaaaactttacctctgagcaatggactgagcaactgttggacagctactttccaattcactcgtgttgaagtacaaaataagcagcagccttctcaatccaaaaggatataacaataacatggagttctgccgcctcagaagatgataagatagaaagcacctttctgtaaattaaataaattgtacactcaaatggaattaacttggtacagaaagaacggtggaactattcaaatactggttaatatcacaatattaatcgttttagaagaattaaatgaatatagagataacacatgtcactacagaaaaaaggcatcgttatcaaaaatagtggaacaataaagccaccatgtaagtctgaacatcagaacaggacagaatcatggaactaaaatgtccctaaagttgccgtagaacaattctagaatgttatcgtggcaaaatacagtgactatacggatcggggcagaaatttgcatcatattggggagaacatcagtataccagagaactggaaacatccagtctgtcctaatataactattagctggacattttattttattgtagcacaaaaagaactctgtactgaaacttacaatcaaacatgaagttatggtggtcacttgatgttaaattgttgatatgataatagtttttttttccttccatttcgtgagtgaaatacaagcagaaacatctaatgcaatgcaatctctgtataataacttcaaaagcttccacttacctggttttcagcaagcagatactacctccgtcctatataatataggaatataatataggaaggaggtagtatgattaaccattcatgttttgagctgggccacgatctgaagtatctgagagaagcttaaaattttcaaatttccaaactactgggaactaattcacagataatgaattaaacaagatattttcagggatcttcatgatcacaaggctgaaattagcgacttaaaaactgagtgcactgcaaataaatgacaactgatcaataaaggaagaacaatctgtacggaaccaacctgcaatcacactttcagaggtggaaactttagtgcgattttcaaatatatccagttagaactgagtagattggaaaatatccaatgtcaagttgtcgactaatattttatcagcctgtaatgaacaaaaaatcacatataaatatgttacctcatttagggaaagaacacactaccccccaaaagtcagatgcagcaactcgcaacttcttatattagacaagtacaacactaatagctagtggttttaagcatatagtacagtatattgaacaattgataactggaaaaaaaatgcatatcaactcttacacttggttccatgatgctatagagtcttcaacagagacatcagtgtgaagtgtaaacaacttgtcacctcttcagagtggaacacaatacatgatatgcta

SEQ ID NO: 46631 - DNA, 425 bp, Oryza sativa
tagcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaagaattggtaacttatatcaattagtcctaattgatggatggttgatggttgtgtagtggaggatggttcatgg

SEQ ID NO: 46632 - DNA, 1501 bp, Oryza sativa
tcagtgaggagctactccgattgcaggagagtgcatttagtgatgatgagagaacgagaaatctcatcagcaaagttaaccacattttacaaaatcactcaggcattggcgtgaagaaactagagcttgttttcttggatagtactgatgtggacttaagttatattgacagttggcttcacaaggctgtcacacgagggattgaagaactcaccctgatactgcctataaacagcaatgcagaatacagcttcccatgttcgcttttatctgatggtaatggtaactcgattcagtatcttcatctctctcgctgtgccatccgccccactgctgatcttggttgcctgagaacattgacaacgttgcatctatattccgtgcgaatcactgggtttgagctagagtaccttctttccaattcacccgcattggagtggttgataatgatggattgtaaagagatagttcagttgaagataccaagttgctgaagcggctccatactctttttgtgagtagatgtcaaatgctgaaagtggtagagagctatgctccaaatatcgccacctttcacttccggggtcatgttcatgcagtgcgaatgttgggtttactgcaagtaaaagaccttgagatgtcatgttcagatcactctagcattctctgctatgctctcaccaatcttttgtctattgtcccaaatgttgaaaaacttagaatatcatcacaaacacaggtaaactctgaagcattacataattatagagtagcaattgtacataaaattgtagacatctattaaaaaattacataaaactgtagacatccattaaaataaaataatacgagacatctttatgcagattgtcagtacacaaactgtaccagggaaatatcttcgcctcaagcacttgcatatatctcttaacaggtccccaaactttgattatctttctcttgtttcttttctcgatgcctctccttcactcgagactttcatcttgcatgtaagtaactagtttcatcttgtaaagacaagtagtatatatcatccataaatataaccatcttttgaagtgttctctctgttttacaattaattttgatcctatatgtgcagatatgggacatatacataccactgggtcatatggggcatccttggactcttggagactctgaacagctgaggcagatgccaggacaccgccatgacagtctcaagaaattcgaggtcgtcggttcctgctacgcgaagggcttggtcgagctaacatgtcatatccttgagacgacatcgtcgctcgatcgtattaaactcgacacctgtggttatgttgggctttgtgcttccggcagtggcagatgttacccacattatacagaacaaatcatggaggcctgtaattcagtcttggctatcaggacatacatcatggggaaagttccacctacagtgaagtttgaacttgttgagccttgcagccgttgccctgta

SEQ ID NO: 46633 - DNA, 1501 bp, Oryza sativa
  unsure (1)..(1501): unsure at all n locations
tgatgtgtggtgaagggtaggtaatttgtaggagtagagttttttttttataaataatgtgtagtatttgagtaatgtacttatttattggaaaaattagacatgttgttagcttttgaagtattggtattgcaatggtaattacatattattttcaagtaattaatgtttatgcatgggtttaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagaatcacccattagctgtcacgaactgtcggagaggtgtagtaggaaggaagaattgattgaggaagacgtggaggggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatggtaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaagatgtcagagcatgaaaggactgtgtttgcgaaactggtgggtagaaaccccgaaataacacaattcgaggatcttaccagatctgggctagcaattgctgatggggatccacaatatgacggngcctttcgaccaatgtgtgatgaaccaaagaaggggttggagtttcgatcgatggatgatctgaaaatatggctacagagttattctatccgtgtccaccggccgtaccatgtgaaggaatctaatgcgtcagtaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcag

SEQ ID NO: 46634 - DNA, 1501 bp, Oryza sativa
cacacacatttgttttattgaaatgtatgtttcatcgcactagtttgtgacagtgcattaatctatctggtagtgtatattttctgcaatctcaatattgataactttttttttctcgaaaacgtaggagaactacacttcatttcattaagaagaaacaaaaaaggaaaataattacaaaggagagtaacaaaactgtcctccccacagaacacacgtgcgtgcgcgcacacacgcacacacacaacatacacacacacaacacacacacacacacacacacacacacacacacacacacacccctaaaaggtgatacacaaggccattatgtgtccattgattaacttgatctatgcccattatgtccaaagaggagttggactgttttggtgatcatttataattggctgcacatggaagcatttttttgagtacttggatcaatttcatgaaataattatagccttttgagggcttctctgaatacatcctatgtagaactttaccatcatacattgctgaagaagtaaacaaataaaaattcattgcagttcctagatttcgttggttgaaacaatgtcagttttgtgtgataatgttttactgcttcattaatctattacctcttgaagctcatagggtattgagtccatttagttgtgaaaaatatccacatgatgtatcatagctatcctttattcataccagtcaatgccattctatagtacaccgctatgtttacttaaaaccacatactaagaggtagaaaggttggttagacaagcatatgtcactaaaatatgtgcctagtttttgcacactttgattatttctcatttttagtgtcaatgtgcattgtcacagtttgagtctaccaaacctttgcatgtaatgtgccttgtagttctgattttttggttcactaccacaatttgcctcaagttaggcaggtttgactgagttaggtgtctgtttggttcgtgccacgcttgtagtaagattccttcatcatcacatgggtcccagatgtcattggcacataaaagtgtggcaaggttgctctcttcgaactaaagtgtggcttcaattttggtagccgcatgttaggctgttagctaaaaaagtatggcaagctttgacaatttgagtatgccaaacaaacatgccacattataaaattaaattaatgtgagccttccctataggaaaatgtgggtaacatatttcatggaaaatatgcttttatttattttagaaaatattatgatatttttttccttctatggatagcaaagcacaggcatttagctagtaatacaataaaaagaaccgatagtacccatttgtctagtatattagcatcttttgaaccatttcatttttataacatgaaaggattttaatgcatccgccttgcttttactttgtagaagaaactgaaaggcagtagcactcagtgtactgctactaccaggaatattgaagatggcttcctcta

SEQ ID NO: 46635 - DNA, 295 bp, Oryza sativa
ttctagctagctagcaaagctgagagttgcagcttctactaactctgaacctcaagcactgttttctctgcagaacggaataggacaaagggtgaaccggtgaagtgtttggtgaattattttagtctaaattaatactacctctgcttttttaatagatgacgtcgttaattttctgccacacgtttgaccatccgtcttattcaaaaatacgtaattataatttattttgttgtgagttattttatccctcaaaatactttaaacatgatttatatcttatacttctgcataa

SEQ ID NO: 46636 - DNA, 248 bp, Oryza sativa
tgttctgtaaagatttaaaaagttatatataattgtcagaactatcattacttagtacttttagctttctgctgaagttttatacatgagtgtatatagttggaaccagcattcaagtaggagaattggaacccagatgtgcaatagtttattttttaaacacaatgtctgttgtgagttccatccgatggttaaacgaaaataaacgttaattcaaatttagagaatgttggttgggtgcttgcagg

SEQ ID NO: 46637 - DNA, 1501 bp, Oryza sativa
ccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacagaccgatcagatcgtgggttaggtggagacaggcggtctgacgcacgcctcgccccatcccatcaggatgagagcctccaagcactcgtccctagccggagccggcgtgttacctcctggagatggcacgttggtcccggtcagatatataccaggcttcatcctaaccattacaagcaagacattgtatgaagaggggcgaacatgcagattgttaaactgacacgtggtggacaagaatgaccgatttgtgaccggtctgacaatggtcatgtcgtcagcagacagctatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaggaggggaaacgatcccagaacgatcgggggctggctcgcactttgtagcttcttcatacacagatccaccaaaacacaggagtagggtattacgcttctcagcggcccgaacctgtatacatcgcccgtgtcttgtgtgtttccactctcgtgaactttccacaggctaggagcttagaacctcacccagggcccccggccgaaccggcaaagggaggcctgcgcggtctcccggtgaggagcccccacgctccgtcaggcaagatcaacaacccacggagaggtgtatcgatcgctaaggcgcaacacaacgtctcgtacggttgtagtcggatcgtcaacgtttatcccaaatcgtagttatcacaactcaccgaaagatcgggccaacaacagccttgaatgtcgagaggaactcagggttcatcagaagtagttgacgagaatcaaagaaagttgctactgattacatgaaatttagacttgagcatgggccaaagcaggtgggagaagagcctggtccatccacgcatggaccaaggttccacattaaaagtgccccttaggtcatatttgacacaaatatatatctcagatctatggtagattttaatttgtatgttaaattatattggtttaacattttaatttttatctaaaatgagaacaaaattatttatctaaatgttatcaaagtaaccgtagatctagatctatgaatttgtagaactagaaatgcctagctccaaaatatcttaggtacatagttgtgccaaagagaaccttaatggccattctgctacaaactatcatgctaagtagggccaccaacaaaaataac

SEQ ID NO: 46638 - DNA, 433 bp, Oryza sativa
cggcggctaaacgcaactcctaacagcgggaaggggcatagccacgctacactcccaaaaaatccccaaaagtggcaccacagatgaccctccgagaggatggattccaggaccacagggactgaagagagcaccgagtcaaaacccagaagttccgttccttccacggctgccaagagaccagagcaccagggtcctgaggatgaatagaattttcccttctacttagcaaatgccaaatgccactcttacctgcaccatgtagaaaatattttttttagataatgtagaaaatatttacatgttcaaaccgatagtcgcacctaattcatatagtgaaatatgctggaaaggatgcaaatcgttatgatctcaattctcaagacgacgctactacgagtttccagagttcagttctgcctctgaagatcct

SEQ ID NO: 46639 - DNA, 1501 bp, Oryza sativa
tcggtgaaatgtatttcccgatgacttccaatttaatgggaaaaggggagccccggttggcaatgattaaggccatgttcggtttagaggggattgagggggaataattccacaccacaataaatcccctccaattcctccctcgtaaggattaaccaaataaggactaaatgtttttcgctgggagcaatcaataaatgttatccggataaatatatattaagtaatataatgatgaatagatatgttaaaatattatggaaatgatgtaaggtgtgataatcacatatgctttgcatgttgatttgtagaattcaatgaattgtaaataatgttgaatacttgtatgagtttttatatgtaattattgttagtgaatgatgagctagtatatttgtatgttgagttttaaacttagtgggttataactatatagaatgtatagatgtcttagttttgacatgtggaatatgggctcgagtgttattgagagaacgagggataaataagggaatgagcacttttggggggtaaataggcattttatccacagcaatcctcatgttacaagacaggtatgaaaggttactcctaccctttgtttatttaaatcaatgttgatgatgtagcacttttgaattcatggttgttatactttttcaccttttagaaaaaaagctaatataattcatggttggtttttaattatatttccctccttaaaaaagagctccaatttgcttgtgaaaacaaagtgtttggtatgtttgcccaaaccaaccatagcaaatttctggaaggtagcaatccaaacaaacctaagtaccccactataccaaaaatgtaatacgaggtaccacatcttggaaggcatcaaaccaaaaatactatcacatccgcattcacatacctctaccatacaagttccttttttgtcacaattcagaattacatttttgctgacgcaacaacaaaatagaggaattacataatttgatttatcatgattgatttgggtaacataccaaacaccaaacagttcaaggccctatttgaagagtttctatcacctcccgcttctcccagagcttttcgtccagattctaagaatctatagttgtagactaaaaaaatgaactgaaaattagaagttgaaaaacctatttttttttcattatcaaaaactggttaccaaccaattatttcttacaatcttaacattccccagagaggctcctgtaattttgaactttaggaggcaaaatactagcgaaatagtgaatcggcccatcatttggtctgggccgagtaagcctcgaagagcccaaagcccaaacggcccaaaactcgagcctgataaaaccacctcctaatccatccccgacgccggtgggtcccctccccttcccccctcccctccggcgaactccgagctcttcccggtgagcgccgccgattcggccggagaggctcgccggagtcgcctccgccctgcccacga

SEQ ID NO: 46640 - DNA, 1501 bp, Oryza sativa
cactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggatttagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccgatacaaccaggctagggcagccgacccccagctgaaggtacccgcctcatcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcatt

SEQ ID NO: 46641 - DNA, 1501 bp, Oryza sativa
tcaaatgccatttgcatcgtttctttccaattaaaatcattttgccctattttatcttgtgtgttgaccaaaacacccctgttttcacattgttttccccttgttttccctgttcaacatggacagcaatggtgtcggcgtaccggcagcgagctgctgccgtgagccatcgtgttcatcctcgatcagccatctccaagcagcaagccgccgcccggccgacctcaccgcagttcttctcgtcgtcccccaccgtctgtcgatcgtcgcagatcggctcaccgaggcaccaagcctcttcgcggctcgtcgtcatcaccgcattcctgtttcgccggtcgcagcgccgcgcctacttctccaccatcacaaccgttgctgtggccttcttcatcaatgtcgtcgacgcctgtcttcaccaccgccagcggcaatcccatcacttgtgacgatggagcagctgcccagatccaagaagcagccattgatctggacttcctgtcatcctggtaagcagcaacttgcttgtttgtgcaggcttgaactaggagagaacacaagcttctttaagctttactctgccccatgccggccgcttccgcggcgaagcttctcctccagtccgcctcgcccgacacccatctctttctccccacgaatgataccagctagggtattttggtcagaaacaaatagaaaacagggaaagatgattttaattgggaagagatggagtaaatggcatttgagcgtagatgcacgggttgaaagtggcgtattatcgaatcccatctgtacagtggcatttgagcgaaaccccatcgtgacaatggcacaatgtcaattttctccctagtataaaagatgatgtggcaagtgaataaatgaggaaagatatattgtttctacacaatatccaagacaaaacattaaatttaagtatataaaagtggtgttagcattgaaagagtagtgtctagtactgattttttttgataatgtagaatttatgaaaactatatttagtgtcttgggttgggaatggcctgagaacccaaatgcaacaataatattgcataatagttttaacgggtcatcttttttttttctaacaacatgatttcacgtgcatgatgactgatctctacgactctacctcggtgtgctacactattgaattttgcgcttgctgtgttttttagctcaaaatttgtcccacgaagactgtcttcttaatgatttattagccctctttaatattattgaatccttttctctttttttttttttgccattgaaccaatagtctcctcattcattctcccctcatttctctctgtattaacgaagagcataatagtcttctaatgttttgcttggaatgactttgactctctaaaagaaccgtcttttggggacggagggattatgtgagtatgtgacggtgttcctaattaactaaagcaattcgctaaagtatttaattaagaagattgagctg

SEQ ID NO: 46642 - DNA, 1501 bp, Oryza sativa
gagctatgtacttacagaatctgtacttctgatcttaggtaaataatattaagcactatttactcgatgaatgatgcaaaaaaaaaatctgatgcagcaactgcaaatcaaagtacaatagtacccaaatcaatagctagatacagtatatgtgctctacagtggaagaagagttcagaacttcagagttcagatacgaacgccatctcttcaacctctgacatactcctaatggacatggtaggtagcatctgataattaatgccaattaagcagcaccaaaaattgttcggattccatatattgatcatctgatactgcaaaattttgtgcgagtggtttaacgagcattgagtaagcttgcactcatgcatgtttcttcagattcgtgttccattttgtgaagtgcctctgaatttttgtggcattaattattctggttgtcccagagcatcgatcaagctagctacttctgccattgttggccatcatcgattctcttctcgaccaagaataatacttatcactttccacaaatttgctttcgcttggccttaggacaaatgcgttttttttttgtctgtcaggacgtcatgaattgacatgatgccatttgatttgaatgttgaaatgctacaagaatgacctgtttggaggagctttaaattctgaaaagcagctgtttggtaaccaacttctgagaatttggaaaagctctgaaacccagattctcagaagctgtagactgtttggggcagattctagcagaagagctttttggaaaaagctgcagctaggacaagctctcccaaacagggccaattggcttctactccatcactaagcctcaaattgatttgaatgttgaaatgcctcaaattcattgttgacgaatccttgtttgtttggggtcagacgaggccccgacaaaattccaaaatcatctggtaaaacattggtacaattcaaggttcacggtgccatgtaatggatctgactccaataatatccttcgctgctagcttcatccctgatatatgataaatgaataaattacatattggatcactttttataatagttttaatttgaactatcttgaactaagttttcactttttttagaacaaagtttttactttggaccggataatattttcttctttgttacgcctatttccctttggaccggataatatttcctttccgttacaccctgggccacccacatagttctcctttcacctcccctcgcgtgcctctatcattgttgcttaaccagtggaactgcatcttagtggggataattaagggctgctatgttccatttattgtatatcccgagtgatttctccactaagatggaaaatggaaatggattgttaacccgacaaaaaaagatatgaactactttaggaaagcaaaaggagtggtgattatgcaaaacttggtgtaatttcacatcaacgtagaaactgcattgacgaagccacctaatttag

SEQ ID NO: 46643 - DNA, 1077 bp, Oryza sativa
cgatcacgatgactggagaacttgatccaaactttctgttgatgccacttgaacttctggtctaacctctcaactaggcaaagagctctagccagaactttcggtcactattactggaacatttttcctacgtgagtgtggtgcattgtgtctcacttaagataaggctagagtaaattctatgtgtactcctgaaaactcactcaatcccttttgtacctctgaaatttacccaatcccttctatacccctaaaatttcaatttgatctcttccatgcccctaccattatattttccatcatttcactattacatttggttgcaaatgtctttttttgcccttgatgctttaggtttgaatataagcttaaaaaatgattaaaattttgtttgagtgcgcagtatctgcaatttatgaaactaatggatctaaataattagtgcataaaattttgacataattaaaatttttatttgaaattttaataggacaatagattttttttatcgggagcattcataaaaaaaattattgtgaacattggtcctatctttgtatgaatgctcctaatttttatgaatttttttataaaaaataaatacattttttatttcattatataaaaatattttttgggataaataatacatcgcacaacaaattcataactataatagtctcatgcgagaagcttttacatttttaataatgttcataaatttctatgttcatccaaagggtaaaatggttatttttatagaaattagacgatcaactgacgggaggggtatggaagggatcaaaatcaaattttaagggtatataaggaagtaagcaaaattcaggggtatagaagggattagctaaaattctaaaggtatacaagagattttctctcaaagatactatgaatacttgggctgaaatccaggccttatacatgaaccactcttaataatacagattttctaagactcaaattaaaattaaaaataatttgcgaaagggcctgtagcttagtggttataagagcctcagtagcattttaggtcctgggttcgactcccataggagc

SEQ ID NO: 46644 - DNA, 1501 bp, Oryza sativa
aggaggaagatgacgggaggaagaagaagaaagaagagaaaaagaaaaagaaagactgacaggtgggcccctgcacagtaacattttgtattttccctatttaattcaaatcctattctttagaagcccatatctcctaaaccgtagatccgatttcagtgaaacttggacctaaatttatctaaattcaaaccctatcttttgacacaaaatttgctattttataattttatttgaatttattcaaatatagtttgaatttatatttgcctttttaaatattttctttttgtcccaaaataccctttagccactaaaaagccgccagttggaactttacaccttccatggggacgctcgcggtttactatccccgacatcaggccgttggttgtaaagcccggcaaaaccaaacctaaggtcgaagtgctgctactggcaccccacgcctcgatgcctatagtggtcggagctacactattccctcgacctccacagcacgctgcacagttagctattgggctctgtgtgatcctagctgttccgccgccactcacggttgtcggagtaacacttccgccccactaaacccacacaaacctcctatccctctagccattaaactatccgttgataccggctagaaaagataccagttctagtcgttatactgtccaactctagcagcaactagcaaacacctaaaccctagctaatatttatcctacctcaatcagcttgctatccgaactccataccaaccatttacccttctactacccatagcctatgcatgaaatacgagctgatatgctatcctatttcagcatcgactcgagaacaactaaatcctagccattcttctaccaaagcccaacctcgaccaatgctagccacatatccacttaaccagttagattattcggtatatcccctattctccaagaaaccaaaaaccacacataaaatataagtgacaattattacttaatcccctctagcctccaaccctttagaacctacacatattagcccagtaatccctacaccctataaaggagataggttataccctaaaccctagcccttttagttgtttatcgttttcttgttattttatggattttattgaaattggttcttcctcttctctagtagagtctattatattctggatggcaacctgtggtatttcgagcatcggataatcaggttgcctaccttgatttattcgcgttggagcaaggcaagttattattcctcccctttgagcataattatcccatattcttatatctctattctatgcattagtcatacatgattttgaatgcataacctgaacatagcaaaccagatatgctagctttgcttagccctgcctagttagtccgtataaaaatataatgaacttagattgggacagtacgtaggaattggttgatttccgggtggctagtactgtctcagtcgatatagttattaccaagtacttatgtca

SEQ ID NO: 46645 - DNA, 1501 bp, Oryza sativa
tggcacagctccagctccagcttcaccccttctggagttggagctcagccgaacaatttcggctccaccaaaactgggagtggagctgggtggaactctctcacaaaatgaactagagttgtggagctgggtttaggcagcttcacaactccactccagactcaactcttggagttaaatttaggagttggagctataccaaacaggccctatatctctcccctgctactctattctccctctctcttcaaggtggggcctagccgaacactccctcattgctatatacattgtaaaagagatgctatataatagtcattgtgattttaaagccacagaaacatgatactcacaagagataaaaacggtatatattaagagaaagccatttatgtatactactgtatataagtatatactattaagactttaagagaaagccaagctattatgttaataagtaccatatctgctatctttaaatgacgatttcagcctgttctttatatctgatggatttatgacaattttttgagtgcagaaatgagtaaactaaacattagaaagttgaaaagtttgtttttttaatagaaatattgataaaaaagttcttttttataaaaatcatacttcctccagtttgtattatgagtcgttttaacatttttcctagtcaatgtttttaagtttaaccaaatttatagaaaaaattaacaacatctgaaacaccaaattacttttattaaatttaacattgaatatattttgataatatgtttgttttatatcgaaaatgttactatattttttttactaaagttggtcaaacttaaataaatttgaaaaaaacaaagcaatttataatataaaatggagggagaactgtttagaagcacagaaagcgtgccaatgatagtgtattggctgaaaaggacgcaaagtcacacattccctgcttttgaaatggcagcactttccgctctcataagaacatttcaacttttcaacaaagaaatgtcactacagctcactaatattctgtctaggcaagaagatacttccgtttgggaataatcttgacatgttttgaacgtttcttaaaggggcaattgcttatttgaccctgttttgaattgtaattgccgatttgaccctactttttgaactttgcttatttgaccctccttttcgagtacgaagcttccgactgaccctctttcgctaactccgttagggttcaattttttaaaaaagaaaatctttacagagttcctaatggcgaaaataccctccaaagcccaaaccctattatgactctctctctctctcactcgtgcattcctcacggtctcacctctctctcactcgtgcgtgcggcggcggcggcgagtacgcgtgcggcggcggcggcctaagggggcggcggcggcggcgagctgagggggcggcggcggcgtcaagcacagacccgccggcgcccgctcgttgtggtggagggcag

SEQ ID NO: 46646 - DNA, 550 bp, Oryza sativa
aatgcagcagcatttagtaaaatcttgaattaggtttctaaccaaagtaccatatgagtcccgatactcaattccgtgagcacggctattcgaatagattcaggtttactttactacagtaaatgtacgctttacccgcaatccatgacatgctaatattcattagcttagtcatggcaaagcttttcagttactaacatcagtggcacctgttccatgaactctcatcctcatgcgctctgaacataacattgtcagcagcgcgaggagttctggcgttcccgaggtttttagagagagaactggttgagagacccccgtcatctcaaccaggttttcacaattatatatatacttgagctcaataaatcatttacctgcgcctcggtaaacgtcacatttgcccttcgcggcatataattgcctcctgcgcgaggacttacaatagaaccactgtacagaggtaccacctttgctagataacttactttgcaaggtctgtccccattctagaattgcggtcgtactcgttcgtttgacataagtactt

SEQ ID NO: 46647 - DNA, 1501 bp, Oryza sativa
tatcgactgagacagtactagccacccggaaatcaaccaattcctacgtactgtcccaatctaagttcattatatttttatacggactaactaggcagggctaagcaaagctagcatatctggtttgctatgttcaggttatgcattcaaaatcatgtatgactaatgcatagaatagagatataagaatatgggataattatgctcaaaggggaggaataataacttgccttgctccaacgcgaataaatcaaggtaggcaacctgattatccgatgctcgaaataccacaggttgccatccagaatataatagactctactagagaagaggaagaaccaatttcaataaaatccataaaataacaagaaaacgataaacaactaaaagggctagggtttagggtataacctatctcctttatagggtgtagggattactgggctaatatgtgtaggttctaaagggttggaggctagaggggattaagtaataattgtcacttatattttatgtgtggtttttggtttcttggagaataggggatataccgaataatctaactggttaagtggatatgtggctagcattggtcgaggttgggctttggtagaagaatggctaggatttagttgttctcgagtcgatgctgaaataggatagcatatcagctcgtatttcatgcataggctatgggtagtagaagggtaaatggttggtatggagttcggatagcaagctgattgaggtaggataaatattagctagggtttaggtgtttgctagttgctgctagagttggacagtataacgactagaactggtatcttttctagccggtatcaacggatagtttaatggctagagggataggaggtttgtgtgggtttagtggggcggaagtgttactccgacaaccgtgagtggcggcggaacagctaggatcacacagagcccaatagctaactgtgcagcgtgctgtggaggtcgagggaatagtgtagctccgaccactataggcatcgaggcgtggggtgccagtagcagcacttcgaccttaggtttggttttgccgggctttacaaccaacggcctgatgtcggggatagtaaaccgcgagcgtccccatggaaggtgtaaagttccaactggcggctttttagtggctaaagggtattttgggacaaaaagaaaatatttaaaaaggcaaatataaattcaaactatatttgaataaattcaaataaaattataaaatagcaaattttgtgtcaaaagatagggtttgaatttagataaatttaggtccaagtttcactgaaatcggatctacggtttaggagatatgggcttctaaagaataggatttgaattaaatagggaaaatacaaaatgttactgtgcaggggcccacctgtcagtctttctttttctttttctcttctttcttcttcttcctcccgtcatcttcctcctctccttcttcccgtgtaacaacaga

SEQ ID NO: 46648 - DNA, 664 bp, Oryza sativa
tgcatgtcatgccaaatcatatgttgaggattgatttcttgccttctatttcccaaggaccattagttagattgttacataaaaacaatttgcatgtggtttgtaaattccaagtttcttgcttattttgaatagctgcatctgtactggttttgtcagatgttagttctggactttctggttttgtgtcagacctttcctcttctgggtcatagtgtaagtctggcagttcctgaagtctaatcagtaatctggtttagtatagccaattaaagtctacaccctccattgcaaaaagattgcaattctagcattcaaattctgtcccaaaaaaaaatgcaatcctatagtataactttgtttcatcaatctaggtcatttcccttccctactaatttgcccccctcactcctaaaattgcaatctttttgggacagagggagtactaaagtactatttttgacagtccaacatttagtgttttttctgccaggccggctgaaagactgaccgaccaaatttcaataagataggaacatttagtgctttggactgtgtctgtgttgagttggtcttggttgtgtgtacacttaagtagcatagtcataccatttagagcatccattctaatttactgaaggaagacaatgggagattgcaatca

SEQ ID NO: 46649 - DNA, 1501 bp, Oryza sativa
gcttatcgtaaaacagtaatgctctaaaaggtggtaattgcgtgctcagcactattctttgcttatagataacaatcttccatttttgtggcaatgtgccgatgcgtatggatgatttttatgtagataccggaagtagtatatacatatgcaatgagttaggggctgtttgattttaagccctaagctgacaaaccaaagtttggcaatgcacatgcttttttgtcctccatttggctggtgaccacaatttgtgtgccctctctatttggcaaaggtaggcaataatttgtgtgctctctctatttggcaaaggtaggcaatagacttaccaaacttttggggacaaaatttgaatggcaatatctgaccaaattttggtggcttagcctatctccatgcccatataaaaaaaatattggtaaaaccaaaacatgtttttttgctacttttttctctaggcacacatttagtcacggttattagatttcaattggacttatagatgatatatatataattatagaagaccttagttttgtatgatgcacaacaagggcgaggtatgaacccatgatggcataaaaatccattgcctagtaagatttaagaatgtgccagcttttgaatttatgattataaagatttaagtacaagagaggaggccctattggacatatgagcttagttccaagaagatcgttatgagtggatttttacagcggatgaagaaacatggtatttgccatactaaagtttataaaccgaagagtatcccaatcacccaaacaaccaaacaatacttgtttgaatatccaccataaaaagtttggttcactttcatgccacaaaaaatgttgaagccatctcagatcagacatatcactttgttcccttccatccaaactcctgactcactaatgttgactcatgcctaggccatgttccatctagtctactacctaaacccagtcgttctgtgctcctttggtccttccccagaattctgttcctgcatcatcttcacagttaatgtcctgcaggtatgatgtttgtgtacccactcaaaattataaggacataattactcctaagagaccaaatataggactacatacatgattaaatagctaatacacgatcttcctcataatatcgcctgctgcattcatcagccaaaatgagcaaagctcactgaaatccttagctcctgtctttaacatactcaaactgggaagttagtggccatggcagcatgactggagcgataggttgtgcctcttacatatggttgcgatggagtcactatctcagcatggaagagcacagtgagggtgaaatcatttgatatgacactgattctcacttagcagggagggcgcagtgatgtgcttgtagatggacatggcattttggagattgcggggtactaggagtaagaaagtaggtaatgcagtggctcaagagacaagcggagcttcagtgaagaaagagtgtaggg

SEQ ID NO: 46650 - DNA, 1501 bp, Oryza sativa
gttggagagttttcttccacaatctattcgcactgcaatctgatcaagttattatgtgtttgcttaaggcccagccctaggggggtcgagctatgccatcgcactaggccctcgaagttaaggagcctcacaacatatatgtatgctatagatatagaagtccatagaccatatgaacttagatttagaaagcacaggagaaagatatataacttgtttgcatttattagaaacatcattatattatcagagttgtattaaagggctcatctttctagcttcgctccgggccactaaattggcaggaccgggccttgctttgcatacgacgggatcgggtaccatgggaagcgatatggacccaatacaaactcgttaccgtccgatatcaagtgttttcggaaaacattacggtaagtgatcttctgctcgaatccaaacaaagcacggtaacgcttgttctgtttccattcacagagtgatgggaaaacatttacgtttgcattaccaaaacatttacattctcttaccatggttcaagccatcaaccaatagcgattgccatagtattgtatcttgggagaacccataatatgcatgcttcctttttttagtggagaaaatttagagaaactacaaaatgaatgggaggaggagatctagggggatgagagaaaaaatggggacttttcaggcagttaagaggtagagttcaagcattgaaagtgatcttcatttttaaatgaactgatcagcttggagcgtagttatcactattgattgatggcttgaaccgagaatgatactcagttaactctatcaagtgcaatccgtggagctaccctaagcaatcgtgcttctgtcaacacatgtgattagggatgcaagcggcacgggcaagcaagattttttatcccgcttatcccattttttatttaattctttttctctaaaatttatactaccatataaaaaaataaactagtaaacgaatttttatacggtttatgggattgtccactttatccctacatgtgacctcgagattgactaacctcaaacgagtttgagagtggcaatttttccatcttagaccgagattgtttctaagaacgagacgcattatgagttccacctgtgaatatcaaaaatcaaaaatcactcactacatgcaacgctttcgaaaaaggaaaatacaaactacgaatttcggatatataccatgtttttcattataatcggaaattaatctttttctacgacggaggaagtacaagataaccgaaggtccaaacaaagaaaacacaaagcccaccagcaaccctagaaggctcatctgtaaccccaaaggcccaaggcccattaggccgaataacacctcctttccagcccgcgactcgtgcggccgtgtgcgtgcgtgcgttgcccttgctgcgggtgcagaactccatctgctccggcggcggcggcggcggcggcggcgaggcgaggagagagagga

SEQ ID NO: 46651 - DNA, 419 bp, Oryza sativa
tgctaacgattatttcctgtaccataatttaaggctagtgacaagggttgcttattttctagacattctggatctgatatctaggtgggatctgaattggtaacttaattactgaactcttgaaagaactaagtttacctgcatggtgctgtttctaatttgcttgggcatgtttggtttcccttcccaacctggctagccttggttcactctacaaaagtgcacatgggagtccggtttcaatactttctagtttttttattcagtttatatttgtcttccccacccatccattaacacctaaagtgcccatgggactcctgtttcaatattttctagttttttttattcagtttatatttgtcttccatacccatccattaacacctaaagattttcacttattcgttttttctagc

SEQ ID NO: 46652 - DNA, 267 bp, Oryza sativa
ttttcctttggtacccttatctccgcatgagaaaccgcatccatgcgagataagtagggacacatgctggatacatgataaggtacgatactccggataagctgtgcagggataaaaggttgttgttcgaccaatttaactattcaacaagttcgagaataattgagtctttttctttttgaataatgtcaacccctctcctgcaaattcatcttttcttaaaacaagagatttattttttaattctacgagtgcgcgcatcggaca

SEQ ID NO: 46653 - DNA, 234 bp, Oryza sativa
aggaaaaaggattttccctggaataaaatattgcttgctcaattttaattggttaaaattatttctagagctctgaaaattccactaaaaatcctgttaatgaattttgacatgtagaacttaagaaaaattccacatgtcaagtccgattattatttgcattactttcttagggttttctcctgatttcacctgcattttcttggggtcatttgaaaattacgattttggcta

SEQ ID NO: 46654 - DNA, 326 bp, Oryza sativa
gtcgctgagtgaaagggcatgacacgatattgctcgaccgttgcgtgaaaataatgaccacgtgctgaattcgtgtgcggtctcgcgtgcagggtggaggtagagtaattagggggttcctagtaacccggtgaaaaaaaaattataactatatcttatctattttcgctatatatgcaccctctcaatataaatataagtatctatgtcagtttaaactcaatattaagtaaaataaattaagctagcagcatctctctgtctagttctagctccgtcctgctcgcgtgacggagtcatgacatgggcggtgtcgtggtgcgaaa

SEQ ID NO: 46655 - DNA, 303 bp, Oryza sativa
ttattttttttgcggggaaataatacacaaattataactgaagacaaattataactgaaggcaaatacatgaggccactcatctctacctcttttataaggcaaatacatgaggccactcatctctaccccttttattgagctagcttttgtaatttggagtatatcaacaccttccaagggggtattgtttcaggaggtacaaaactgtatgaactagggcctttcggttcaaatgcgaaaatgcccaccaagtgttgatattgatacatcaggctggcaaaatccagattacagcgcagca

SEQ ID NO: 46656 - DNA, 1501 bp, Oryza sativa
tgcgggactgcatgtggccatgccaccacagggagatggcgggaagagggacaccgaggaattctgccgccggtagggctcatctctccctctcactcgcacgacggcatcaacagatagggattgatctgaaaagagaattactaaattgcccttacatttttttagcatattcctataatacccttgtaaatacttgcagtatatactgttagtatattgtaccgtaaaagttctcaaatatttagctttaataattagtttatggttgcatttccgggcattttatgattaattaattccgtggctgcaggatcgacggatcatgtcatgtgggagcatgtcaaccctgaaacgtgcctgtcctgacgctctctggactttttcttgatatgccaaaccatcatctgtggacgttttggaatcttcttttcatcagagttctttgtatgccccttttctttttcttttttttttctgttagatttggatgtattggaagcttcggatgtctccttgttgcctcccgttaattctcttctttgtgatttttactagcaagtgaaaccttaattatatctatctgaagttatgccatactgatatagcactgtgctaactagcagtacccctgatctcttggcagttgtgtaaggaacgaaactcgatgctctcttcggtgcccgtggttctatagtctatcctctcggatggctgtctatagtcttttgctggcgttgctgtttttggggttttttttggagtgtagtgtggctcttcccctcctcccacttatcggagttgtgtttagctcccgtagtagtttttcttttttcctagttacggtttttggtttgctttttcttccttcccctagtataggcctgtttggctgattgcgttgtgtaaaaaaaactcttttttcctttttttcctttttaatgtattgaagtgtaattattttgcgcattggaaaaaaaaaaaaactagcagtatcccattttcagtcagtacaaaggtgcttgcaaaactacaaatgtttcaggatccttcagacaaagaatagtgcaagaaacgtgtacagagtttcttgaataacatatactacatgaatagaccatcgatttaatttgtgatcaattcaactttgtgttactttgttcaatacaaaattgccgtgaaccatatgaaatgcatgtatttggtggcatcatccatccgtgaacgaatgatataagctcgatcgtctgaaagaaacagcgctagggagttggtggagggaatgatatactacagtatcataccactgctagtattagttgagaaaaattaatcacatgggacaaagcacagttacaatagatactcctatataggtaggagtcattaacttgaatccattattgaactccatattcttcaatgatagtagcatatgtttctgtagacgaccctatgattcgctgttgatctccaactgtccatgccgtgctgcacattg

SEQ ID NO: 46657 - DNA, 212 bp, Oryza sativa
attaatgaaactaatgcagcaaagcaaatgctaataatggccactttccaccctgcactgcaacctagtctactcccctcacatgtcgcaccagctgcagcgccacactccactcctcctgacgactccactgtctcctcttcaactgaatcagaccagaccacgccgcagctgagctgcaggagcgcgcggccagagccttcgtggcgcag

SEQ ID NO: 46658 - DNA, 1501 bp, Oryza sativa
ttgactactcagactccattgcaaaactagtactgatgattgatttcttcagcatcagactccatgcatgttaccttggtcaagtgattgatgggtgtatatacatgtacatactgagatatataatcaatgtgcagcacggcatggacagttggagatcaacagcgaatcatagggtcgtctacagaaacatatgctactatcattgaagaatatggagttcaataatggattcaagttaatgactcctacctatataggagtatctattgtaactgtgctttgtcccatgtgattaatttttctcaactaatactagcagtggtatgatactgtagtatatcattccctccaccaactccctagcgctgtttctttcagacgatcgagcttatatcattcgttcacggatggatgatgccaccaaatacatgcatttcatatggttcacggcaattttgtattgaacaaagtaacacaaagttgaattgatcacaaattaaatcgatggtctattcatgtagtatatgttattcaagaaactctgtacacgtttcttgcactattctttgtctgaaggatcctgaaacatttgtagttttgcaagcacctttgtactgactgaaaatgggatactgctagtttttttttttttccaatgcgcaaaataattacacttcaatacattaaaaaggaaaaaaaggaaaaaagagttttttttacacaacgcaatcagccaaacaggcctatactaggggaaggaagaaaaagcaaaccaaaaaccgtaactaggaaaaaagaaaaactactacgggagctaaacacaactccgataagtgggaggaggggaagagccacactacactccaaaaaaaaccccaaaaacagcaacgccagcaaaagactatagacagccatccgagaggatagactatagaaccacgggcaccgaagagagcatcgagtttcgttccttacacaactgccaagagatcaggggtactgctagttagcacagtgctatatcagtatggcataacttcagatagatataattaaggtttcacttgctagtaaaaatcacaaagaagagaattaacgggaggcaacaaggagacatccgaagcttccaatacatccaaatctaacagaaaaaaaaaagaaaaagaaaaggggcatacaaagaactctgatgaaaagaagattccaaaacgtccacagatgatggtttggcatatcaagaaaaagtccagagagcgtcaggacaggcacgtttcagggttgacatgctcccacatgacatgatccgtcgatcctgcagccacggaattaattaatcataaaatgcccggaaatgcaaccataaactaattattaaagctaaatatttgagaacttttacggtacaatatactaacagtatatactgcaagtatttacaagggtattataggaatatgctaaaaaaatgtaagggcaatttagtaattctcttttcaga

SEQ ID NO: 46659 - DNA, 1486 bp, Oryza sativa
gaatctcgatctaaaaaggtgttgattatccatgtattttagggagtatatatatacttgcagtaggccatagtcacttatcatgagcaatgaaataatcggtgacattgcatctgcttccctggagaaattagcaatcaaatagcaccgtcgctctcatggctgaaagtgatattttgtgatagagaaaaaaaatataacaatatatatccttatcaattttcaagataaaatgcgacctttttttaaccaagagaaagaagaaaatgcaactatgcaagagtgacgagtttgtcaggacacttgttgctttcagaacaggcacaagaaaataggattgacatttgacaaccataccgtacgtacgtgtctacaccgaccgacttaaattcatcaaattctcactagtttatgacaattattggagagaacaaacgaaagagttaaaatattacaaagttgaatggttgattttaaaaagttctctaacaaatatcgatgaagaaagttttcagatatatcataccgtttaggagcatcagaagcatacgagcgataattgataatctactactccctcgatcatttcctaaatgtttgacgccgttggtttttttaaacatgtttgaccattcgtcttattcaaaaaccttttgtgaaatgtataaaacgatatgtatacataaaagtatatttaacaataaatcaaatgataggaaaagaattaataattacttaaattttttgaataagacaaacggccaaacatttttaaaaaagtcaatggcgtcaaacatttttggatggagggagtataaaccaaaaggaacttgtatttataagtaaatgtgaattatacccaaacaaaaaaaaagaaatagagagtgtgtacacaagaaaaatgcaatgtaggttctgaattaggcaaggtatggggcccttgatgacatgctctgacagctcatgagttctactggaacatccaattccaaccaaatattccatgcatttgacctagttagttctacaccttacatccataatccatcaatcattcattcctagctcacataagacttgttctttttctctcacatgccacctcctacccaatcatgtacacaaaacttaactaggattttacaaatccttctgccaactactccaaataactataattttttattcccgaaattagcctccaatagctagtcaaaaaaaggtgtattccaaaaaaaaaaaaattgcaccttacaaacgatgcacgtttaagctaactactgcatgataattgtcgtcattatacagggaaaatatagtaaattagaggtagcaatcacgagggagagttggagtttggctaagtcctcctgagagcagccaggcataaaggacatcatcaagaactggtctattgaggagaagagaagagaagagttcttggaaggttctccatctcccatgtcagggagttggtgtctctagg

SEQ ID NO: 46660 - DNA, 648 bp, Oryza sativa
ttgtcataaactagtgagaatttgatgaatttaagtcggtcggtgtagacacgtacgtacggtatggttgtcaaatgtcaatcctattttcttgtgcctgttctgaaagcaacaagtgtcctgacaaactcgtcactcttgcatagttgcattttcttctttctcttggttaaaaaaaggtcgcattttatcttgaaaattgataaggatatatattgttatattttttttctctatcacaaaatatcactttcagccatgagagcgacggtgctatttgattgctaatttctccagggaagcagatgcaatgtcaccgattatttcattgctcatgataggtgactatggcctactgcaagtatatatatactccctaaaatacatggataatcaacacctttttagatcgagattcctcttgatgataatcatgatcaatgaactgaacactacgctgaaatggagttgcctgcattgatgggcctcccattctctgaattctggtgcttatttttttcaagaactttctatgatgcttgttaaggagtagctctcaatgaactgttccgatcttctcggtgcaatgcagtacaactacagtgcatgcacggcagctctcaatattaatttgtgctactgtttaga

SEQ ID NO: 46661 - DNA, 1501 bp, Oryza sativa
gcaagcggcgattcattcgtcccgacaggttcactcgctgtactaatcgaggagttgacgaactgtctcttgttcatctctcctccctgcttagatttggaccgagatgcaatgtccagggaagggagcaaggctcaggtgctcgacacagacggcgacgacaagatttcctctttggggccaggtaaacaactccaactcgcaatcatttgcagatcattttgcttgcgcatggatcgaattcgaatttggtgtgttgctttggtacttctactggctcacacgcaaagttcagacaatctgaaaaagatttgttttctttctttcgttcttttcccctttagatttgggccacaatgcatcagcgttggaggggaagaagaaagatgagacttttgctaaggatagcggtgatgcaagcgtgtctgcttccacagatgaggctcttgccaaggatgatgacgcaattgtcggtgctgttcttcctcccttgtcatcagaggaacccacaaacatcacacaggattcaggtaaaaaaaaaaaaaacacaaccaattgaacttctctgaagtaaccaggatgagatgttttcccccctcttcatttctgtcagaaatgggaaatgcaggatttttaacaagctgtttttttgttcttcttcttcttggtcagttcttgaggatgaggagctgaaagtccaggagactgctcctgctactactaatccttctccggagaagagcagcaacaatggcagctccccctctgtggttccatccgaccctgctactctccctgttcagcagattcctcctactcaagaggcaaaggatcctcctgctcagcaaattccagctgttccagaggccaaagttcctcctgttcagcagattccaacatttccagtggttaagacaggtatctagttcctccttacttttccttgtgttttccttgtgctaaaaaaagatgccttttttatttgcgaaaatgccaagtactactggcatactgctggtctttttagctacacatttgaaacctacagtagaacacatttgagattttgagcacaaattctcgttgcaagtagcaaaggcatgtacatggagtagttgcaaaatgtggattgtggagactagtttttggacacacatttttgatgtcttgcctatcccaacgcaaggcccaacgttcttcttgctgttctgttctggaccacctttttttgttttcatcctgtgccttgttcacctttcttgagaggagagcaatttaagagtaataaagcatcatcatcccatggccttagcttattgatagcccccattttctagtgtctttcatttgattatcatctcaccatttctcatctcgtagggtctacaacaacattgttttttgtgttcttaatttggttgcgaatctacaatctttcttgctgcatttctgggtcataattaacatgcaacgtggtttgattgattgatggtcctcccaa

SEQ ID NO: 46662 - DNA, 1501 bp, Oryza sativa
ttttaatcttttcttcttcttttactatcttttcactagtaagtaaaagtagactgtagcagctagcagatcgaccaaatgtatgatatttcagaggaggagatcagcagcaatactatattcatctctttgttttttttttatctcgattggaagatgagtttcatgagtggtagttgagttgatcatgtatactcctatagtagccaaaacccaaaaaagtgtacgaggcttaattagattatggtttgtttccccagatctcataatgtaacaactgttctttgcttctttttttcttttatagtacagcatagaattatttatgtacggtcaaaaaagatactttattaataaattacatgatgatatggtatacgagaatcaaggacatatgtacatagatagttgtacactcctactgtaattcagatggctcattctatcgaaatgtaattagctgctcggacaattaagcaaggacaacactacagtaacttcataactggtcttggatggtcaattatggttgttcatcctctaataaaaaaaaaactttgtactccacaataaagtttctttaagctcgcatttctattgcatggattggtgaactgctccatgtaaacatgtcaggtttaccatcttgccacttgctactgctgctatagtaattaaaaatcaatcaatgggatgaatctatggagcagggttcactgttcagtgaggactagtccagcaatcagcatgcttaatgcatgcattcttaactaaaatttaaccaagcacatgctcctgccaagctaggtttctgctgggaaaaattgtataaaataaacctgagaaaggcatgtgagatcgtgcaaacaatgaagcaacggtgaaggtatgaatcgtcggtggcctccatctccatggaccaggaacgtgagctccaacacagttgcagcttgcacgttgctgctgagctagtcctcgagttccaaattgccaaaaaaaaaaaatcagagtaagacgtactaatggacctgcaaaatgcatctgaaaaaaaaagattacagatcactcaataattaatggtcttaaacctccaaagtacgaattgaagattgcagttagtactactgatgataaccataacgaatgtactggtttttgctaatcagatcatagtagcaattagtactaagcacctaatgtactagtgttcaggagcagacgaccaaatggttggtgaagcaatagcaatagcaagaaattgtaagatgactgatactactatctagtactagcaatatcgctataccattacagtattgtactggtacactggagtagtactaattgttagtacaggctaaggaccatatggtatggcccgtgtaatggggatcgatatgatctcacgctatgtctgcgtgctagctttggaccaccaattatttcattcatttgatcaagcatacgaaatcgattggtgttgaatcgatcgattttgaat

SEQ ID NO: 46663 - DNA, 1501 bp, Oryza sativa
gtagcaattaaggatgggataacactatcacaaactaggcaggtaattatctaggatgagattgattacctatccagattactacgtattaacttgtccaaattcatatcattaggttaggtcaaataacaggctgattcgtacttactaaattagggctaatttcatctttaattgctactctatattagaggttttgaaagcgtgtgccggcgagatgaaacggtttcgttcactacaaaaaaaaaaaagtcagccttctccatcctttacacactgaaaaaacggaagtacttgctccctctgtaaaaaaaaaagacaaatcctttctgtgtctaacgtttgaccgtccgtcttatttgaaaaaattataaaaaaaattaaaaagacaagtcatgcataaaatattaatcatgttttatcatctaacaacaataaaaatacaaattataaaaaaaattcatataagacggacagtcaaagttggacacggaaacccagggtttgtctttttttttttggacggagggagtaggccagaaaacaagatgacgagaagaaaagaaaaaaaagaaaaggagaggagaaaaaaaacggaaaagaacagaaagccacgagttaaggagaaataataaatggaggtggcctccacgacctcctcctctgtttctcttcttcacactcacatgctgacaccctcctagctccccccacctcagccatcaccgccaagcccaagcaagcaagctcacgagcactccaattatctactctacttaagctccggtgagttaatccttcaccgctgcactctcacgctcacacacatgagctctagttttactatatagagagagtgtgccgtgctgtttgccaagagaggtcgagagcggtggcggcggcggccatggagggcggtggcaaggcggggtacagctatggcggccaccaccaccaccaggacgccaagctgctcaagaacctcagccgggtggagccccgccggttcggcctcggcctcgtcgccgggttcctcatcgtcacctgcgcctacttctccaccgccaagttcgacgccatccacatcgccatgagtacgcccgcccatctcctcctcctcctcctcacgcatctccatgcctacctgtgtatctcactcttgtcgccatggattcttgcagtaagctctccagccaagaatgcagctgggtttatgaacgcttcttctgacggctccaatcagcagcagctaggtgagcaagcggcgattcattcgtcccgacaggttcactcgctgtactaatcgaggagttgacgaactgtctcttgttcatctctcctccctgcttagatttggaccgagatgcaatgtccagggaagggagcaaggctcaggtgctcgacacagacggcgacgacaagatttcctctttggggccaggtaaacaactccaactcgcaatcatttgcagatcattttgcttgcgcatggatcgaattc

SEQ ID NO: 46664 - DNA, 1501 bp, Oryza sativa
acaccgcttagtgtgtcatatgtgcaccagcttcccttcatgaaccaatgagcattacaagtctcatgttaaactttgctagtaatattttttaaattaagaattggtatcagcctaagttcattcgatgatttactagtatgcagtatgcagaggctcaaatttaaactgaaattgaaaaaaaaaatcagcaacttccgtagccttccgttgttatttttgacaaaaagtacaatacccttatcaattatcccatttgcgtttatggctcactgttttggcgcaatactatttttaattgacctttcttactttatagccctgtgctatgatgctttcaacatattccaatctgagacaagcttaagatatccatgcttccggaacgctttcttttctagaaaattatttttacagtcttctaagtttcacttcttcaatacaaacctgagtgaattgtctaattagttacttaatgaatctagagttttcaaaatcaatttccgaatgtatacacggttggtgttatgttttctttggtgtagaattatttcatagtggtttcacttatccaatacaagcttcctttcttttgtcttaaccaatgaaaattacctggctcttgttgaactttgatagttgtaactttcaaattaagaattattttcagagtccctcagtttagtattattttcagagtctccctgagtgaattgcctaattaatgaatatagagaggttttgaaatcaattaccgaatgcattattggtacaagcctaagtagattctaaaagatgcagcattctgaagtgcaagactaaaaccaacagtggtcttaactgctgctggcaacagtaacaacctataaccacgtatattgatgccatggctactaacctcattagcaacatgccttgaagtactgctgactggacactacccctcttcttaagtgttgaagaattataattcaagctttggcatagataaaactagggtcagatttaaatcataatgtttaattgacagtcatcttcattttgttttggcagaatgctgaagcagcaggcaaggttggagcaagcgccaagggcaagcgtaagcggatgagcagcaggcaagctggtaggagcaagtgccaagggcaagcgtaagcggatcgaggagtgctgaatggtactccctcagttaaaaaaaaaaaacaatcctgagtatgaacctggacacgtgtgtgggctcatacccaggatttgttcttttctttttaggacggagagagtagtatatttctgttgcttatcatgtgcgcctagcatgtcgcttttttggcttacatcctgtgagatgtaatgttagcatgtgtttggtttcgggactaagtgggatgggatgaaaccatccctgattttggagttgggatgattccactcacatgtttggtttgtaggatgggacaattctaattttttgtttggttgaaaggatgagggagaaatggga

SEQ ID NO: 46665 - DNA, 819 bp, Oryza sativa
gatttgaaggcaatttgaggatgattgttttgggattttggggacgggatagggttagggtgaaatcaatatattaaaaataataaagagaagaaaataataaagaagcaaccggatctgtctcaaccgggactaaagataaacaccaaccgggactaaaaatcgatttttactcccggttatctcacccgggactaaagatcgctatctttagtcccggattcgtagtctcggttggaaaaccaggactatataggggttatgaaccgggagtaaaatccacttctccaccagtgacacgttttaggtacaaaaggaaatctgctgcattcacgtgtggcgcgcccgcgcatgccaacctgttcgagccattcgcgggtacgggttaacgcgaacgttcacgtattaggtatttcgtagaaggaacgaacaaacggtcatgctgcccctaacgtgcgatcagtcgcgcttcccacgagccgcgcggtcagtttctgaccatatagtctctctcctctactagatgtatatatatatataaagtttatatgtatgtatataaagtttatatgtatatatatatatacatatgtatattttctaatatgtatatacacatataaaatgtttgtatacgtcatatacaaagtttgtatgcgacgtatataaaagtttatatatgtatgtatacaaaatatatgtcacgcccagaaatttagccctaaatttccagactattttgtgtattaaatccctgtccaggaccagccaggatacacaaaacgataagtaatatacagttccaaacgtaaataaagc

SEQ ID NO: 46666 - DNA, 183 bp, Oryza sativa
aggtggaaaccatccagcgacatgggggcggcatcaaggggcggagtgaaggtggctcggtgccgtttttctcgggggaagtgggggaagagggggaggacgagggcggcgaccgcgcccacgtatgcgcgggaaaggggggtcgcgcggaaggggcggcaacgtgggcgtatcgggcggcca

SEQ ID NO: 46667 - DNA, 208 bp, Oryza sativa
aaccgtatcagtttcgttgcaatccgatcacccgttgtcgcgaccctaattttagccctagggtacgccgttcaccgaaattccaaaaatccctaaaattatttctttaaatccttttcacccattgttgcagtttgtgatactattttcttttggttatctttgcttttctgttatttattatggtgatgattgttgcgtaaataga

SEQ ID NO: 46668 - DNA, 1501 bp, Oryza sativa
agaatcataatctctagcgtgctttttattgccaataagggttttatcggggtttcagtgtggggacacctgataaagtcatggtgccctacgaatacgtaactgcccaggatgttcagttatgcatgaaatgatataaaagcataaacttcaattatacaatacttaagtcacttagttcacaacagaacacaaatacaaaccattacatatatggcctacaaagccttatttctacaaacagataaactgctagactccaccacaggaactgcctgagcgtagaatgacctagaaaccatagctgtcccactctaacggatcaacatgatcttcacaagcatcctcctccttatgatctgaacccatttatgagtacaaaaggtactcagcaagacatgcttatgataacaaatacaataattgcaatataaaacatgcaatattaagagctggaaggtttaaaccctaaccttaacagttatttcatagagcctatcttaataaacatttgatataaacatcactattgaacatttaatttaaacagtaataatgagcataaaaatataaatgttacttataaataacttgaatagaccatcaagtaataaataagttaaccatattaattaatagccatttagtttaacttgtgcccataatctggaatcacccatagacacatctccactaatcgggagcacggcgttttcgaatactcaacgactctgtagcgtctgcccagctttacctacacgatacccatagctggccaggctgaaaagtaacaaggtgtaatattgctccatatatctctcccttctgcctagtaagttaaaggatgctcgagatgttgctcggagtgatccagtccgaggtgtgtgccaacctacctccacatccacttaccattgttcgttactcgatgggcagcccagaacttcatgggccaatagggcagttctgaactctcggggcccatcgagcccacatatataaatcatataaacatgaaccatgtcactttgcttcacacacttgaaagctaatggccagtacaccgaaaggcatgcagaagtttaatcaattagagcaatatacggccaggttcgataactcgatcgtgtggatggcgaaactatgtcattcttattgacataagggggttgattattatatcaattttaaataagaaatagccataaatatatccatatattcaacacgaccataaacaggtccataaaaccaaacacatgaactctattatgtgtaccacccgctcacatgcggtgccaacaattctcagcatatagccataaatagttccataagcatgttttcatatgcagtaataatatccatattaaatcaatagcatgttaaataattaaccatttgtttaggtgtttctcaaattttatcctaagtttgttatactctaaggctcattaaggtgtttataacaacaacagaaaatataatgcaataatagtaa

SEQ ID NO: 46669 - DNA, 452 bp, Oryza sativa
catcctagttattgggttagaaatggtctaatcatgagatgtacgatactaaacgtctgttcgcgttccgcgaacgttcacgtattagcctcacccgctgctcgggcggtgctgcgagaccgcatctgtctcgtgccaacagaccgcaaacagcgtctctctcgtgccgatgttgtggcgttgcggggccgtaacaacgtcacccatttcgcaccacgacaccgcccatgtcatgactccgtcacgcgagcaggacggagctagaactagacagagagatgctgctagcttaatttattttacttaatattgagtttaaactgacatagatacttatatttatattgagagggtgcatatatagcgaaaatagataagatatagttataatttttttttcaccgggttactaggaaccccctaattactctacctccaccctgcacgcgaga

SEQ ID NO: 46670 - DNA, 1501 bp, Oryza sativa
atattggttaaggtttctatcttgtaataatgccccacatcctatataaggtgggcactgggctggaagccttctaaggaatgattcacaaacagatcgtcagatcaatactacacccggcggattcgaatcctcaaacaggagtggggtattttctctcattgagagggcctggacctgtctaaatccttgtctctacatccatctacttttaggtctcatgcactatccctttatattgtcgaaattttgtttggacacatatttttgcctctcttttcttgttcgatcgctcacttccatttcggggagccattactgcacggccaaacagtttccttttccgtgaaacgaagcctcccgaggagatggatcgatgtcgttcgctactaatccgaactatacgcgaatcccatcacagatgccgcatatcccgtccaaattatctatatgcggtcctacttcataatcgcatcgcggttttctttttatcatttgttatttttaccaaaggaccacagcagggtttttatttttaaataatgacctcagcagggtttttttttttgttgtttaagtaaaaaccgctcctctcagatttacaaaaaaccaacaaaagggacaaagcttgacaactttcgatcaaaaccgtatagaaaccaactaatataataccgatcggcttccacaaacagagaatcaccagtttcacgaaaaccgttgaatcctggacctcagtccgtttcttagtccactccctcttcgtctcattactaggctgatccaacagggtcggtgctgtggccgctaccccgatttggcgcagctaccgtcgcccgtcatgggtaagcgtcgtcgaatcgcgcctccgtccactagctccccctatctgcctctagccctctaccaagaaacaccatcgttgtaaccttcgccaagccaccgtgtgtgcgggtcatggggtgggttgggagggaaagatggagagagagaggaagaagtacatagattgacatgtggaacccactagctattagattggagagggtaataaagagaatgttagagtgaaagacaaatttgactctaatattttgtaagctagccaaatagagatttaaaaagttaaatttagagagaccgttaaagatgctattatacactcgggcaacagctgcatcatatcattgccttgatctcctctaggaggaaacaccacatggctttgtctggtgctctcttcacattaggcatgaccgagctagctacacgcaaatactcccttcatttcatacttattataagtcgctttaattttttacataatcttttaattgtttgatcaaacttaaaaaaaaactagcaacatctaaaataccaaattagttctattaaatttaacactgagtatatattttgataatgggtttattttatgttgaaaatgttattgtattattcaataaatttggttaaacttaaagaaaatcaaaacaatttg

SEQ ID NO: 46671 - DNA, 1501 bp, Oryza sativa
gtcgttcctcaactagaaggctcaagaccggaggcaaaagaagcgcaatttcaacctctttcacctcctcaaatccgcaccaacccccgctgactcaatcatcatcaccggaggaaaaatccccgaaaccctaattttgcgccattcacagagcttcaaaattcgtcgcatacgttgcaaatcttctgaaattgaaggtaaaaacggatttgacgtgccgagtactcccattcccttctgttttcccatccaatccgacgccggagtgccgccgtttccgcctcccggcgtcgccgctctgttcggccgcctccagccgcacggcgcgccgccgctcccggcctccccaggctgagccgccgctaccaccacgctccccttgctccactgatgctcaccatatccgccgccctcacctgagttcgccggaaccaccgtcgccatggccgccgccgtctccagctcctggccgccgtcgccagcctcgccaccggcgcttctctcgccgcagaccacaaaaacggaatcggctcgacttatagatcgcaaaaccggcgccccctttcccaaaaccggccatcttcaccgctggcgccagggagttgccgaccggctcccgtgcacagaacgagatgaataggaaatctgattttcctgttgaaaaataaataagaaaaaacatttttattttcctatcaagttgaccatccgtttgagctcgaaatcaaaatccgagacctattccaaactcctagaattattccgaatccaaccgtatcagtttcgttgcaatccgatcacccgttgtcgcgaccctaattttagccctagggtacgccgttcaccgaaattccaaaaatccctaaaattatttctttaaatccttttcacccattgttgcagtttgtgatactattttcttttggttatctttgcttttctgttatttattatggtgatgattgttgcgtaaatagaaagcactgacgttggtccggtagtcggagcaagtgaaatctccgcgccaggaggagacggtttgtacgactacatcgagcccgaaggttgcaagacatgcaccctcccttgaacaatttaatcccagtagttagagagttattttggtagcgtactcgtcctttggagtacgatagactgcacgaattcttttaaattaattatattactattattgcattatattttctgttgttgttataaacaccttaatgagccttagagtataacaaacttaggataaaatttgagaaacacctaaacaaatggttaattatttaacatgctattgatttaatatggatattattactgcatatgaaaacatgcttatggaactatttatggctatatgctgagaattgttggcaccgcatgtgagcgggtggtacacataatagagttcatgtgtttggttttatggacctgtttatggtcgtgttgaatatatggatatatttatggctatttcttatttaaaatt

SEQ ID NO: 46672 - DNA, 1501 bp, Oryza sativa
tattttttttgaaaggaaatgcacatagcaaataaaacatgatgaaacgatgatgattaacgcaaacttcttccatgaggtattgctgatacaacatcatcccaacatagcatcctaatggaaattcatatccaagtcactaaaatcatgcaatagttatcatgccagcaattaattaacagcgacagtatgaataaatgagaagatgtagtttggttgatatggagttatagacttcaagcttgacgatttcaagcaaacatcacaggttcagcacgacgattcaacaagaagctaataggtctgcaaatgcacatagcaattattttttttgaaaggaaatgcacatagcaaataaaacatgatgaaacgatgatgattaacgcaaacttcttccaagaggtattgctcatacaacatcatcccaacatagcatcctaatggaaattcatatccaagtcactaaaatcatgtgatagttatcatgccagcaattaattaaccgcgacagtatgaataaataagaagatgtagtttggttgatatggagttatagacttcaagcttgacgatttcagtaaaatttcttggcgtctcaatacaagtttacaccgtgcacacctggaatttaagttgcggcgttccgcatcgacttccaagctaacgctctgcccttcactgaacccggaattgcatccatctccagcatcctcaaatctcccatagtggaaaaccttgatttaccagcacaaatactcaattagcctaaaaaaaataaatccaacatcctcagcaagcttgtatccttttcgagttctcggttctcaccactccatccttcatccgcacatcatcgacgatgaacctggtgccgccgccagcggagatgacgccggtgtcggccggctggccgccgccctgcgggtagaagacggtggagtccaccaacaccgctcgccggcccccctcctcctgccgacgagacaccaggggcttagtctagtcaggctctagggttttgcgcgcgctctacagtacggccgcttgttcgtgcacatggatggggcaagatcctgaggagaggagaggggaacctggaggagggagacgacggtggcggtggagctgagggcccacatgtcatcgaagtacgcgagcttggtggggcccatggccctcgccggagctgcggcctccgttcccatctccgcgggggtggagatcaccgccggtgggcagaatggagcgccgagtcgttcgaagttcgaactcccaaatttttggaacaaccttgggtgagatgaaatgaaatgagatgcatatttatagcctcatatgctacaagtcaattcaaatacgcggatcgaaaagaaaaggtagtattcggttaaaaaaattagaatgtcccagcatatagttgaatttgaccaaaattatagtgatctttgcaaaggttttcagaagaagacaaggaagtagaagtaagccggcagctgtggaa

SEQ ID NO: 46673 - DNA, 383 bp, Oryza sativa
tctggtttgcgtccaatcgggtgttgcgagtagcgacactttgaaacgggacgtgcatctcttcttcttcttctgtaggctgtagctagtaactcgtgatggcgatctaatcctttccccatttcgttcgcccagctgttgcttctgggatcaccatggcatgtcatgtatggtgctggttttcttctttgttttaaggagagaatttgcatagactgatcaagtctactgtgagggacccacgtttcacattttttataaacttgattaaatttaaaaatgtttggctaaggaaaaagtataaactacttataacatgaaacggggaaatattgtttatgctcttttgctgatttcttccttttggttgtcttgactgcagt

SEQ ID NO: 46674 - DNA, 445 bp, Oryza sativa
cgatcattctccaagcctaaggctgagttcgctatgggttgttcccaatagcacggaaaacggaacgatccattagcacgtgattaattaaatattagctatttttttcaaaaaaggattaatttgatttttttaagcaacctttgtatagaaactttttgcaaaaaaaacaccgtttagcagtttaaaaagcgtgcgcgcgggaaaacgagggagataagttgggaaaatggacgtccgaacacagaccgactagatactccattacacagcttcaccaaatcgcacatcgtagagacaagtgttgcatgagcagagcaagaaacatggcgagagataagcaatctgctttaatcgtcgcagcgttcgtactcctctgttcaggtaagcaccatggaatgatgcttggtttgatttgttttcaaaatttgcaatgtgctcaaat

SEQ ID NO: 46675 - DNA, 169 bp, Oryza sativa
aaagtcaacggcgtcatttgttaaaaaacgaagggagtactctaaattagtgtctaaatacaaagacttagttaaatcctgatccaaaccccaccgaaatgagaaaaaaggaaaagttagtttttacatgtttttttgcttgtttttctcttcttttttttgggttagt

SEQ ID NO: 46676 - DNA, 453 bp, Oryza sativa
tggattataagctttggaggacgtttgggaaagtactagtatttggaattttgcatgaacgtttgttgttttctttacaaaattacaaatttgtgcattaacatgatggatgttctcagaatactactcttgactgccgttgacatgtgggcccaactatattccaaatagcttctgtacttactagtactattcatgggttttactagcattgtaatgttactgtcaaattaaaggcaaagccatgcttttcactttccattagaaagatcatctaaaaacagaccaattggacccaaacatgaatactctacttaattagatcaatgagcaataaatgagttgaactaattactctctgtttgcaaattaatgatcgtttaactgattaattaataaatgagctaataaacctcgatgaatcaattttttttctgtttttggtgcaacaga

SEQ ID NO: 46677 - DNA, 1501 bp, Oryza sativa
ggagggagtagctgtcaacaagttaattagggcctgttcactttgatgtcattttcaaccaaatcattttttgccaaagttaccaaaaaaatatctacgtttagttgttgccaaatttggttaatacataagaaatcctgccaaaattttggcattgccaaaaacttggtaaggtttattttgactacaatctgaacatgcccttaattaaatcagctccgtgcatgcagcttttgactccatccgcaaaattcgcatgcatggcgacgtgcccagacagcatccaagaagcagatcctttgaacaaatccaagtagctagtccatgttgcatatgatcaccagaaacccaagcggatcaccgatctattagctctctctttaaagttcaagcagaggacgacaagccagcagcacagctagtagctgcaacgtgcaaaaaaatttaggctagctaactctactagcctcttacacacacacacacaaacacaagagtaggaagagaagattaagagaagaaggattgggttgggttgagtgtttcaaaatttgctgctactaggatccaattgccaacttggcacgcacacagtatgaaactgtatgccgtatgtctcaaactgcctctctaataaccaaacaagccgtcactacaagagatcttatcatagcactggtggagaaaccatctttggtcggtcagccgaaattcacaatattcccggttccactaaaaaccgggactaaagatcatctttagtcccggttggtggctacagcgggcatatatgatctttaatcccagttggtaagatcatctttagtctcggttctaaagatgttaggccttgtcaggcccccggggactaaagatctcggcgatttttagccctggatgataacatcatccgggactaattatctccctctttatatgtgtcttcttcctcctccagcccgagcaagcttcaaattttctccaaaaaagaggggaggtcatgccaaaatttcttgtgaatttttttggtgattatatacaaatcggaggtatctaaaaggttagtaacttcatcctccaatgttttttgttgttatattacttttggagctatgtttcacacattttttgtctccaaaactttgtcgtaagttgatgagagaaacaaattgtgtggggaagaagaatatataggaattttgtttgtttacttaaaaaagttttattctcatagtttaaaatataatgaaaattaatcttgaaaaatagaaaacaaactaaattgaaaattaaaagaagtacaacattaatattagtttaaaaattcaaaaataataaataagaattgtttgttggattattttataattattgtatgaataatgatatgtcattattgtatgactattgaaagagtttttaattgtttgatcattattgtatggctgtcattattttatgaatatttatttatgtatgactttttttcatttcatgtagg

SEQ ID NO: 46678 - DNA, 270 bp, Oryza sativa
ttgctgtagttcgctgtgttactttgctagcttaagattgcttgtccgtgtgtgggtttagcatgttgcttacatcaatggtgggatgtaactacatgagtttagttcttttgcttgtcagagagtaagttagctggtgagatagtgttaattcaatttaaatgtaatcatacacagttaagagcaatatagaatttaaattaattaaagttctccgttctaagggtatctctctgtcgttctttccttttgcccatgcttttcttcaga

SEQ ID NO: 46679 - DNA, 1501 bp, Oryza sativa
aatttgcacgtgaaaagcatattaattattctattcaactgaaaagcatatgcatccagcttccatggatagcaaatatacgacttatctaagaaatactggtacatacttatttatatactgagtgaaaaaaagtagtatacgtagtatttaccgatcaaacaaaaaggcagtataacctcctttagcgaggacgatgcagtataccgaccaaacatgacaattagtatatgcagtatactgacagaacaagtagtgcatacagtatatactcaattaataacaaatgtatatactgataaaaaaagaagcagtatatactccttcaatgaggaatgtagtatatatacactgaccaaagagcagttcataccgattgtagaagaaataagtatataccactccgagtagctgttcataccgattggagaagaaataagtatataccactccgagaaaagtcagtatatatactcgttccaaaaaaaaaatcagtatatactcattccgagaaagaacagtatgtactcattcgctcgttgcagtagtatatactgcacgtaccaataaaaagacataatcagtatatatatactcattagttctggagtaagtatattcggctgctaattaaaaaaagaagtattcactgctacaacaaaaatataaggtactccttattaggtactgctaatacacaaaaaactactatatagtactgctcatcacttcaaagagtatatatactgcggcttaaaaaacagtatatactgttgcatactagaaaaggtggggatatctaaggtacgttatcaaatttgaaagcaaatgcatgccaacaatcttgttcaaatctgcacccaatccggtgtgcagctatgccacatgcatgcagtcatttggaaattaatattattaatttttttcatagctaatttgaatgctaatggatcatccattaataaaagggtgtacatacacctgggcgtatgaaagagccatcatatatatatatatatatatatagatatatatatatatatatatatatatagatatatataatgcatatatatgtattgtaacataaaccctaaaccatgcagcaatagggccatgcaaataagaaaaaaattggtagatcgatctttagtccaggttatttcacccaggactaaggatagcgatctttagtcccggattcgtagtcccggttggataaccgggactaaaggggggttacgaaccgggaggaaaaagggtttctccaccagtgtagctgatgctaatttacgtcatgaaaattgaattttaagtcatgttgtgaaatctaacgttcgtgtgacaaatatcattcgtcacctatgtcacaccctaaaaatccgaaatatataaattgttgtttaattggaattattagaattgatattaaaagcctagaagagaagatctatttttaaataataaatttcaatataaaattgggccagataaaatttta

SEQ ID NO: 46680 - DNA, 1501 bp, Oryza sativa
tagaagccctctaaaaatattggaaaagtagaactgttctcctctctttctcttttaattaaaccaaactaatggcacatgcagtttatagtctcttttaatggttctcattcaaaatttatttatgattcctgtgttgttagtactgtacatctattactgtactaatggcccatttaccagcaaaagtttcacaacattgatttatttaatcttgctgcaatgaaataagcttagcatgttgattttataactttcttttattttatttcttttgaaactcgttattaaaaagtgcaaaatttctaatcatgttttcaactgtttcaacttatcttgcaagattggtttactttatttatttaccttttactttgattttctaactttaatttaatccaaaaacttgtgctattaattggataaatgtcttaactctgtcctttcacttgtctttagatgccgcgctacaagcctgagtacttgtttggcactaagggatttgtccaggagttgcgtacgatgtcctttgccataggatttgggactgctcctttgtatgcccagattcctcatgatcgtgatgaagagaagtgccgtgtcaaagtcaccttgaacagtaatcgtgaagatatcccatcggtgatgttcgaggctggttggggaagctacattcatgcttgtcaggaggtggcaaggatcaccataggagagctccgcgaaagctacaatgatcggttggccaacactaagtatcgctaccatcctcgccaaccccagggaagcgatcgtggcagctaccttgaacctgcagggattgagaatgatgctaccacaaggcatttggttgagatgctgtgggccatggatgagacccgcgctgagattgtgatagcagctcaagatcgtgaagacaggaatcgcggcaagatctgcaagctggaggacaaggtggatcatttggagaaggaactagccgcattgacgggagaagcaccaccgaaaaaggccagggtttgtcttaccgcaaggaagagagctctattcgttcctcgctaccagttggcgccaaaggttcgtgtggtggaaaaagaagctaccccagccccagcggatcctccggtcgtcaacgtaagtgatgatgatgaagaagaatccaagcgcacccatttaaaggtcgagtggggagctactcaagatgatggggacgcgccgaacgagccttcaatcaactccgatgcccggaagacctagaacgccttgtcaagccgttgccttagatcgttgtgttagtttgcttgtttaagtttggttgtgtgtgtgggtcttgcatgtgatttacatcattggtgggatgtaaatgcatgcgtttgtttgctttcgagtgattaggtagttggtgagttaagtggtgtgagagtcttcagttttgtaataatgaaactcagttaagatcaataaaagtcaagctagtaaaaaaaaattaatttcctgtcctaag

SEQ ID NO: 46681 - DNA, 1501 bp, Oryza sativa
gaggtagtcagtttacttcaaagttttggaagaaacttcaggaagagatgggttctaagctgaacttcagtaccgcttatcatccgcagacagacggacaaactgaaagggtaaatcagattttggaatacatgttgagagcttgtgctttagacttcggtggaagttgggataagaatctgccttacgcggaattctcgtacaacaacagttatcaagctagtcttcaaatggctccttatgaagcactgtatggtcggaagcgccgcactccgtttttgtgggatcaaacgggagaacgtcaggttttcgggactgatatcttaagggaagcagaagagaaggtaaagatcattcaagaaagattgcgtatagctcagtctcgtcataagagttatgccgacaatcgccgcagagatttaagttttgaggaaggagatcatgtgtaccttcgtgtcacgcctcttcgaggggttcatcgttttcacaccaaaggaaaattggcaccgcgttttgtgggaccttataagattgtcagtagaaggggtgaggttgcttatcagttggagttacctcaatccttggcaggtatccataatgtgttccatgtgttacagctgaaaaagtgtttaagggtacctactgaagaagctaatcttgaacagatagaagtccaagaggatctgacatatgttgagaaaccaatccgtatcttggagatagatgagagaagaaccaggaatcgagttatccatttttgcaaggtacaatggagtaatcactcagaggaagaatctacttgggagcgagaagatgaactaaagtcagctcatccgcatcttttcgccagttcttccgaatctcgaggacgagattctatttaaggggggtaggtttgtcacaccctgaaaatcccaaatatgtaaattgttgtttaattggaattattagaaataattttaaaagcctagaagagaagatctaattttaaataataaattccaatataaaagtgggccagataaaattttattaaatacttcacttgattctatagttactagatttttctgggatttatttgagccaaggaagtatttttaataaatggaattgcatttcggcccaatgccaaaatgaggatttttaaaactttttcaatttaaattaacgcgcgcgcgccctcgccgctgactggtggggccggcttcgtctacctcgcaccgccgccgcagccgaaccctagccgagccgcgccgccgtctccttccaaatttgatcgcgtctttccttctccggtcgaatcaatagaggggaaatgatctccgggacctcctctaccttttctcttttggaatcatcgtctaattttgattggaaagcgccggattcgatctcgagtcggattcctctctctctcccgaaccctaatgtttccatcgcagtcgccggccaccatgggcctccaccgccgcccctagcccctttataagaacccacg

SEQ ID NO: 46682 - DNA, 1501 bp, Oryza sativa
aagtgcacaggataacaaaggatggcatagtatagtctcaattgcttaaatagcatgtaacaattatttcagaatttaataaaatagttaaataataattaaacaatattgatccaacgctatacaacataccctgttgcataggcccaaccattctgaacaaccagtcccgactgcacagttctatctccaaaccaggaattaaccattccaaaccaggagctatcaagttattaacagcatcatttagtatggtgagaggtgtgagactaatcacgaaagacattgttagacccgcccataaccgtgggcacggctattctaatagtttaaactctggccagaggtgtaccactgtacccacaaagacacaacctcaacatcatgtcaaccatgcgtcgcgatacttgacaagtacccgaatagagattgtgacaataccctctatataatacaattcaaagcagtgcaccgttcccggatcataatcacccccttataaacaaggtatggactccccagcgacccccgtgggcttatctccgccacttcatactctggtgctctactatgaaccatactatatagaaagtaaagccgttgcccacgctggcttgtggttgacacggtaaatgtttcacaaccgaaaatcgtgtgctcacaacccatcaaaaccatatgctcacaacccaccattatcaggttttagttggcaaattaattacttaaccaatcatgattaaccatcatgagctatcattaagccatcattaaataatagtgaagcataagttatcccaatagtgtgctaatgtttctaagcatggctaagcaattatgtctaatatctagctgaaccaatatataaagctcaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatactcaaagggttgtttgggatctgtgtgacttgccttgctggccttggaactcttcaaagtcttctcctgcaaattcggactctccgggaacgtcggactctaaagagaaaagagcaaaatcaccaaaacagcacataaacaagcctgaacagtacatgtggatatttttaacatgtagatctcaattttagaaaaatttagagacttgaaccaactaaatgcgagctaagatgaattagttatgaattttcatagattaaatcggattaaatcatttatatagattttaattgaattatgacgtaataatgaattatttttaaaaaggaaaaagggattattgcgtcagaggactcggctcacggtggaccgggtgcacggcggtggttcacggaaacgaacggccgagatcgatctatccaaaacggaccaagatctaacggtctacgaccggtctacggtggacggcgtcga

SEQ ID NO: 46683 - DNA, 1501 bp, Oryza sativa
gaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacagaagcatatgcggcgcctaaagaggcattctagccgactgctttttagtcataataaaaagaatccgagtggttaacactctaaaaggttcacgaatgaacacacttgacaggcatccgaataaaaaactctaaagattacccaccaaacattataaaaattatggtaatgaataagtctaatagcctaagctatgactatccatcataatgaaaacaggcatatgtggtgtaaaatccgagtaaataaactcataaaggatttaccaaccgcctaaggaaaaatgactataatatataatcagcctaagccataatattggtcaataaaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcttaaaaagttgagtaactgcggtataaaaggattttaaggtattgagcacttgatcacgcgcactttggcctaagcgaaaagtgcctgagtccctaaaagaacgtgacaggccacacctgaaaattcgcattgtaataattccgaagaattatatgaccgcgtaaaaaaagattttatcagcattgggcaacactattgtgcgcataagttgccaaagcaaaaaatgcctaagtccctaaggagcacaatgggccacgctgttaaaagtattgggctgaggtactgttcaagcctaagcccattcgcacctccgatacccttaacaaaaaatcacgtgatccaagcgccacttcgtcttccccgccagaactctcgccattttccccacttcctgctacagtacagagctgcgccggcaaactagggttcaccattccactcgaatccaccttcgaaaagttcattaaaatccttcctgtgatccaccgcctcaattcctcacctctcccaagccatccctcgaatcaaatcagcgcattcaggtaaaatcga

SEQ ID NO: 46684 - DNA, 1501 bp, Oryza sativa
actttatgatcttcggccttcgcattattgatcctagtcttgggccgaggatccccaataataacacttttccctttctttttgttaacatcaataggactaatagggagaggattactaacaattccgatcttagacatagatgtaaccgaaatcgtttcacaagtgaccgatgaagtatcaatcggtctttgctccatcaagcttgcatctttgaaataatcatgaaactcatgctccatttgtgaccatgtagaaattgaattaggagcaagtaaactataccatgtagatgcaaagtttgacaaagaaaggggaaacaacttcaacttaagcaaatcatcgctaccggctttaccacattaatcaataaagcggccgatatgctccattgtagtcatagcattctcacctgtgaatttcgtgaagttgggcacctcaaatccttgcgggtatgggaccgaatctacatgttcaggatacggcctttgatatgtatgcatagctactttggattctatttcaccactatcccacaagacattgtcattatcttttccaatatccacatgaccgatttgtgattcggtcttaggtgacaatgctatttcacttccgcttgtaatacaatccgaaccgtcacttagttcggctatattttcaatgatgttactctctaagctagcaacacaatctaaaccattacttggttcggctattccatcggtgtctaaacaagtaacacaatccgaaccgtcgcttggttcggctataatggttgttgcatcattgcacaaatcattaacacaatccgaaccatcgcttggttcggctatacatgatattgcattttcatctaaactagcttgtaagctattgccatccactcggctttcctgagccagagcttcatgcaacacatgatcaatatcaagaaatatctggccattcaatttctctttaatagaatcaagcaatccatcatatgcaatgttggccaaatctttatcagttattttcaaactaaaacatcggcttttaacatctctaaacctttcaatataatcagcaacagattcattgtattcatgcctaaccgatgttaaatcagataacttaagctcagttttattagtgtgaaaataatcatgaaatttttgttctaattgagcccaagtatcaatagaatttgccggtaaagaagtaaaccatgtaaaagcagtaccggacaaagataaagaaaacaagcgcaatttaaaaatatcacttttaacctaccacattgtgctaagaattgatctacatgctcgcatgtagtcctactatcctcaccactaaacttggtaaattcaggaattttataatcacgaggatatgggaaaatgtcataataatcaggatacggctttcggtagtccctagagcgattccttagctttgctaaattctccctgataatatttctaaaccaattctccacagtttcaggccttggtggatc

SEQ ID NO: 46685 - DNA, 361 bp, Oryza sativa
tattatgaagtacggcttctactttttgtgtagtaccaagtatatggttagcatgtgaggctttaactcatatatttttatttcaattcctagtttatgtagtaatactatccaagaaaatgcaagacactttgttactgcaaagcttattgtctttactagactcttatggtaacgttgtgatagaaatgtagtaacgtacagtagtaacaagtaatgctattgtattattacttgtggagagtcaaattctaaaaagaaaagcttttaagaacaatatctctgatgtcatgtatggttttttaaaattgtttgcaccatgatgctagaaaaaaaatgcttatcaaaagtacatccatca

SEQ ID NO: 46686 - DNA, 1501 bp, Oryza sativa
ttccataccccttggcgatgcttgtctctggacgagcacggttacgaacatacttcttcagaacgcccatgtacctctcgaaaggaaacatgttgtgtaggtacacaggcccgagaataccaatctctttgacaaggtgacaaagcagatgcgtcattatattgaaaaatgaaggtggaaatatcaactcaaagctgacaagacattgcaccatattattctgaagggcttctaatctatccggatcgatgaccttctgcaaaattgcgttcatgaaagcacatagctttgttattgttgaccggacattgtctggaaggaaaccccttattataactggtagcagctgtgtcatcaacacgtgacagtcatgagactttaggtttgtgaacttcttctccttcgtgcttattattcgctttatattcgtggagtatcctgatggtaccttgatgctttccaagcattcaaacatactgtttacacccaaatttggcatctgtggacgaaatagggaaaaattgccaaagtttggaaagtaacgggtttccttactcgggaaggcaggtttagtgtttcctttggtttctatcccgagttggatgtggagaagggcctatagagggtaagaccaacccctatataagggacaaggccggttcattgtaaaacccccgaatacaatctacttgaatcgttcttttactatgtcttctattttaccctagtttagtccatctttgtcggtttgcgccgtaaaccgtccgccgccgctacgagagtgcgacacctctttgtatgtttgtcctgaaaaccttccgttttgcccacgagacgggtagttatcctcatatcgatctaaatcggcctagaggctgattttgatctctaaatcggctccgctagccggtttaggttttgtttctacaaaacccatcttgatttggccctttggctagatcgaggtggttggcgactccatatcaccgcaaggcatttaggtgttgtgatcgtgcttgtcgacttgtcaaaaaaattaccaacacgatttttggcgactccactaaggaacgatctaatcggccatatcacggctgaatttcgtttaatacagtagttttcgtcaaattgagagtttgggctaaacagccgagatcaatctgtacaacttatcgctgctgctacgaagttttcctcggatcagtatattcgacggcggtactgtttggtcaccaagtggaattaatctacatagctcagccgacgctatttggtttcatctgccgcagtcagccggcgtcgccgttgtctgtgttgaggccgatcgattcaatcggtttgggagcagtacgctgtccttctattttgctgtgcacggctgaaattttgagtcttcgtcctattcggtttgctatatacaaattcctaaaaacagaagaaatcaggctatcaaagccgatctgccactgcccacataccgaaaatcaggctattagagccg

SEQ ID NO: 46687 - DNA, 296 bp, Oryza sativa
atctattatggtatcgattcaatcaagatggcatcagtactactcatccctgttaatggtgactctgtaccgtgctcctggtagatcctaaatattttagttttaatttattcatttgtcaaaagttatttgtctctgttcaaggttgatttatgttccaaaaagaaaaaaaaattgagtcatgtttgctccttttcttttattttctttttctttgggtccaatttaattaagtctagtttgtgcagctaacttaaaaatatgcattaattccttcctttcaatgttcctttata

SEQ ID NO: 46688 - DNA, 1109 bp, Oryza sativa
cggcgaaactcaccggtgcacggagagagaggcgttccggcagcgggattggatggggatgcggcggccgaggtagctttggcggcggagaagctaacggcggcggtggctctagcggtggcggcgtgcggccggagcacggcggcgagcggcggcgctagaggagatcggcgcgggtgcggtagagggcgtgcgagagcgcggtgaaaaggggaaaagggagagggggatgcggggaagctttataggggctcgggaggggcggacacggccgggaaacccccccgattcggccggcgacgtgggggggagagagagagagagacggattcaaaaccgaatcccgccctctcgggccgcgcgcgcggggcgggaaggcgtggggaagggggcggcgacgtgggcttgacgacgtggggcgagtggaggaggtggggcaccggcggtgcgggcggttggagctgcggctccaacgaccggaggtaggagacgaccgacaggtgggccccacctgtcagcgcccgaaggagagaggagggagggaggacttcggggaagggaggagaagcgggctggtgtgggaaggaatggaccgacggcccaagaaaaggaaaaaggagggaaaagaaaagataaaaaggaaaaaggattttcccagggatttaatattgcactttgcttattttaattggttaaaattatttctaaggctctgaaaattctactaaaattcctgttagcatattttgacatgtagaatccaagaaaaattccacatgccgattctgattattatttgcatttattagtttagggattcaactctaggttaaattaaacaatttcttcggacgatttattttatgaatttttaagcaaggaggggaactttagggcgtgacagcctcaacggggcaggtaggatcacagagcatggactccatgcaaactcaggatgaaaccacttgccccgttgatgagatcacgtagcggacaccatgtgagctacatatttccttcaagaacttatcagtcaaggtatgctcatagttttatgatttttgacttgtacattccgcaagttgctgcttcggttgattactaataga

SEQ ID NO: 46689 - DNA, 1060 bp, Oryza sativa
aacttcgaccctcgagtatcctgctggaatcggcctgcagtggtaagtccctgaagggtcagttgggatggccattcctgatgccaccttcacgtgatgagaggttatctattagtaatcaaccgaagcagcaacttgcggaatgtacaagtcaaaaatcataaaactatgagcataccttgactgataagttcttgaaggaaatatgtagctcacatggtgtccgctacgtgatctcatcaacggggcaagtggtttcatcctgagtttgcatggagtccatgctctgtgatcctacctgccccgttgaggctgtcacgccctaaagttcccctccttgcttaaaaattcataaaataaatcgtccgaagaaattgtttaatttaacctagagttgaatccctaaactaataaatgcaaataataatcagaatcggcatgtggaatttttcttggattctacatgtcaaaatatgctaacaggaattttagtagaattttcagagccttagaaataattttaaccaattaaaataagcaaagtgcaatattaaatccctgggaaaatcctttttcctttttatcttttcttttccctcctttttccttttcttgggccgtcggtccattccttcccacaccagcccgcttctcctcccttccccgaagtcctccctccctcctctctccttcgggcgctgacaggtggggcccacctgtcggtcgtctcctacctccggtcgttggagccgcagctccaaccgcccgcaccgccggtgccccacctcctccactcgccccacgtcgtcaagcccacgtcgccgcccccttccccacgccttcccgccccgcgcgcgcggcccgagagggcgggattcggttttgaatccgtctctctctctctctcccccccacgtcgccggccgaatcgggggggtttcccggccgtgtccgcccctcccgagcccctataaagcttccccgcatccccctctcccttttccccttttcaccgcgctctcgcacgccctctaccgcacccgcgccgatctcctctagc

SEQ ID NO: 46690 - DNA, 1501 bp, Oryza sativa
atcttcctccagcttcgaacttaagggacggaaagtcttcacgatcactagccaacgtcacacgaacacgacacttctcctcgttggggtcatgggaaatccggcgatactcaggagcaacttcatagcctacctcaaaagccatcaacctcagctccctgacgaatcctaacaccttgatcaaatttctcggtgaatggggcggcatctaaagaaacatagaagggaggaattaatgcatatttttaagttagctgcaccatctagacttaactgatttgaccaaagaggaagaaaaataaaagaaaagacacatactaagctattatatatatatttttagaatttaactttttaaacagggacaaataatttttgacaaataaataaaataaaaccagaatatttaggacctactataagcatggtacagtatcatcattaaaagggatgagtagtacttgtgctaacatgattgaatcgataccataataaatgtacagtgccgactaatcaatgaagtttaataaagcgaaataagaaacattttgagaagaacaacgttttgctttcaaaagaaaaggaattaagttaaataaattttgtgcataaccttgcatgtgctgccaacttaattaatttgtaagagaatagagaagagcagttctaatttcccaaaatattttgaaggctacttgaggtttaccatttggcttgtcctaaggtcaaggtggctctgataccaacttgtcacgcccggaatttctatccaaaattccaaacgcttacatgtgtgttaaaccctcgtccaggaatcagccgaggcacacaataacaaattgataatagagtacaaataatcaactatttaatattcgcaaataaaaaaatattacagaggtggatagttcctctcaaagaataacattctacgcagcagaaaaaaaactaaagcaaactacggaacagctatggcgactccactccacaggcatcataaccaggaagaagctcaatcctccagatcatcaccttcactgaagcactcctcttctgatgattgaatattgtaagaatgagcatatgacatactcaacaagtcacacagcaaatatgcaagtgcacagaataacaaaggatggcataatatacctcatttgcataaacatcatttaataaatacttaagagaatagtaaaacagttgtataattaatcaatattaaataaacaccatagaacacacccgtgttgcataggcccaacctcatttgaacaaccaaccccggttgaacaaattaaacctccaaaccaggaatcacattaattaacacaattaccagtaatgaataatgtgagactaatcacgaaaaacattgctcaactcacccataaccgcgggtacggctattcgaatagattaaactctgatcagaggtgtacccatgtacccacaagacacaatcccacaacatgttaccatgcgccttagtaccaccacg

SEQ ID NO: 46691 - DNA, 300 bp, Oryza sativa
gatcgatcagacaaagctgggttgctgggtatttgtagtggtgatacagaaattcagaattaatgaattggagacttggtaataataagcctagtcagaggctttgtctgaatgcaatggacgtgtcactttacaaggagttagcacttgccacaggttgtcactttgattattactaattgggtatttcattggcataatatgtgttgtacaggtgatggtctgacagagtgacaagtgctcatgaaaattcacagtttaatgcttcgatttggatacgtatccaacgtcattttcaga

SEQ ID NO: 46692 - DNA, 337 bp, Oryza sativa
ttcacggtataatggctcggacgccagatgatattcttctgatgtgtggtcatatcctgattgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatg

SEQ ID NO: 46693 - DNA, 217 bp, Oryza sativa
agtaatcaagctaataatcttattactatcacttactccagctagtactactattatagcctaatgatcatcacaaagactccatcgtgattagtttaaccacgtcagcacatctgtctagtaacatagcttgccaagcgccgtcttcacacatatatgtggactgtcactgacgagtgggccttttctgacattttactggccacctctttgtagg

SEQ ID NO: 46694 - DNA, 855 bp, Oryza sativa
attcctgcagcccgcataacctgaagacatcctagagtaccatcgtagaccaaatcgattggagactagaaagatagaaaatgtgatctcctagacaatatatgcttccatgaaggtcgtgacgtcgccacgtcgcccgcccgcccgcccacccgcccacccaagacctagacaagatttttacctggaggatcccaccatgaagggagagatggatgtttctcagcaatgccccatgggggaaatgaggcacccaaattaaggcattgcgaccaccctaacatcgtaaccccatgttctcccgctatccaacctgcaccaacaatgtgccctgtcgcatgtaacgccccgattttcgttcgggtttaaaaatcattaaataatgcattttctagaaattaaataaaagttaaatcaatttaatcaagtaaaataatgggagaattaaaattttcccttaaaaatcattggccgggaatattttgtaatattctttgtgccctaatgtactctccggaattttccgtgaattttcggagctcgagaaatagttttaaagtcacgaagatcatttaatcaattaaaataaaaagagaacaaataaaatcctccttcatctctttgggccattttcggcccaaattcctccccctccttcctctcccgcggcccgcgcgcctcctccctctctcgggccggctcccttcttccttggcccgctcgcaaaagtctgttttgcgtccctccttctctcccttcgccgacaggtgggaccggcggtcccacccgtcagctcctcctcctacctctcgccggccgacgccaaccgccatagccgtccacgtcgccgcaaaa

SEQ ID NO: 46695 - DNA, 270 bp, Oryza sativa
attcaaacttcgagctgagtggtttgtcaaaaggtattcttttagacctgtcccattaatctatgctgtcataactatatcctcaaccatttggatttcgaacagcgcaagccaccaggatggttcaaatggagaaacaaattgaagccttgaaaaaagacaaagtagaactggctgcgcaaagggattcggccttgaaggaggttgaaggtactgccagctagcaatctggacgtctctcttttaaatgcagcagattcttatcataaa

SEQ ID NO: 46696 - DNA, 176 bp, Oryza sativa
gctccgcgagggaaacctgacacctgtccagatcccatgagacgaagatgcaacccatcaaggtcacgaaaacaacgggaagtcggcaacctgtgctgcacagtgcacacagcctttgacagcacgtgcgcagcgcgcgagccagatctagctggtagtacagatgggcagcatcg

SEQ ID NO: 46697 - DNA, 323 bp, Oryza sativa
ggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctacgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 46698 - DNA, 355 bp, Oryza sativa
tgcttgtgccgtattttataattttcgctgttgatctgctaataatatactcccaccctttccttatatttgccgtcgggagtactagtattcaatcaattgcggtaaatactggtgccccaagtttctgaaaagtaagtaatacataactatcatatgatgatgttcccagtgtcatatgtatttcacacaagatgtttcttctccaatcaagttctggttgtcaactactgatagcccaggaaagctaataagatacagattgacatgtcgcaaagcagtataggattgaaatgatgtggccaccccgagtagatggggaacaaagtgacttgcttaatccgccatccataga

SEQ ID NO: 46699 - DNA, 1501 bp, Oryza sativa
ttcagattaattatcattaatattatattaaaataaattttaaaatgttttgatatatttacgattttacttttctactagacaaatttacgtatattgattttttaaactagaatttgagatcctactactagttaaagtttaaaaaattaactaagttttattattctaaagttaaattgctcccctctttctctctctctcttaatatctgacaccattacattttcaacgtactaatcattcatcttacttaaaataatataataaattgtcttattaaaattatataattattaattatcttgttatgaattgtacgtttaaacattgaagataatcttagcataacttatatattcttgtatttattttacataatttaaataataaaaagtaaaacgtatatttaaaattcgacgccatacaatactgaaaatcaaaggagtatttatgaccatataatcgtatttgcacgtggtcctccttgtcggcggctcggtggctgtcgccgtccacgcgctgccttctcgacagggcggtactccacccggtaggtaggcacccgtacggagctcggctaatccagctgaccattcaataattttagatatttaaatataaacttttgtagtgaggctgtgatcagttgttttggcaaaaaaaaaaaatgtatacgacacatatttaaagtattaaacgtaaactataaacaaaacaaattacagattccgcctgtaaactgcgagacaaatatattaagcctaattaatatgttattactaaatgtttactgtagcaccacattattaaattatggtgtaattaggctcaaaagatttgtctcgcaatttgcatgcaaactgtgcaattggtttttttttgtccacatttaatgttacatgcatgtgtccaaacatttgatgtgacggaaaagttggaagtttgaaggaactaaacacagcctgattctctgaaactaataacagctttcaaatggtctcctaaattcaactttaaccattacttcttaaaccaactaaaaatataatattgtgcaattattttgtaagaaaaaattgtggctttcatgcatccaatttaagcaatttactatattatggtagctaacgtttaaagtttttatcagataaacaaaacaccatatttcactttgggccacattttatcacctatatttcgctttggatcacatttcaactaatgttttattttggatcaagtaattttacctccatgatgtttggaccatcctgataacttttttatccaactatatccaatttattatataaaaatagattaaaggatgatccaaagcacatatcaatagtaaaatgtgaagcaaagtgaaatttactcaaaacgaaagttcactctgtgaagtgtcaaattatcaaatccctcctcctattcgttgtgttgtaagaccagtttaaaacaattgatgaagtggagaattaccaaattccccctaatc

SEQ ID NO: 46700 - DNA, 1501 bp, Oryza sativa
cgtttttcgattttaggtccatcaggtccagaactgagaggcaatcacccagatgcctttgaaaggtttctccagatggagcttacagccagatccaagcagatgcacccagcaatggctggtcatgtacctggcggcatgtacgggcccgagcttgacatgaacttgagatacagatagatggatgcgtgtgattgcttatgcagtatgaaggacccagaaacggtttgctgtacttgcgtcaaatagtactctttacccatgccataccgctatgtacctgtgtcaatgagcttgggttagcgtttaccatcaatacaatcgtttggctgcgataaggtacctgatgattcactggtggtgggggttggttgcatttgcatataaatatggagaagttatgaatgggttggtgatctggagtgatctgttgtgaaagtggggaacccaacgaatattgggtgaggtccatcaccgtagcagccacctctgcattgtgtctgtctgcctgcctatctgttgttttcagtttctgtataaatactattctgcaaaagaaagtaccagattgacagacacatttggaagtgtttccctggcctcaccttttcttttagctacagtagcattttatgtttaatttagtttctaggataaaatgctatccatgtaacgattctctggtatttaagcatttaccccctccgttttcaaaaaaaaaaaagagaccaatcctaccaatgaaccttgattcgtagctaggaatttgtttttttttaacggagtagtagttcagaataaggagtcgccgcagaaagatcaacccctcagaacatgacatgttagaaaaatagtgtataacattggtattttcctatactaagctatctgtttttttaaccaaacaatttatatcaatccttcttttaatatatgacttttgcaaatatatgatttttgcacgtatgtatgtaattaccatttattttgctaggatttgttcttttacaaaatttttaacaaaattatatatctatactaaacagttgtggtggagtagtcactaccactgacatgcgatgccattgtagggggctttcacccattttcctgattccctccttcgaatggtaaaaaaaaaacatttaaaataggacagagggagtacaatgtatgatgatttattttcttctactcgtatatatgcaaaattcaatggtaacatttttcaaattaaataaatctagaataggatatcatgttattctaagttggtttattttagaatatattataagtgggtttattttggtagggagcaaacaattcatgggcttaaaatgttgggaagtttctcatttctaggcctaaacgatgctagtactaggcaagtagagtagcagccaaagcggacaccgctaccacctccactacccaccttccttccttcctgaggatctccgcttgaagaagagaaccccaaccctaaccctaactccaa

SEQ ID NO: 46701 - DNA, 463 bp, Oryza sativa
gctaatacattttttttgcatgttgcagaaaatatgtcgtcgtcgtccctcaagccgaagtggtagctagccctcggaggaatttgcgcaggcaagtgatgtaaagatatgattatctagagttaccacatatgattattagacatagcatatattaattattagagttttaatataagattattagagttttaatatacgaaacttagactgaacatatatgattattagagttctaatatatgattattagagtatcaatatatgattattagacttagcatatatgattattagacttatcatatatgattattagagttttaatataagattattagagttttaatatacgaaacatagacttagcatatatgattatttgatttctaatatatgattattaaagtattaatatatggctattaaagtattaatatatgcctattaaagtattaatata

SEQ ID NO: 46702 - DNA, 346 bp, Oryza sativa
catcggtcacccaaatgctgtaactactaatccatcatcatcatcagaattcagagatcaacatctttttttcttcaggacgaaaaaggcgtacctgaaacgattctttggtcaccccctgcgcctgcccgtccagcattttgtgtcttgtcatcctcgccacctcattctttctttctttcatctccttcctctatcgatcgaaaccctataaatctacctgaaactgactttgttgttgtatcaaggagacagcttagcttagctgttgttgttgcagtccagtcagagagcagagggcactgcaccgagaggatcgagcttccaagaacaagtgaagctagca

SEQ ID NO: 46703 - DNA, 806 bp, Oryza sativa
atatttttcagtactgcatcgctatgcagaagttacacattgattttaaatttatatttggtagctttggttggcatacatagtagtgcattgcatttttccctctctgaatatgttcaatgctttttatgattttttttgctagctgatttttgatggggctttctgcaatgcatcactacattgtgcaatgttcatatccttacctaattgtacaccattttcttttgcatgtgtatgccctagtgaattacattaattttgtatgtatgtttgtgaacttaatttttttaacccatgggcctttctctgtttgccccaatttcatataatattttaatgttttgccccatttttgctgataacaaattttgaacagatggttcgccaaaagcgctcaaaattggaggattgtagccagtctttaaatgaatctgatgatattcattctgaatcgttgccaaataatgatgataactaccaatgtgattctagtgataatagtgacagtaatgtaagtttttttttaacttgttacttttctttttactgtgattctggtgataattgtgacagtcatgtaagtttttttttaacttgttacttttgttttacttttgcactaatgcttcattgatatgcatttgcacagttttaatttttctttttttattttcagcatatggatgtaccttcacaagaccatcttaatgtaatttctacaaatgatcttaatgtaatttctgttgtagccatgtttcatagcacatttgcaatgttttaactgtttaatatgttttcttagg

SEQ ID NO: 46704 - DNA, 922 bp, Oryza sativa
ctgctcacacaaattaaacaaaaatgggctattagaaagctagattgaatttttaggaggcttaaacagagaaagaaaaattctagaaaaattacatttattcatgatacctaatctagtatttgaataaataattttccatgttcacttatgtgcagttaaatgtacttttggatgaaatatggttttagccgattaaatttaatttgatttcttttagttgtctgcttcaactgattaatttgagatatcaacttgagtgttaacatgttaccaaaattacagaggataagtttgtgctaatcactgtacacataaatttttccatgattttatcttgcacaaaatattttagagaattaggatgacctttgtttgtatatgtattcccacttcataattgcatctaatattattatagggattacattaaatttcttttagactgagaagatgatatttgagtttaatattaagtccacatgttatcacccaagattaactataggtttgtttagtgaaataattcttttagattatgctcatgggacctattatggaatgcaagaccaaaactccaaatgcacaaagaactcaagcctaggcatgcattatgtacatgtatgcttgatgatatttctagtctaatgttgggaatgaaaaggttttattttgttctcaaattttaatcatgcaatggtttaagttggtcatcacctaaattaaaacagaaatttttggctctcaaaattggagaaattaacctctaactattttgacaagaaattttaagtcctaaaatttcgggtatgttacacatgcattagccattcatgatttacaatgcataacctaaacatatagcaaaccagatatgctagcttttgcttagccctgccaagttagattgcataaaatataa

SEQ ID NO: 46705 - DNA, 1501 bp, Oryza sativa
  unsure (1)..(1501): unsure at all n locations
tgtaatgggaccgacaacaataatacgacaatggtactaatgcatatactacgatccacccgtgaaccacaaagaacgaccaatctcaccaactatgaacgccccgtgacatggctgaattcctctctctctctctctctctctctctctctctctgaatctctgatagtagtacaatacaatgagacgcaatgcatgaactatgaaccggcttctttttttttaaaaaaactaaaccggcagtttgtctctgaatatatgtccagtcaccacccccacacatgatctatcatagntattcagtccaaatgtgatccttcggtggccataagcttttaattttggaggatctggcaggctgatttcatatggagtaatactcatgcacggatgcacctgcccttttctatccaaaggagggaaatcaggtgcaaaagcaggtttaatcctcctgaataataactactatactaactagtggaaccaaaaggtgcacaaaattctaaagcaattggtggccacaaaatccagcacgagcggcgacttcccaaagactgtcttgcgtaggattgcatgcgcactgaaacagagcacttcaattccggcgacgacgatgacaagcaccgcaccatatatatgtggttcatcgatcacaacatgattgattagacaaatgaattgttcattaccaccgtcccacaatcacagctttaacacatgcacttttttttatcacaaaatacagcatgtggtcattcatacttcatagtgcacaataaagactgaaaaaaaaacagagctgattcagtaacagaaaaaaaaaccttagttatagctgaaaattaattaggggtttaatttgagaatatgttatagaaaagatataaactcggagggtaaatgctgctgcctaatttctagacccgtgactgattgacagtatcaaccatctagtgttaagatagggaaacagacaacctgaaaagagagcacaacactgaactgaccatcacatgtgatctctgaactgaacaaacaagaactctactactagtataaactgaatgctttagtagttcactagttcgtattaagtcacagcgaatataatctaggcatcgataagatgaggccgggtggccggtaaaaagcaagctattgggctattggcaggcaggcaggcagctgaaaagctctactagtaaaaaggtaaatttttcacatgaactggtaatagcataaagtattcaggatgtcaatttgaagagaaaaagggaggagtcgtacagaaaagaaaagacagggaaagttagtgctggattgcatggataataaatctcactaattaattaatagtactaaggatgaggcaggagtgagtgctcaatagtgcagaaaggcctcctataaatctgcagcttcactcgccgttaccatccaatccaccccactccattctctcatctcatccgtgaccacactccactctcatccagagcaa

SEQ ID NO: 46706 - DNA, 1098 bp, Oryza sativa
tcaacttaaaccattgcatgattataatttgagaacaaaataaaatcttttcattcccaacattagactagaaatgtcaccaagcatacatgtacataatgcatgcctaggctcgagttctttgtgcatttggagttttggtcttgcattccataataggtcccatgagcataatctaaaagaattatttcaccaaacaaacctatagttaatcttgggtgataacatgtggacttaatattaaactcaaatatcatcttctcagtctaaaagaaaatttaatgtaatccctataataatattaaatgcaattatgaagtgggaatacatatacaaacaaaggtcatcctaattctctaaaatattttgtgcaagataaaatcatggaaaaatttatgtggatagtgattagcacaaacttatcctccgtaatttggtaacgtgttaacactcaagttgatacctcaaattaaacggtcaaagcagacaactaaaagaaatcaaattaaattttaatcggctaaaaccatgtttcatccaaaagtacatttaactgcacataagtgaacatgggaaataatgtattcaaatactagactagttatcatgcctaaatataatttttctagaattttcctcctctctttaagcctcctaaaaattcaatctagctttctaatagcccatctttgtttaatttctgtgagcagtccacccattatttttttagtgcaaccaaagaaaatggaatctaggtgtaatcatctaccaccagtaaaatctacactaattcttctggtctacacattgaattatgtagttacaaagttagaggagaaaataattccgaaaaaaatgatctaaaaatcaagtttacccagaatcttacccaaccctctcaccctagcctagtttgccatgacctggacccacctggcagcctctccagctcgcccttcctctgtccctcatcctcagccgaccaagaaacacatagagggagagattgagagccgaccgagtcctggacgcgtcgacgcgtggtgacgacgtgtcgacgccttcaagtcactgagtcatgcctccatctcctccaga

SEQ ID NO: 46707 - DNA, 1501 bp, Oryza sativa
atcgattgcgtgttcgctcggcaggtctggctccgtgtgatgtcccctcctggctgggctgccctctctccccttcgtggcagctggctccaggattggtggtcatcctccagggcctgtttacctgagcaccactgcagcggcttcgactccttggtactcctagtctcctggcagctgtggaaggaacgaaactccagggttttcgactctgcgctcgcttcggtcgcagtggttatggagtccacccgctcggagggccagctgtggtctttagccgacgttgctttttttggggatctcttaggagtgtagcgtggctctgtcccctcccgttgtttggagttgcgtttttaaccgtcgtagtagttcctagcttcaagtttttttattttgctttttctcccctcctccctttgcataagccagtctggccgattactttgtgtaacaaaaactcttttcttgctaatatattgacgtgcaatccttttgcgcgttctcaaaaaagaagcgcatcaagaacatatatatggtttcaaaagataaaaaaaatggggatgttattttagacacttgtggctatgtaattcacaatataataattctatgtcgttcatttttcatcaatcttaaatatatcttattcaagctcgttatattacatttatgtttggtttgcattccaaatatcatcgtagcgttagtatgtgcatattactagtggtatttaatgtggaaagaaagactaattttcaagaggttagcctagtcgtgcaggagttaaatcaattacaacttctttggtttctttgtttcttgttggttgtaggatcaaaccaactggaacgccctgaactcgaaagcgatctctttggacttgcactagagtaaagcaaacctcttaggctagcgcgtatttttcgcatcgacagctacgcggttctggcgggaggacgaaagtgtaattaagcggagtggtatgtgtaagtgggcccgcctgtccgataggctggctacgcggtacgggagggagggttgttacagttgttgccggtcaccgagcttcgtcggatatggaggaggtagggttgctggagcatgaatcacaaagcaaatctcaaggttagaaattaaatttacaagattttgaccttagttttctattggatgacatttagcaattccgatattttttccattccatgccctagcacgaatcgtaacactcatctgatgactgacaaactaagagttttattcagggaaaaaaaaaatctggcgacagttgtatatcaaatccgtttttgtaattttgatgagaagcagtaggagtcgtattgagattaatctataatgattccgatttggatacaaacacgaaacgagggaggctgcctacagattgtaaataaatataagagatacatcgcgcggtggatcgaatcgttggggttagttttgggacgcgcaacgaaaggtgatgaggtgaggtgggtga

SEQ ID NO: 46708 - DNA, 1501 bp, Oryza sativa
tcgtcgtcctctacgtgtacatgtcctccatgttcgcagccgaccatccaatctccggcgaggtcaccatctcggtccggccaccattgatgatgtcatcatgacatcatcatctttttctttttcccgtttttctaatagattaaatcttcgaaaaatcataactaaataaccgtagatccgtttcaggtggttcaagttgctaaatttttctaaaattgagatctacatgttaaaaatattcacatgtactgtttatgcttgtttttgtactgttttgttaatttttgtttaattgctttagtttccgacgttccggatagagtgtttccgttgaggaaggttccgaaacatttgtggaagcccaaggcaagtcatacagatcccaaacaaccctttgagcatgttgaacccgtttaaagctattatttttatttcaactatgtattattttcgaatatcatcgggtggtgaacctttcccaattaattaatggccgaagatgacccccgtgggcttatctccgccacttcacagtctggtgctctacaatgaaccatactatacagaaagtaaagccgttgcccacgctggcttgtggttggcacggtaaatgtttcacaaccgaaactcgtgaaccggtccataattgtcatgagcacgaccatcaaaaccatgtgctcacaacccaccattatcaagttttagttggcaaattaattaataaaccaatcatgattaaccatcatgagctattattaaaccatcattaaataatagtgaagcataagttatcccagtagtgtgctaatgtttctaagcatggctaagcaattatgcctaacatctagctgaaccatcatataaagctcaactagtcaaattacattaacccaaggtatcaaagaataaagtaatcaagaacaaaagggccataacaaataataggttaattccacccaatgacattcgaaaataaatgcaatagttgaatagaaacaatagctttaaacaggatcaacatgctcaaagggttgttaggaatctgtgtgacttgccttgctggccttggaaatcctcaaagtcttctcctgcaaaatcagactctcccggaacgtcggaatctaaagagaaaagaacaaaatcaccaaaacagcacataaacacgcatgaacagtacatgtggatatttttaacatgtagatctcaattttagaaaaatttagagacttgaaccaactaaatccgagctaagatgaattagttatgaattttcaaagattaaatcgatttaaatcatttatgtagattttaattgaattatgacgcaataattaattatttttgaaaaggaaaagggaattattgcatcagcgggtcgggtttacggttgaccgggtgcacggcggcggttcacgaaacggacggccgagatcgatccatccaaaatggacggccgagatccatcggtccacggctagaccacgagggatgatgacga

SEQ ID NO: 46709 - DNA, 1029 bp, Oryza sativa
catttgttataactgaaataagttatgtaaccacaaggaaacgcttgctctcggactctgctgaggagagccaaggcaaattggctcataccagtgattgaaggaaaaatgtggagtcgtgggcatctgaaattgcttctcatgcaccaggacgcaggatttcggtgatgggggtacagagttactaaagcatcatgcaatgagaaaaaaaatgaagtgctagtatgtgttattaacacaaacataaatcattgttatagaaaaaaatataaagtagccaagagaaaatgataatactcttgacaaggatgatttttgtgcttgaaaatgattgttttaatttagctgattgtgcatacacatactatacatacatgttatagattatagatcacatttgtttgctaaaacaatttgcggggtaccggattacgaactgtacccctcatgtccttgtgtaaacaggattctacatagaactcaaacaagatagataaattggcctatctaagctaggaaagataggtctcccgtcaacatatcctatcgttctcagatgatcttcggttttgtgatctatagtagatcgtccatttgttcctaatttggctctttaggatttctgattatgatatgtgattaattaatttgatcgtccatttgttcctactttggctctttaggatttctgattatgatatgtgattaattaatttcttgttggtttgatttgttaaggcttcagtgacaggtaattaactaatgtatggcagagagtttctttgcattgtggtttccttgttagcaatctgaccaattagatccatcagtcgagcttatctcatggtatagttggtctggtaataagtttctctgtaacctccacatcgttaagctaaatgtggcaggcacatcctgaaggaagtttcttaaatataatgattcattcttattctatcggatccttctaccagtctgttagaactcactcacccataagcatacaatgtttcctgctgccttcttcca

SEQ ID NO: 46710 - DNA, 1501 bp, Oryza sativa
ttttcttcagtttctgacgttgcacatgagacttcctgctcctttccttcgtggccactctcactcatcgctagccactggatcaccgaacgtgcggctgagatcgaagctgggatctctctgtgggagacgggtcaatgggctgcacagctgcatcatccagaagcatttcctgtcgctgccagcattgtcatcgagcacctatacggtgtgcattttcaggttaaaaaaaaaaacggagtatccaaagctatactcggtattctagaagtgaagaaaccggataaacttttcactgtggtatttatccatatataccgactatatactgtatgcacgtgtggtattgagtgcagtatcttatgctccctttcacttaccgtttcaggcctacgactagtcaacgaatgaccacaaagagtttaaagacaacccagaggcgccagagccacatcattatctaagacttttctgtttgactcaactttagaccagggatttgtgcacgagtacatctagatgtgacactgacatcgtgggcccaactcaccctgaacccgtgacctcgtgctgacgactcacattcccggcctcaggtggatgatccccctgtaaaatcagtggaaacaaaaagcttatcatcatttgctaattgcttccactttaaatttacttgccgtgcttgaccggttataatctcgactctcgtaatagttttctttttctttgaagactaataaatagtgtgatactagttctaatcggtttgaagatatactaaaagaaatggtttcaacagcgacaatacggccagtggagcaaaattagatgtttaaattattggtggccatgggtgatagcaataagatcgcgcgatctgcaacatcttccactcctctttgtcgcaagtgatcgacacctctgtgcttccgaatagtttgaccattcatccgacggcagagtaatgtgccggcacatgctacagtccaagccaacggagcatattgtcgtaccttgatcatgaaaagatcgcaaaactcccataaagaaaccatgtcacgagctgtgcaattcgtacacgttgctcagcttagtccttaacttaacttagtagtagctgcataaacaaaccatctagaacatatccctttcaaacaacgccaccatctgaccagcaaaaaccaaacaaaagatgagctaaaccaccaactggtgaactagtatcaaattataaaggaaagcatggctgaaacttccaagcaagcagcacccaaaaactaatcctaaattcctaacaaattcaatcatttaaccaaacaggataatggaggaagaaaagtctgcacgtgccgttcacactgcatataaatggcccacccatgtttctcacggtggagtccgcgatggctgcttgcctcaccgagtgaacgcacgcgctcgccggcggcgaccaagaaaccacgcgaagacatggcattcccgagcggcaaagcctactacc

SEQ ID NO: 46711 - DNA, 324 bp, Oryza sativa
tgtgtcatctcatgccaaaaccgcctaaaagagtgttcaaaggataatttatttggattaacgagtttgggtagcctggtgtaaccgttcagttggtaaattgtcacaatagtttagaggagtaatttgatattttgttcaaacgcggtagtagtacttctaatactattactgtattgttagcaataagcttatgtttcaataagaaaacctttttttagataataataagaaaacattttataacgaataacgtatgtattactatacagcattatcatgtgaagatgtaatatagtttcatgtcgaaaaaaaattatataa

SEQ ID NO: 46712 - DNA, 1501 bp, Oryza sativa
gtgaaataaaaatgttacatcaatcccttttggtaaaaacaaagttctacatccatttgatctcagagaaaacatacatagcaaagagaattacattaagatcaaattaaaataactacaataccaaaacacattacaagttacatccctatcatcagatagagtactaaaaatcacataaaccttacattatatccagaaaaaacttatagaaagaataataaaaagcatcacatcacaaacaatttgtcctcctgcttgtgagcacctagttgcaacacaaatcggtagcacaagttggggataggggggaaaccatgcaaaacacagaacaaatgcaacaacaatgataaacagatgcaaaagcaaaaaatcacacagttaaatcatagatctgaatttatattggcgaaactacacaaaataaatcagcctagtgaattaaaatcatatctacatcacacatcacgttctattaaatcaagagcacaacaacttcaaatcccacatcatgttctattaaatccagtacattcatcctcagatctaaactgaatcaagtccagataacaactagatcgaagattcaaacaccaaatcatacacgaacaacatgacatcgttgtgagaagcaaaacatcacaatctccaaaaagcaaaagcccaccacgcaaaactactagtactggttgcaaaaaaaacttgatccccaaatcctatgcatcaacaaattcgaccacaaatcatatacgaactacccaaaaaaatcacgcatccagatggctaccgattccgtcgacactcgaagggaagaaggaggaagatgagcaagtactcaccgacgaatcaccctcacgccgctccggcggaatcgccagatcaacgccgcggcggaatccctcgcgttgacgacggcaaaatcgccgaaatggtcgcctctctctctgtttctctcacctcccagagaagagaacgagaaaaagttctctccaactctctctctctctctctctctctctctctccgacacggtcaatgccagcaaaaagataggcgcgtattccgaaatttgaacagtaattgtgggttccacatgaaaacaaaaaaaataaaaaaaacgagcccaacctagaagaagcccaacttaagcccgaagaaaacataaaggcaagtccagcccaaacaaaaagtccaactgtcagcccaaacaaaaagtcagaagaaggcccacatttagcccgaactaaaaatagtccaaatcacagaactcaactgcacgaatctcaaccatatctaacagcccaaaaaagaatgattgaggactcaaatatcatgcgacagtaatatagcctttccgtttttaattaccttggaggactcccccccccccgcgtcgcccacgcgctggcgacccgggggcaaaaccctagcagcgccgccgcctttcctctcccccctcccccacctctccgccgccggaaagtcggcgggcgagccataa

SEQ ID NO: 46713 - DNA, 1501 bp, Oryza sativa
agtggacgaactctcatttgcttttcgcccttgtagactttgatgagatgagcagaggcaaccttgcaagctttctcgcccatgttggtgaaggagatatcagaaaacttgtctggcactatgcttgatctctgttcccgtcgtgtacttataggctaggagatgttgtatctgaatggaagacatgacagctaaactcttgtttcattgccgtattagctgagggagccattgactatacctgaatgatgttgtttttttgtataatcttgcagtgtctgttgagatgaaatgagatgcttctgttgatctatttgtgtcaagattgatagagctgtttgtccgcgtgtgatgtgcaaatctttgactagatagaggctctgtggtttctgatgaacagacatgtgtgcatctggtggaacaaactgcagacttgtcatttattctggtcaggtgtggtgtcgtgtccatgtttctcaggtgcaaagaattgttgccaacctgtgatgtcccccaaatctgagtataaaacctgatgcagaagcatttgtggttaagcttgtttattaggggggcaatcatgaggttcgtagcattgtctcaatcttgaaggaaatcatgtccaccattattgccaattatccttgcttgcgtggtagagtagttgcagtccagagattggctgaatgcacgtactggtgatgaatctctgatggatggaagaagtttcctatgccaagacttgatcatcctgaagtaaggtattccctccgtaaatatttttttttaaaaaaacgaacttggaactgaatgtgatatattctagtacaacgaacatggttagaaattctgtccagatacgttgtgactaggacatgtcacatccaattctaaatttatttatttatttatttttggaacagtaggtaggagaagccctggtcctgtgggagagaagcagaagcaggtcgcggcgttcatctcatcactcatcagggtttgtggtcacaagtaactcgtaccatatcttctcctatctcatttctcaactgaatgactcgatttttatggcgcttttcgccactccccgtccccaaatataaaaccatgatttcgcgcagcaactcaggcacagccaaacagcctgaccattaaaaaaaattataatttactgttttgtgttttggtgtgcctgactaaaaatgtttaaacagcacgccacgacggacaaactagaaagaaagaaagaaagaaagaaaaaaaaacatttatccgtttggtaccacggtagtagaaaatatcagcatgaggaattaaattgcgtttggatttatcaggagagaattgatgctcaaaacctgaatgctactagttgtttgttgcaacataaagaagaagaagaagaaaaggaggagggcgtcacacttggcgcagacaaaacaacgagaccgtacaggtagaggtggtaaaggtaaacgacgagagctaaagaaatctggca

SEQ ID NO: 46714 - DNA, 1501 bp, Oryza sativa
gcggctgccgcggatggattcggtggctacggcgacggccgagggtggatccggtggtagggagtgaagttttgtgatgtatgtatgttggatgattatttttgtaatattttgtaattttgggcaaagattggttgaattttgtttttttttgcggtgtgttcatccgatttggttgtgccgattttgggatgtgttccttgtatcgattctgagtgcaatagggattcggggggttttgaaggcgcaccgtgagggacgaaggcgcctttcgtcccacttgtgacgataggaaaaatccgaatatttatattagttagttatagatttggttctcttggagctgtgagaaacaagtgtagtgcattcggcccgcgaaggtgaagaaggcctgctcggactcaaagtttgtgcagcacagtccttttctccggcccacgtgcatgcgcgcctgtgtggcccacaattaaggggagcgtgctacgcgtcggacgtacggcgcgagacgaaaaatcggacgcctcgcacgaccgtcggatccacgcacgtgcgcgccagccatccatcatgtatggatcaagcgaactttaactatttttttctcttaaaatatttatccaaatcatgatccgattataccattaaatccgttacaattgaatctttaaaacaagaccacatatgaatataatctgatgaaaaaaaattagtttattattgaattatttttaaatgttgtacgttgttgcgccaagtatatcggaattgtttcactaagttgataaaaaatgtttcactaagtatatcgaaatttgcaaatctccggacgatgtcgcactgtacgttaaaaaatgttgcaatgtttcattgcttgaaaaaatgtttcaatatgaattgtttcttgatgtttcatctttcactgaaaaatgtttcaccgctttatcgaaaatgttgcaattgaatgcaacactcgagaacgctgactgcaacaacaaaaacacagtatgtgcaacaaccagtactgaccacaaccgtcaccgtcgccggcggtgggatcctccttgatgcgtagcatcctcctcagctcttcctcctcctcgtcccacgcctccgacaggtacggcctcctcggcgccgaggagaacgaggaggcgtcggccggagcagagttgatccagcgatcggctccacgcggcgagcctcctcggtgcgccccgacgcgcttagcttcttgatgagcgcggcgaaggtgcccgcatcaggcctccgcgcgcacccgacgaggcggagcgccttgtcgagctccccatggcggacgagctagcggaggcgatctctggaggaggaagatgcccggtgggacacggcggcggagcctgcgatgcggaggcgcggcctgggagcggcggcggttctcggcgcgggaagggaaggctaggaagggcacgaggcgaaggagaggaggccggacatggcaggcagcagcgaagctgtcggtgcg

SEQ ID NO: 46715 - DNA, 1501 bp, Oryza sativa
aaattccccgaagctctcggtggcggcggtgacctgggtggccggtgggtacccttgtcgatctcttcctacctcccttcttccctacttgttctagaagcgccggtgggcacccttgtcgatctcttcctacctcccttctttcctgcttgttctagaagcttctggtgccttctaccacttgcatctatttagttttccctcttccaactctcccaaaatatactagacttgcactggtagattaccaattgagttggtgttaagattgctgattgggttgctaacagcatgcaggatgaatataatatttacgacaataacttaagtttctgaagcgacaaatcaagctcatccttgtgctgctgctttccacagtagaattcggtggggtgcagaacacgtccgggcgggcagaaggcacagccgccattagcggcggcggtggtgagatcggcatcggccggccgctgctggagcacggtgcatgtgtcgacgaagaagctgtgtacgtagggggtgaagcggatcgagctcagcgaaaaccaggcccgatggtcacgcccgcaccgacagcttcgctgctgcctgccatgtccggcctcctctccttcgcctcgtgcccttcctagccttcccttcccgcgccgagaaccgccgccgctcccaggccgcgcctccgcatcgcaggctccgccgccgtgtcccaccgggcatcttcctcctccagagatcgcctccgctagctcgtccgccatggggagctcgacaaggcgctccgcctcgtcgggtgcgcgcggaggcctgatgcgggcaccttcgccgcgctcatcaagaagctaagcgcgtcggggcgcaccgaggaggctcgccgcgtggagccgatcgctggatcaactctgctccggccgacgcctcctcgttctcctcggcgccgaggaggccgtacctgtcggaggcgtgggacgaggaggaggaagagctgaggaggatgctacgcatcaaggaggatcccaccgccggcgacggtgacggttgtggtcagtactggttgttgcacatactgtgtttttgttgttgcagtcagcgttctcgagtgttgcattcaattgcaacattttcgataaagcggtgaaacatttttcagtgaaagatgaaacatcaagaaacaattcatattgaaacattttttcaagcaatgaaacattgcaacattttttaacgtacagtgcgacatcgtccggagatttgcaaatttcgatatacttagtgaaacattttttatcaacttagtgaaacaattccgatatacttggcgcaacaacgtacaacatttaaaaataattcaataataaactaattttttttcatcagattatattcatatgtggtcttgttttaaagattcaattgtaacggatttaatggtataatcggatcatgatttggataaatattttaagagaaaaaaatagttaaagttcgcttgatccatacatga

SEQ ID NO: 46716 - DNA, 366 bp, Oryza sativa
caatatccattcgggaaagggttctcatctctcaagtggatatccctcattttttttacatgtcatctaaaatagtcataaataatttaaaaagatagattaatatgaactatatcactccacaaacatacaaattcaaatccaacttttacaagttgtaacaaaaacaaaaaaatatataactatgaatgcacgttaattattttcagtttaatttgttcttttttttacatgtaaaagttgaatttagatttgcatgtttgtagagtgatatttcatattaatctattttgtcatttttgtcaaaaatttgatgacatgcaagaaatgagaggaatctcctgtccattctacttctttttcaga

SEQ ID NO: 46717 - DNA, 316 bp, Oryza sativa
gtccatctttagatgtcagacctgttctccgatcgcaagcgccgctccgagcttcagagtcgccgcccttagctttatcgtctttcttagtttgttgtttgctagtttctgtgtttaggtctgctgcttgtgggttagtcggcggtcgatatcatgtgtgagtggtatggctgccttaattaggagttgtttgcttccttttcggtgttttaatcaaaattaagataattgtacctaaatttataagaaagattagattctgagccccctgtttttcttccttttctcatatttctacctatcccccttcagatgg

SEQ ID NO: 46718 - DNA, 383 bp, Oryza sativa
atagcgatcggcatatttaacggggttaattaacccgctaatgacaaattcgaattagcagaaagctgcacaaatcttgaaagcacgtatagcagatgatgcaggagtagctactcccggtagtaggatataatatatatatatatatatataatgattctatactcccaggagtaggtactcccggttccatccaccgtccatcagcgaacaccaccgatcaaatcagcaagcggatccatataccgagcccgttttgatttctagttacgaaaaaaatcctcataatctgaattattccgtactaaccagaacccttttgaatagctcgtattaaaatctcgtgggtggttgtaaacagaatcgatagatcgatctgcagg

SEQ ID NO: 46719 - DNA, 415 bp, Oryza sativa
gttgacgatccaaatagctagctagcctcctttttcccctttagcaaaagaaatatgcttttcatatgactaagattacataaagcctatagaacgggatcctattcagatgacggcatacttaatgacgagcccatcaccaccacatgtcatcctctcctcttcctcgacctcctctttctcctccgctcccttctacggcctttccctctcatgctcgtcattttcaccttcttcctagctatagagaatcgatatgttgacaggcataggcggcgacagagcgggtcgtcaacaatagatctagaggtctaggccccctcccccgttggattcggccgaggtgtacgtcagtgatgagggcagcagatgacaccaatcctgtggcctcctcttctgtctcatgtttgaggca

SEQ ID NO: 46720 - DNA, 211 bp, Oryza sativa
ttcattccagaccttttgtatttctattttctttgttcgcacgtatttctctcttgctcaatgcatcggggaggacaactagagatcgtcaacacattttataaggacttggtcgctcgatacacatgcacatttagttcctcccggtaagttcgtcgtcgactcgtcgtcggatcgtcgcccggagccataatgcaaacgctcgacaagc

SEQ ID NO: 46721 - DNA, 624 bp, Oryza sativa
caaaagtgtgtacagtacgatgccatgattgtactgaactgcagggcaatcctcagatcataatagtgatttctgttgcaaattaagagagcaagaaaacagctacagaatgctggtggctcatcaataatacagcagcagcagcatatggaatatcctatggtcctgctgttagagcgtgtgaacttgcccacttttttggttatcactctagctatccaaacacctttacttcaagttagctgcgtccccaatttcctcctgtcagttgtcatagaagtttgtcagctgtgactaactcacaggttaatccctctttcacaactgtggaaactattgattgaattcgataacttcatttcttttcgttacacaccattccgtggcaattaatttgcttcctccataggaaaagttgccaaacatggaagctatctgaagccactctcgggagtgcatatcacaagggttgctctcaggaataacacatggcattgatccattccatgatagagatagtgcatgggcttcaagctgacaatcacactctactgcagctcaataggtggaattactgcttgttttgataatttgtttctatttactactttctactgaaccaga

SEQ ID NO: 46722 - DNA, 360 bp, Oryza sativa
caggctccatttcccttgctcgaaaacgtctttgaggttgtgacatgaattgatttgatgatcacaagtcctatctcttcccggtttctctttccagctttcactttgaccttagaatatgttacacgtttgttttgacactttctccggcctaagttgagtgcaaaactgaactcttcaagtagctgcatacttgcattcttcccatcgtttcccaacttcatatgtagtatatcatttatggtagagtttttgagtgttgaagcccttaacattggcactgtagtccttcctcagctccacataccaccatctattcattttaacacaaagattttcctcttgttcctttttcttaga

SEQ ID NO: 46723 - DNA, 907 bp, Oryza sativa
gtgtacttgtgtagaacctcttttaggccttcatcctcgcttcgctcaaaaggttttaacatgtaagcgcaacacattggaatgactagtattaattactatatgctagtgaaactaaatgtcaaatggaaacgcgttgtttaaggacatgctcaagatttaacccaaaacctgaggttgttagataacggcggcacaagttgcttgcatttgagcatgtcaaatcattattatgtgtcacattgaacatgaaaggaaaagaaatgttctttgaatgcacgattttcgtaccgagagctcctgtgagggcggcgaatcaatgctttgtgatttgatttagacttaaagtgaccaattgctcatcaaagcagagacaatgggcattggatctttaggactttctcatggaaagatgttttctacttgttcttagtagttgctaaacaggctcaagctaatgttttagtgctgaaacagcatcctatgctctacagtagaagcaatgtatgcatgatcacaattatatactacttggttgccaaaactgaaagctttaaattgttccattgcactatgagaatactgttattccaattggttggttgcgccgttttctcaatgcaaatcttccatactgaagatattccgatgtcatcagctaatacttgcccacccccctcaactccaactcttgtgtttactcttcgtcacgtgttgcgaaaacgaaacgaaatcgaaatcatccttgcagatgccatgagcaccatcaccatgcatggcatatggctccctataaaaccatgacattaccaaaaacaaattgctcaaactaggccaccggatcaaactttagttgagagcaaaggaaaggcctctggttttcctgaaatgtggagggcaggatgca

SEQ ID NO: 46724 - DNA, 1501 bp, Oryza sativa
tgtgctatgtgttgattgtcatttgcgagacattgaaatgtcttagagtatgcccagggcattgactcgatgacgatcacttagacctgttcctaaggtcctatcataataagatctgtctttattgactgacaccaaatacaagtgggctacctcacagactcctgaggggaggtgagatgagcagcaattcaagttgaatgataatctagaggattgatcacctagtctctcccagcttttagttctcggaagcttttccggagaattgggatgagaagactttgatgtttgctaggttcagggggagaacaccctagaacatgacccacaatatggaccgtgtagtccttagtgttgtactctttttcccttgagtgagtggagctgttgttcctcacataaggtttttaacgaggcaacaacgtgcaatgcatgagcgataactatgtactctttctcctagcctttttcccactgggttttggtaggagttttgacgaggcatgagttggtcgtggattagcctaagggggagtgttgtgaaacaaatctcttggagataagtttcttgtgggctaatccgaaccggagtagagataaggtctatctcctcctaagacccctatctatacaggggcaggatgtgacatctaatggctaatggctggcttgtactccagatgagatctataatgaagagagagctccaccctatatatgtgttcattgtctacttctgtaatgttcttgagggcaaagggatggacgcgggtgttctacatcatctcatgcctctactgctgtgggagggacagtgaacggatccggtgatccgttaataggcgtgttggtttacaacacaaagagcctcaatcccgaatcctaatcttccctgcataaatcaacagaagagagaagctcctcaatgtttcctgcaccggattctccgccatacagtggtcaagcttcgtccattatgggctcaagaattgagcccatagttcatctgttctttgcaaacggcccaaagtttatcttctttccttctgacttctttgtgaactgaaaggtaggccatggtttcgtggaagcccaaaggcctataccaactctattatttttggttactctactttaataatggtgtcatacacaattatatgcactagactcaattgtcagctggctttatatttgtttgttgattatttacgttgcattcctccagaacaattcctatgtttctcgcaatcatccggatacccatcctataaaagtcatgtacttcaaatcctctattttgcttacacatttcctatcaaatttctcggcttttcctatttctccatttttaatattcctatattccgaacaagtcctacgagttaaaatggatttttcccccttgcttcagagagtcaatatattgactgttcagtcagactcagcggtggagggcaagtcaaaaacagtgggaaaaataaggtcggtggagaca

SEQ ID NO: 46725 - DNA, 661 bp, Oryza sativa
ggagacatttgtccatatatgcagtgagcctagacatatacgaatacagtggcatgaatactgtattcttccttcttccgaagggttatcctcaacctcctagttaggatatacaggtttgcaaaaaccaccattgctatcaaatgtatatgcaaccaacatgcaatactttagccaaatgcactctccatggattaatgctcacctagtgccattcaaactcacaatcgattccggatcgacgtgcattacacatggcatgtcatatgcttaagaaggcaacctatggtggcaaaatgcattccgatgtgctcaacaaggagtatgatagcaaaatgcgcggccactagcctgcgctgccaaccatattttgtggtgcagagttgttttaaagtccatcttgtttaatgcccaagtttgaccccaattactcataacaaactctagaattgggtcatagttaagcagcatgtattaggtaccatccactagcgaattattaaaccacatttgctaatgtcccctggacatagccatcgagagataatcaatacctccaacaatggtaatattcacaataaaaccattatattcagacatatccacaaaaatagtggaatgtgtcggtgcaaccgtcgttggtataacgaagctcaacgca

SEQ ID NO: 46726 - DNA, 268 bp, Oryza sativa
caaaagaagtggtttgttatctctcaccttttcccttcaacctattgtgcttgtggtcatcgaccagttgtggcaaaacactgttattctagctagttggatgtgatatatcctaaattatgaacatagcctaaaatatgtcatattcacctaaaattccttatgttttgggacggatgaatatctcaaagtattggagtactgcaattactgaacagggagggaacaccattacaccaagcaataagataacagggaaggaacaaaa

SEQ ID NO: 46727 - DNA, 792 bp, Oryza sativa
agcagtgatctgccgtgcgtgaccccgccgattagagacatcctgttcccatatctgctgtttcccatcgacacccagtgctccactcaggtctgatcccaatccgctgcctgctccactcctttgattgttattcccctttcttccacataattgcacacttaggcagattcaaccaaattttgtttttcagatatattgtgatatagtgttacacaatgagaattcctcctcacaaataaatggctccacgtgcttctgttttcttggaatgctatacgttagtttttagatgcagcgattaagcgagtataatctgtgagctatctaagtaggatatgacttaattcgtgcaaggttaatcgcaatagcagccatattgtagattagtattcttgagaaatgccatataggaaatggatcatttcaccaatcatatcattttattcctagtttcaatagtaaggcaatgaatctgcatacttcatcatgttaacaagccggcccaattaactactgatcaatattttttttggaaaataaatttcatttaataatgccatggattggagaaggttgagaaaacaaattactagacaagattcggtggtatccactttagacttcttattggcaaagtcttgaacattttaggtttatatattttgggatgaaatgctaggctcatatattttttatttgcattctccttcttaccctctgagtaaataactgaaaatagatgttttagcttcttttcaattctcagaaatttcgctaattttcacaagt

SEQ ID NO: 46728 - DNA, 255 bp, Oryza sativa
tctgcagctttcaaccagattgatacctactttgctggccaaaaatatttgatgagtaaaagctttcaaactcagttgcagtaaagaccttctaaaggggaagaaatgaaagaccagctttgagcgaaaatcgggggattagtggaaaggcgggatgaaactgtttcttaatttttcaacactctgatttgagcagaaactctatggagtgtgttcattgatataccaataccttttcatttcttgattaccaga

SEQ ID NO: 46729 - DNA, 153 bp, Oryza sativa
gcgtaaagtgaaaatgggggggaataaacctcattccccgtttggggtattccaaagcgtaacctaggcaacaaaaaaggggcccgatccttcacctaaaggaccgacctgttggttcaccaaaccccgacccatggtcacacgttttccagg

SEQ ID NO: 46730 - DNA, 1501 bp, Oryza sativa
tgtttcagtagtcttatggcatgtttgtattgtttgctttgtatgttgattagattccggctctcccgacgctccggtgtactttgaaatagtcgccgaggttccaccagcagcagagcaaggcaagtcatgcttgtcacttgaacatgttgatcccatattacaaatgttctatcgttttcccttaaatactgtattgttttataatgttactatgggatgtatacctactgtacagccatgctatttttgtaccatgctcctttgttagcttgggatataacatgactagatattggactagggattgcttagccatgcttagttcaactagcacacaatgggggaatcacattaatgcatagacttcaggttctagtgttggtgttggattaaagcctccgtcctggtgttagtcaattaaaatgcattaaatggtgggctgtgggtgcatggttttgatggtcgcgcccatagcacttaaggatcggttcgcgggatgccctggaagaacttatcgtacttaccacaagccagcgtgggcaacggctgggcttgtagtgtagctttcctctagttgacgcatccaggcaagggtgggcgtgatggagcggggcgggccctgcgacggcctctgtcgcttccagattcacctaggcacgagaggggactgcccgttgcccgctgcggacgggggtgaaacctgaggtgtggtgtgcttggctagagggggttatgcgaaagatcctgtcacggcctctttccggtatgtcgtggtggcatgtcggcgcacggtaacgtgtcgtggggctgtgtgttgtgggtacaattgtacacctctgatcagagtaaaactattcgaatagtcgtgcccgcggttatgggcgatcaaccagattcactgtgattagtctcaccctagtctagtctaatggaattggttagttcaggtggatggttgggcttgtcgcaacgtggtgtagcgttggacagtggatgattaatattgattagttactacaactgttttactgctttcaactactgtttttaaatgctcgctttatgcaaatgaaccgctctacctatcctttggttatatcctgcatcatacccctattccggtatgatttgctgagtacagtgggtagtactcagtcttgctctattttctcccaaaccccagagtttgagtacgtgtcagatggtggcttctccgaagagtaggcttcgtccgtgccgtcaatgatgcatgtggagtggtgttcccgctgcagtccaagtcaaggcttagctccagttatcatttaattttccgctgcatttatgtaagacttttatgatatttgtaagacgtggatctgtatgtcaactttgtcgtttgtgtaccctggccggtcctggacgggggttttaatgcacattctgcttggaattctattcgggaatttctaggcgtgacagagccattggatgcttgatagtggatgcacttaacaca

SEQ ID NO: 46731 - DNA, 1126 bp, Oryza sativa
gccccacccgtcaacaagggtggcgggcgggcccgcccgtcagcggggcgcgcgcgggaagggccgagtgggccgcggggaggaggagagagggggagggagatgggccgagccggcccattagaggggagaggtgatttttagggtttttctttttataaaatcattttaactttgtttatttctgaataattattatttgtgctctgaaaattccactaaaatttatttacacattttaggcttttaggaaatatacaaaaatcctccaagccctatttgacttttaactttgcacattttaatttttgaaggctttcacaagcattttaattattctaggcataatttagaggatgtattttagggtcgatttgggaagcgacacggttcatcacacattatttgatcagtctggagttttggtgagtacactacaagatgtgatcaagaagatagtacctgaaatagttgctcaaaagaattagctcgggggcaagcatatcaatatcagccagaagaacttcgtcaatatgggtatgatgaagaatatcaatataacaatgatttggctgatagaattgcaaagataatagaagagcagtttggaatcaaacataaggaacatacttctgcgtatcggctgccatatcctgagtggtttgatagggtgccattgctacaccgatacaaagttcaatatttcgccaagttttcaggcaggatgatacatctacaatggaacacatcagccgattcttagcacaatgtgggcaggcatcggctgaagaagctctgaaagttagattttttcctttgtctttgactggatcggctttcacatggttttcatcgctaccatcagattctatccaaggatgggctgatcttgagaagcaatttcatgacacttctttgctagaatcaaagagttgaagctttcagatttaataacgtttgagcagcaagaaggagaatcgactatggattgagtctaagtgatgaacaactcgcagatcttgcattccaaggattgtcagcacctatcagagagagattcttttgccacgagtttgatagtctagctcatttaatgcagacagtaccggataatgaaagccgattg

SEQ ID NO: 46732 - DNA, 1501 bp, Oryza sativa
cgtgcccctcttgggagccattagtctcatcaaattgaacatcggcggtttcttccacaatacctttgttcttgttgtagacccggtatgccttgctatttgaggcataacctagaagaaacccttcatcacaccgactttcaaatttggttagtctaacaccctttcgataaatataacacttgcaaccaaaaactcgaaaataggcaacatttggcttcctcccaacaattagctcataggaagtctttttcaagagacgatgcaaataaagcctattgattgcatggcaagcggtatttatggcttccgcccaaaagaaatcggaaacaccatattcatcaagcatagtccttgccatctcaatcaatgtacgatttttcctctccactacaccattttgttgaggtgagtaggtagcggaaagttcgtgtttaataccaagatcatcacaatagtcctcgatattggtattcttaaactcggaaccattgtcacttctaattttcacaagagtgcaactaaattcattttgggccttttttgcaaactttttgaaaagctcggcaacaatagacttatcatgcaaaaagaacacccaagtatagcgagaataatcatcaacaatcacaagacaatgactatttccaccaatgctcttataggttgttgggccaaacaaatccatatgcaagagctccaatggtctagatgtggacatgatacttttagtaggatgagaacatgcaacttgcttgccggcttgacaagcactacaaagcttatctttctcaaacttcacatctttcaagcccacaactagatcacattttgaaagtttgctcaattgattcatgccaacatgggctagcctcctatgccaaagccatcccaatgaagtttttgcaactaaacaatttttcaaatttgcttcactagaattgaaatcaaccaaataaagatttccatatctaaaacctttgaacacacaagacttgtcaagaaggctagaaacaataacttcttgtggcaagaaagcacatgacaagccaagatcacaaatttgagcaaccgaaagcaaattgaaacttagagatttaacaaaagagacattatcaattgacaaatcattggagatagcaattttacctaacccaattacctttcctttgctattgtcttcaaaagtcactttctcttgttcattccctcctacttcaaatgtggtgaacatagccctatcaccggtcatgtgttaagtgcatccactatcaagcatccaatggctctgtcacgcctagaaattcccgaatagaattccaagcagaatgtgcattaaaacccccgtccaggaccggccagggtacacaaacgacaaagttgacatacagatccacgtcttacaaatatcataaaagtcttacataaatgcagcggaaaattaaatgataactggagctaagccttgacttggactgcagcgggaacaccactccacatg

SEQ ID NO: 46733 - DNA, 404 bp, Oryza sativa
aggatcagttaaatgttttctttggacaacggatttggactcattcaggcctcgtttggatgtgtcgaaatccgaaagcccagtccatatatgcatgtatgggatttcagttcacttttcatggcttacatgtggatggactgggattgaggcccatccaaaagatatgccttgggagaactatgcaaggtttacatgaaattaagatgcatccacatctctgaatcttgatgcatggctttagtattacatgtttgtcagggtgacctatctttaattgactttttttttggtgggggaatgggggttgggggttttatacaattcttcataccgataaacagtcttgacttgatgcattatggcgtcatgggggtcgcaggtctcatcactttttcaactgt

SEQ ID NO: 46734 - DNA, 1501 bp, Oryza sativa
aggtgagattcaaaaattgaatcccggccgtctcgagcgcgggcgcgggcggaagagagagggagtgggcgcgggcggcgtcgtgggtgacgtggcccgggagacgcgggagcgagtggggcggcggttgcgggatacggcggcgccggttggaggtgggagacgggcccgacaagtgggccccacctgtcggcgacccgaagggaggagggaggcggccggctcggctgggccgtggccttcggccggcccaacggggagggggagaggaagagaatgggccggcggcccattcgaaaaagaaaaaggagggaaaagaaaagaaaaggaaggaaatgaatttcctaggattaaatattgcttgtgctcgattttaattggttaaaattatttctagagctctgaaaattccactaaaaatcttgttagcacatttcgacatgtagatctcaagaaaaattccacatgccaattccgactattattcgcattaatttatttagggtttctctcttgcttttacaccgatattttcttgaggccaattaaatattcaatttaggcttgggaaaagaacttcagggtgtgacaggctcccaccggtgcggtagttcacctacaaaagaagatcaagctcttttaggtaccaaacttgtttgggtctttggagattagagactaaagctttgggcacccaaatggcattctttttaccaccgagtataggggaatccacatatctagcaacaatgctaccatcataagccttcctaagcatataatgggaatcaaacatgcatgtcttagggggcttactaccggggcaatcattcaccaaatgcccaacctcacgacacttggagcaatacttaccattgctcttgacaaaacgagtggcacggtgagaaggtttcttacccttctttggaatgaatccaagtctctccttgttaaggatgcaccgttgctcactcaaaatcttgttaagagtgttcttacccttgaagcacctctccaaactcttgttgagcttagccacttgctccttaagcttattgttctcaacaacaagtgaggcatcacaaatagaaacacaagggctagagccagagctaggcatatccacaagatcattaaaagaggtagaaatgctagatgatgcaacatgagcaatatggcaagtagcactatcatcaagcaaatcacaagatatgccaacatcaatgagagctctatgttaagtagtggaaaggaggttgtcatgagcttccttaagcttctcatgagaaatggtgagtctctcatgagaagtctttagctcctcatacaagacctccaaagaagcatgatccttctttagatccttgaacttgacaatctccttctcactataagcatagagctcctcaaacatactcacaagctcatcataggaaacatcatcacaatcatcatcactcccaccatcactaagagatattaccttagaggagccctttgc

SEQ ID NO: 46735 - DNA, 1501 bp, Oryza sativa
tttcggtcctcgcgacgtgacgtggttttagatcaagtcgccaaaccaagctaatttaggggtggaaattccaaccacacatggcaaagaaagcgttttagaccaaagccatactcgactcgaccatagcatcgtgtgcaaatgaactactagtaccagctcgtgggaattgaagctgctcaaccataagaaaagaccataatgaagatcatcggcaccgtctcgaccgccctactgactagcttgatctgcttccataccagaaacaggcgaagagcgtggagttgacgagtcatgggcgtcaagcttttggccgacgagtcctactcccctaggacccctaccaaggcaggacgcaacgcatctggcctgggcggcaaaacacgttcgctgaacccgtacgtcgctgggaaacgaccagccaccacggcaccaccgggcaggcgcgcgatcacgacgacgacgacgaggacaccgaccgccatctgctggtcgtgcgggctgccagaaacgcggccggaattcttcgttttttctggcccgcccacccgcttcgcccggctaattctcggctccgaatttagccggacgaagtggcgagcaacgcggcccccgcctcgtgccctcgcgggaaaaacgctatcgtcgcggctcggttgactgggagcgagagtgacggcaacgtgcagcatcgccatggcgtgtggctcccgtgctgatagcgattcgttttctgtcttcggttgcgaaatcagatgcctttgtttatccacggaacggtgtaaattctactggcgtcgcttttggccaaaatttaccttttcttcaccggttacagctggtgcaacgtaacaggtggtcaggtggcgtggctggttgagtgagcggccaatccattccgtggtgtaaccatcggaggattcacttcaccaataatagctccagggcttttgatcatttggaataatagcaaaagatgagaggataaagatgtgcctggacgaaatgcatgcatatctgtaggcagagttttccatcgtagaaacgagaagtgacagaagaaaagaggcagttagccagttaacttcaaaccagatgtcagtatacgaatacgtgcttggagttaagccttaaaatataaaaactacaaataacttgagctatccgtgtattagagcaagtttaatagtatagttcactactagctccaatttatttatagccaatctaatagctaatttatacaataattacttactatactattaatatatggtcacacctgtcatacacacatagcgtcttggagtccgcgctgcagctggctacagatctgtagcccgctgctcttctctctcatattttatctcattaaaataggtttatagctggctaataacctgctattgtactgctcttagtagctcagcaaatggttgcaattaagatcgtgttccctgcgggggaagcatatgagtggacacttgacttcactcactgg

SEQ ID NO: 46736 - DNA, 634 bp, Oryza sativa
acgacttagccgtctgcgttcatagagataagtatatgcgtgttatgagtgtttacgttttattatgtttctaaaaagaaaggtagccggatatatttatactctaaaatgggtagagtaaatatgaattttatgttctttcaaacaaaaaggaaaatgattaattaattactccgtggctccgtgacgtgcacggcagtttgtatgtagtgtaaaatttgtgctaattagctcgcgcctcaagatgataacgtagctaataaggtacagtaatttgtcgaagactgagaaattaccattaaaaaaagagctctgtctcttttctaatactctaccatatatactgggcatctagtacacatagcctgtacagatgtactctctgcgctatatttactgatacaacaaaaatatgtagaaaaatatagtactagtacctgtactctataaaggtacgtactgtacaagcttgcaatagaaaaaaagacgaaaagaaagaatcagacgctcctctgctgtgcagtgtactgcatctagttacaataactactgtagaaattttccttgagaaaaaccaatggaaaacagggagatcttggtacgttatactgccccaatagtacacactacggta

SEQ ID NO: 46737 - DNA, 163 bp, Oryza sativa
gcccaaatttttcttgcggcccaggtactccatctttcacctgggattaagatattttctttttctccctccaaagcaacacgaagggcggctaatgctaatctgaaatctcctctcgccatatgggttccggttctcctctcccctgcccatgtcgcttgcc

SEQ ID NO: 46738 - DNA, 441 bp, Oryza sativa
tcattttaggccttgtttagtcctaaacttttttttttaaacttttaactttttcatcacatcaaggcatggctacacacataaacttccaattttttcatcagatcgttccactttcaactaaacttctaattttgacgtgaactaaacacactcttagtcggaggaagtacaaaagcatagcaggtgaagaatagatctcatgtgtcagcaaaaaaaaaaaattgccagttaaaattcttatatctatgtcctcaaccatttagaagcaaatgataaaaacaaaagtgaagtgtactttagaccatgtttattggtaaaacttcactttggaccatcatatacataatatttttcagtttgaactagttaacttttatctttattgcataatggaccatcttaactctattcactaattatgtctcgcgtttccttagg

SEQ ID NO: 46739 - DNA, 1501 bp, Oryza sativa
actaaatcaaagcaacatttgtgatttccaaggtgctgtatatattaattttgcattgttcagtaaaccatgagaaatgtcctgtggcgaactaaacaaagcaacatctgtgattttcaaggtgctctatgcattaattttgcaatgttcagtaaaccatggggggagctcagccgtatcccacaataaattcatcctcaaaatcaaattccatccccattgccaccttaaaagaatccaaaacaggcatttgaagatttccgcgcagattctagcccccaagggtcaagggttaattcaattagcactaaatatcaaattgcacaaacaaggcatgagacccttgacgtcatgagtcctcagagaagcagcgcatctcccgggagcacttgcaagtagagatgaaattgaaacattttattccctaagcagaatctcaagtagataaattaatagctacgattacctcaatctcctgccttagattatgtatatctttgtcagtcttcccatgcttaaggataaacttcatagctaccgtctgaaacaaatttaaacagaagcaatcaaacttccgagcaaaactagcagaaaaaaaaaagaaaaaagaattaaccattccatttcaccgtacgagcggaatccagagcacgaacctggcgagtgtacttgcgccttcccatgtacaccttcccgaaggagccctccccaacgagcacgatgacatggtaatcttctatccccatcaccacccacccactaggctcacacaaaccctggtagcaatccacaccgcaacgattaatcgcgcgaaaatcaaagcccaaaaatacagtgaaggtgggggaaaaaaatagtcaccggtgatcgactaccgcctccggagcagcagcccgggtgggcggaaccctaccttcccaacgacgagacaatcgaggaggttccagtcgagagggggacctgattcgtgcggtgcgcggcgccgcgcggccgatgggggaagcacggagcggaggcgggggatctcgcgagagcagaagacttgggggcggatctcgtcgggggctcgccggagatcgccggatccggccgccggaggggagggggaagggaggagctcgtggggggataaggctatgggctttctctctctacagggttgtgggtgggatattcccctcaaattctagggtttcaattattttcccgctcgctgcgcgaatttggaactgacgaactaggcgtcgcggatagagaggacaaagctggctaacggcccacttcttattgggcctagtaacggctagtttcagtctcacctgcatatttcacttggaacaaagtcaattaagtaacagaattttttttatttataattttttttattaaaagttttacaaaaataattttccattttgaaaattgacggaagtagtcgcctactgccctctgggaaaaatcgccctcccagagggcggcgaaaatgacgtggcagccggcc

SEQ ID NO: 46740 - DNA, 278 bp, Oryza sativa
atggacggctcagatcaattcaaattaatgcccctaaccctccccctcccccttcccccagctgagccggccaccaccatgggcccaacgcctcctctccccctccctctctccccaccggcgccgcttcccctcccctcccctccggcggtgccgctccctctccccatctcccgcttctccccctcccccaagctggccgcctcccccaccaccggcgccgtctctcccaccaccgatgctgcttcccttcccttctccctcccttctcgccggca

SEQ ID NO: 46741 - DNA, 1501 bp, Oryza sativa
gtgcagtcgatggctcggcgcaaggaccatcggcagtgatggcggcgcggcatgaggatgaggaggaggagactgctgtgctgttggcgcgacagtggcatatggtgcgaagaggaggcggcggctgtcggtttggcgcagtgctgcgggaagagaaacggcaaccgatcgagtgcggttctgccgagcccgtgtggggtggggatggggtgcagtgttgccgcgttggcgcgtccgtgcggttagggttttggcaatgtgggcctggtgggctgggctgttcggctgatattggagccgcttgatgttattacctgatcgagaagggcagagaaaaaaaatcaccggcgaaggtcttgtcacacgtaatgagagctagggcttacaaaactgcgcggtaacctttttttcaatttttgaaactacggtatgtcttgtggttaccacgcggttttcgcagtgaaagctttaccgcgggggtgcggtaaccgcgccaaaaacggtaaggggaaccctagtgagagggacatggacggtatactctggcgccgtgatgtttttttagaagggtattttccctcagataacccaatctgaaattctatgtccaaccgaatatatgcaaccttttttaaattaggaacttagtactcaaataaccaatctgaaattcgctactatggagatttgaactcggatcttaaggtgctactcagttcgctgcaaccactaggctacatgtactttcacaacagttaattcgtgccgtgatgtttaggaacatgatcgtgtgtgtgtgaggtggtgatctattaaccaaagctctcgtccaatattttactttgttgacaacagaacttgtgggcatgtattatctaaaaaaaagaacttgtgggcatgtactgcaaacaaatgagtttatgccatgtcgaagagagcacagacagaagtatttgcagggagcaagcaagccacgtccggctagaggcactttgcttctacctgatttggtcataaggtcattcaattatcccagggtgcctgccgaccgaattaactgttgagaaattttcatactacaagtaatcacatgcataatcaaaacattttaattagattagaataagttgcctatggtttgtaagccagttttctataaattagtttttcaatcaagattttgaatctaaggctgttttagttccatgccaaaactggaagtttgaaaaaaaaattgaaagtttatgtgtgtaggaaagttttatgtgatagaaaagttagaagtttgaagaaaaagtttgaaacttaacttggcccaaatattggtacgatatgaccagtggtacttacctttgacctactgtttactgattttgttggtatttcgagtaaccgatatttataagttccactggtggagaaaccatctttggtcggttggctcgatttcacaatagtcccagttatattaaaaaccgggactaaaaacatctttagtctc

SEQ ID NO: 46742 - DNA, 759 bp, Oryza sativa
aaaaataaagactattgaaagaaaagaccatctaaaacacatgacgagattaattaagtaataagcatataaatgagtatagtggtggcggttgatgggacatgtaaaaattattaataaaacaccaaatataatcttaatgacgattaaaatgaatgatgatggataggtcgtaaagcaaccggttaaggcggttggcgggacttatagaaagtcgaaaaataaaccccaatgataattatatttaatttttaaaatctcaatgacaataaaaatgataggcaacgggcgggtcgtacagtagtacaatggcagagccggcaatagttgatgggacttctagaaagtaaaaaaatgaattccaacgatagttatgttcgattttacgaatcccaacaacaataaaaaataagcggcggatgggtatagtggcaacgtttaacgatatttctaaaaattataaaaaataaaatccaacgagtcaataaaccctaaaaactataaggtccaattttaaaaggttcgggcttctaaaaagttttaaaaaataaactccaatgataattatgtttgattttaaaatctcaatgacaataaagaagggaggcagcgggcgagccgtagaggagtacagcgacaaatccacgaacattttggcggaacttctataaagtagaaagaacctaaacgataattatattcgattttgaaaataccgaagatgcagcagactggccgtagaggagtataatgacaacg

SEQ ID NO: 46743 - DNA, 1501 bp, Oryza sativa
acctggggtatcatatacctggtacctaaaccagcctgatacctggggtagcaaggtacctggtacctagatcggcatgaatcccataggtgccatatttggtactgggcattgggtacctagggtatcagatatctggtatctagaccagcctgatacctggggtagcaaggtacctggtacctagatcggcatgaatcccataggtaccagatctggtatagggcatcgagtacctggggtatcagatacctggtacctagaccagcctgatatctaaaggtaccatacctagtactaagatatcatggtacatggggtattcggtacctggtaccatctgagtacgttgggtacctaggtatcatatacctggtacctagaccagcctgatacctaaaggtaccatacccagtactagatattatgatatatggggtatccggtacctggtaccacctaagtatcgagtacctagtgtgttgtgtctctagtgaaagactgaaagacaaccataagcctgtagactctcacgtgattatgtgaacatacactgacgctttgacccttgtatggaattacgtgaagtggatagattgacagaagtggttgattggtcaaacaataatcctcattaagttatcccgttaggacgggagtccgtggtgtagcagtcctctagttataattatctacagttcacacatagctttaaatattattcacgtccagatcacacgccctcgccttcctcccttcccacccgccgcgtcccccggacgcccccgcactcacccctcttctccgccgccaccagagtggacctcgtcggtggccaactcctcctcccctctctccactccatcttcctccgccattcccttcccatcatctgtccgccgccggtgactatccgattcgcttatgttgaaattataagcacataatgatttaatttattccataaataaatcatgacattgcagatataaactagcatgaacgcatcattaggtctacatatgtaaactaaacagtaaaatatgaacagatcaaatatgcgcaacatgtcgaacacgtaccgaggtggcggaaagaccggttgctcggcagggactactcgcggttgcaggcgtcgacgaaggtgcgcagcacgcgagcgaagaggaaggcgagccatcgcggacgaacagggagcagtcgcgcgaagcgcttcccaaaaaccttatttccgccttctcccggtgcatgacgtcgaaggcagaggttccggagatctgctctcccgatcgccggtgcacaccggcgagcgggatggagtagtctatgagcgatggcgcagcacagagtaggaggcaaaccgtagattgttccggagatctactctcccgatcgccggtgcacaccggcgagtgggatggagtagtctacgagcgatggcgcagcacagagtaggaggcaaaccctagattgattttgcgtgtgttgcgtgaaggcggcg

SEQ ID NO: 46744 - DNA, 1501 bp, Oryza sativa
gaaactcgatacctaagcattaggtatcttgtgggtatcaagcatgtttcatggatattaggccctcatgccgatgggagctatgagaaaaagggaaaagagacgaggcaagcacaaaaataagatggctatcttccttggaggtggaagaacactattccttcttgttgccatccttgattcggatcgccgctgctacatcctcgacacgcatgtgaccatgatggttatggacatcgcctgtgacagtaggacggacacctcaatctctcctcctagctcgaactcattgaagctcttcctaagcacctagtacacgagagttcccatgaccaccatcaacgatgtgatgttccgcacaacgagagctaacaccgctctggtcttgtcgcagggcttgcagtgagtacttgcccagccacattaattaggaatgaagagaggagttagagagggagagaggcgtagaggaggagaggcgaaggaggaggacgaccaagcaaagctccgggagagagaggtagaaagggaacagataagattggatatcgtttcacttctcccgttcctacggcattccgttggctagtttttctgttataactatttttagacgacatacggtgctcagtgaaaatatacggtgcttctctaaacttgctttccgatgattaataatcagctgtaatcaaagctgttagcacccaatggagtacaatatattgctgatgagcttatacatcagagacctgtgcatcgccgtcgtcgcagagctccacctcgacggcggtgaacaccacgaacagctccgggccatcacggtgttcgtcgtcggtctccaagaacctggcgatgcaggaacctgccgacgaggtctgagccgacgggattgagcgcgccgggcagcgtgtaatcccgaggaagaaggctgcgaccacaccggcggcttgccggcgtcaaggtccgtggcagagagaggaccatgccactgccatcactagccggtgagaggccgtgctccgggacgtactcggcgaggccgccgatcgaacggcagcgtccagtcgtcggcggcgcgccgtgtcgaagcggtaggtgccgtctccgccgccgaccaggagtcgggttggaagggaggcggcgggagagcacggtagcgctagtcctcgccgccgtggtcatcgtaggcgtagatgagcccatggaagcaaccaccggcgaccggcgaatccgaggcgttgaggcaggtcgggaaggcagaatccgaatccgaatgaggacggtgtgctcgccggtgtcgacggcgcggcgagtctggtcgactcatcgccgatcgattgaccatttgacctccaagattgtttatctggcatcctggccccgcctgccatagactcatcggtctctggccccacctgtcatagactcatccgcttctctctgctcgttagttgccttcgtcctcctgccgcctcgggtgttcttccttcctccatcgcca

SEQ ID NO: 46745 - DNA, 177 bp, Oryza sativa
agtattacaagtcttcctcaataaattactccaacaaaatcctcacctaggtcaaagcagcttttcctatggttattttcttcagagtttcttgtacttgcatttgtatagtataatgccttcaattcctctgcttttcaattgaaatgtttatattgctgtgatcctctttggtga

SEQ ID NO: 46746 - DNA, 222 bp, Oryza sativa
cacacactactctctatgcttaaacactccagcttccctccaaatcagcacttcatctctaagggctctgtaaacttgcgctgcagtgcaatctttgtgttcaaagattctcgagttgcgctctttccagattagtttgtggtatctctgttcatttaatagattggtatcagcaagaatgcaaagtattgatactgttgtttgaaatataacatcggaaca

SEQ ID NO: 46747 - DNA, 386 bp, Oryza sativa
tccatgcataattaactcagttccatctagcaacatgccagtacaaaatgcaggtgtttgttgatcctgccattcatagaccaagtctgatgattgtttatgcatagatcaatcatactatatagtaggctcgttagatcaatcttatacggttagcaactttatagcagcaaaatcaaaccaagttttgtttaaaacaggttctgttgcttctgggttcaaaataagttatgagctggcctaatctttttcagtcactgtgtacctcgtgcccccagtgtcggtgcttaccagtgttgggcacttggcttttttgagaaaagccacatgttcttttttttctcttttatgttcttttttttctcttttatgaaaatacgatgaca

SEQ ID NO: 46748 - DNA, 523 bp, Oryza sativa
atttctggggttcatagttgttgtccacccgcctcacggagcgcattcagtaccatcccataggcttcctgtgtttccatgtgtgcaatatccttactggtatcgttcaaaagaaccggaaggggaagtaatgtgttcagaattaacattagtatctgatcaactccagcttaaataagtaatcttgtggtctagacaatctacaacttctgcatttcatgaattcaataatcatgcacctctgaatttaaataaatcaattagcaatgcaatgctggtctggaaaaaagcaatgcaatgttcaacaaaatatgatcttctctgctgaaaatttccacatcctctcaaattttatctatccaaagacagtgcatttgaagtgtaggagaacaagaaatatgagaaatgttctgaaacataccacatataatgatataaatggaaggataaatgaatattaatgtgctcttcaaatataatgtaagctttagccttcatgtgagtaataacttgtaacaataga

SEQ ID NO: 46749 - DNA, 1501 bp, Oryza sativa
tatatataaaaatatatttgaattcaaattcaaatttgagtcgggtatataagcttttgacttataaactttaggtctataaattttagatgtatagaaaatactatatataaaaaatatttcaattcaaattcaaatttgaatcggatatataaactcttgacttataaactttgtgtctctaaactttaggtgtatagaaatactatatataaaaaatatttgaattcaaattcaaattagaatcgagtatataaacttttgacttataaacattgggtctataaactttagatgtatagaaataactatatataaaaaatatttgaattcaaattcaaatttgaatcggatatataaacttttgacttataaactttgggtctctaaactttaggtgtataaactttagatgtgtaaacttgaggtgtacaaattttaggtacataaatttatttaaaaaaataaaagtaatgtggtgaaaaaaaaaccacgtggagaaggaggggtcatcgctgggggcgatcgatcgcccgttagacttttcgtccaccttgtccatcatcagctcaatgatgcactatcgttggacctcgtgattatacatcacctccactttatccaatggagaattcccgttcatgtttatcctattgaagatatgtaagagtatgatgctgggtattctgttctcctcaatgctctagtgcaaacttgatctgagcgtccatgtatatcaggaaagctcatggtgcttcctagggtcccaggcctagctaccatgggcaagcgacaactgacaagtctagctggagctactaacacttccatgtgatgttgtgaactaactcgtcatggatgactctctcttacagctcaaagctactcctcttttataacccaaatgacgtttgcatgtggagagctaggtagcatgtgcgtgtacactgatcagttaaccaacatatttcaacaggttgacagaatctcacgcaacagtcttctaattggctacactattggtgcacgatacattgcgtaatggtgctacacatatagaaatggtagccaaagatattatattctagtttagatgatgtagtacgttcataatttcgttgatctattaattagcgggagttaatgggtttgtcccatcatcttattcgtttattcttattttttacttctaaaactttttggttgtgtcattgtgtgcccattggtagaggctaaaacataaaccatttccactatctaaaaagccacaaccaaatataaaagttgactttgatttttttttccagagtatagtttattttttatcaacagcctgtaagtagttaaaaatatatttttttacaacaatattttttatcgctcatatatataattagatattgagaaaagggaaatcatattagttggtgaactatcaaggaaacatatgcagttgtcggagaacacagatggaagcaagatcggagacacaagtccacaa

SEQ ID NO: 46750 - DNA, 247 bp, Oryza sativa
gcagaaaaaatatgaacactggcgttcgccttttgagaatggcgaagatgtattatgacactaggtgattatattttgccaagtttgtctgctttgcgcgattcttgacttgtatttttttctttccccttttccctattgttttagcggggatttcgccgaaagtcatgcgttcggcccccttttggggattggcgaaaagatttgttgacttttcagctttcgacttccgttttcgactcgtagc

SEQ ID NO: 46751 - DNA, 1501 bp, Oryza sativa
atatatatttttagaaaatcatgagctgcagttaggagttcaatcatctcaagttaacatacgagtttttttaaataaatttcttatatgattccttttgtattaccaaaagtgaacaatcttaaaaaccgactcaaatacggatatgtatttctaaaagcaaacgaacttaaaaaccgactcatacacggatgacataccaaaatactgacaaaaacattttcaatttttataatagtagagatagagaagatatatagattaaaaccaaaatataaaaattaaaaccgactaaaacacgcatgacggaccgcgtaaacatctttaatttttataatagttttagaagatcatgagctgcagttaggagtccggtcatcttaagttagcatgcgagttttttaaatagatttcttatatgattccttttagattaccaaaagtgaacgatcttaaaaaccgactcaaatatggatatgtatttccaaaagcaaacgaacttaaaaaccgactcatacacagatgacgtactaaaataccagcaaaaatatctttaatttttataacagtagagatagagaaatgggtttcgtgggttagccgcttacaccccgaccgcctaccatggcgcgaaggcacaattttcgatgccacgcgacggcacgccaataagctgatggagagctgcagcttcgtcgtcatcgttgcttgttgcttctacgaagaaggcgccatgcatgtggaggctaggaggagtgcagcgcgacgtgacggatcgatgaccggccgcgtgatctccagactccgcatgcaccgacctcgccgtgcactaggccagtgctgcacgcttgctggttgtgtaggagacaggagagatatagcagggaacgcttgacatgtattcctacatgaaggtggagaagccgcacgtatatggcacgtaacgtggttaaattatcggtgccgagaagatccataccactgttccattatcagctctcgcggcgcacgtatatgagacgtaacgtttttgtcctcgtttcatataaaagacccttataagttggccccacttatactcaactagtgaggttgtgctaatattagtcctaacttatttttaatggtacgggtttagaaaagtaggaaaagtggttggatgaaaaaattcatactttacgctagattcacatcttagtcctagcctatatatttttagtgctgaggttagttgcaatgcatggccatactactagtagagcagaaattatgttaagttttctcgtgtaaaacagttacttattgctggagttaattttgctgaaatatgaaatatctagctatattttcaggaaaaagtgatacttttgataagatttttttcgttttatcgatcattgtctaaaaagttgttgttttatcaatttgccacataatatctgttggaggcatgccatgaagcccttcggccgaacctgccgaaaccatagtaccagtaagg

SEQ ID NO: 46752 - DNA, 339 bp, Oryza sativa
agcaaacgtggtgcctcctttcaaaactgtatggcacagtaatataataaaatggttttagagggaaccatttgaatatgtgtccgatcttttgagttgtgtcattgttgttatttgtaatcgttttgtgatcagatatggcggtaaattttattttgtttcagtcaatttttttatcgttagagttatcctgggattcatgctatttgggggttctcaaaggagaggacagctctcagagcggagtgcttgatgtagttaattgcatgtgttaccagtcatgatgcatggatacgtgatattggtacggtgatacgggaattttgaaaaacatcaaca

SEQ ID NO: 46753 - DNA, 1349 bp, Oryza sativa
  unsure (1)..(1349): unsure at all n locations
tttacataggtaaagtgtctgaattgaaagtaataatggaaaaaaatttaccacgaagtggtggtcccagattcttggcagcgtcaaatgccaatgaagttggtactttggtagcggcttgctttcccttctctacatccaaccgaaatgagctctcacatgacaatggcaacctttttctggactcagctcccatggagaaaccacagcgttcagtaatactttgtttaatcgaggaaatgatccctgcaccttcttccttcctcttcgaattgctattattgcattggtttgttgaattcaactctttcttatctccattttcattctccacttcattttcaaaagaacttctgttcttcaaagcagtgtcaggtttactaattttcccttcaagggcttttgagggttcatcttcataagaattgctttttgatgcattggcaattntattggttttcctttcaaagaactggctttttgaggcaccaaccttcagctgagatttttctagttgcttcttcttttcatattccaattcattttcgcactttttacacaaccattcaccctctggaacctcttggatgattacccgcatacaataactggagcaaagaaatgagacaaaatttaagtagattaacaatacccatattctcaatgtggaaaaatattctgaaaataatactcctaactggcttgtctgcataataacagtagtagtttattcctgtcctgagacacagggcaggcatcctaattgtggcttgtttgcaaactacaagtgcaacaatcttaaccatcatggcatgtcatcaagcaatcaaagatgagtaattatacataaaaagcaacggaacaaataagccttacatatgctcagcaccatcattgcatgtagtgcaaacagcaagcctctcctcctcaccaacatctccacaaatgtcacacactttcacctattgttgtcaagtgaaacaaaatatttagctacacaaaaagatttgtcataattttaatgcacaaaaataaaggttttgaactcacgtcctcaacttcttcagaacttttgtcctcagaagatgtggcattcacatgtgtatcagacacctaatggatattgaaaccatgtccaaggaatttaattttgaacacaaattcaaaggaatataaatcaaactgtatacacacattatgtttggatcaacatgccaaattgccaaacatcaattgctagattatgacagaagcatgacttaaccacaaaaaagaaagaaaatactggacatctgttgatggataaaatatgtactagtagttgcagataaaaaaggaaaactgaaact

SEQ ID NO: 46754 - DNA, 174 bp, Oryza sativa
gtgaccagaactcgatactctaaactaactagacgttaagaccagcaagatgacgtgacgatgcaacacaaaattcggcaaagcaaaaactgaaaagaactatgcaatggcacaatatggctaggtaaatgatgcagtttctttttgtcgggctattttctggttatgggtaga

SEQ ID NO: 46755 - DNA, 1348 bp, Oryza sativa
tccccccacgtcgccaccaccgctgccggcggaggaacgcagcgagccgcctcgggtgggctcgccggaggaagtcagcggcacaactattattgcaaggactaaacaagcatgaaactagcttaaagatgggcctcatgctaatagggccagttaatcccttcatcctaaaatataagtcacaactatttttttatatattttataatacaagacgtgctcccactctcctttattttttttctttaaatcctcaatctcaaaatctctaattccattgagtgtatgtattgtatttactaggtgatactccgcgctttgctgtgggattcatggacgagtatatgctaaatattgtcaaaatgatgaaagttgaaatgttaagaaaataatatgaggaagatgatttgacacatacttgtcgatttctataacattatattgtagatgattatgctagaatagtaattgctagtgagtgaagatgtggcatgcttgcatgggattttaaataggctaaaatagtaattgctagtgtgtgatgatgtggcatacttgcatgttgagctttagcttataataattattattgggtactactatatagaaagtatagatttcttggttttgtgctaatagtagttgtgccttatatttttgtatggagagaggtattaaacaaatgatgcttgtcctcgttcctcatgcatagaaaattgtagcaagagatttgagtgggttttctttcttcccatggttttcagtggtgaaggaagcattccttcaatcttcctatgatcattttgagtggtccgaatggtaggaaaggaaacacttcattcaccctaatttctgggtgcacgaaatcaaggagagatggtgacacagttgtttatactggttcaagccctcaatgcgaggtaataccctagtccagttgtttgtggattgaatctgtgtcggctgtgaatggtagaatgcataacccctgcgtgtatgctgggttctggagatgatacccgatctcgggacccctaccccctcttatataggataagggggagggttacgaggaaagtatccagttgactacaactagatctccctattctatctatataagatatgcatgatccccgagatttatattttatcccgagaatatctcttacttaatttataacatatccttgtgggcctagggctcttggcccactccatgtcatacggcccaaaggcctctccttgggtacccgagtgccgtgtacaccacactctgctctggccggcgtttcccgtcatgccgcgctagctcttctgtccctaaccccctatctccttccatagg

SEQ ID NO: 46756 - DNA, 583 bp, Oryza sativa
tacctctcatcgaaagatcgggccacaaaccctagcgggttcgcattagtataagagtatgctaacattcaaaatttatcctaaacaaacttgcccacttattttctcatctcaatcaaattacaaccatcactcacttaattccacatctctccttaatttcataaaaaaagaacttttaaaacacataggagtagtagaccttttataaacatctacgctaataaaactaagatgaagtaagatcacttcataagcaattccgtttactattttgtgaattactccctccatcccaaaataaacataaccatgagttttcgtaccaaactttgatcatccgtcttatttaaattttttaatgattagtatttttagtgttattagattataaaacataaatagtactttatgcgtgatttatgttttttagctttttcaaaaaaaaattaaataagacgaacgattaaagttgggtacgaaagcttatagctgtgtttattttgggacggagggtgtatatcctataataacctcatagttacagttaatacataattacagcatcgtgaatctttgctga

SEQ ID NO: 46757 - DNA, 433 bp, Oryza sativa
tatacatgcaatatttaagtaggaataccaaaaaataatgtgttgaactgttgagggagcgtcagatctccatcgatctgcctcgaatgataaggggtttagtatataaatttgatctagaattaaaatcggttggcctttccttgggactttggccgacccagtttgctaaaaaatcatttgtccagtatttcctctgttgtataatataagacacaactactttttttttatgtttcatgatataaggcatacatacaattaattaggacatcttctccattaaattattacttttttaaatcatccaccttaagatctctaatttcattggatgcatgcattatatttattagggtgatccaaactaggagatgataataattatttcttgtttttttaggttaagggtggttgtgccttatattttaga

SEQ ID NO: 46758 - DNA, 939 bp, Oryza sativa
tatacatgcaatatttaagtaggaataccaaaaaataatgtgttgaactgttgagggagcgtcagatctccatcgatctgcctcgaatgataaggggtttagtatataaatttgatctagaattaaaatcggttggcctttccttgggactttggccgacccagtttgctaaaaaatcatttgtccagtatttcctctgttgtataatataagacacaactactttttttttatgtttcatgatataaggcatacatacaattaattaggacatcttctccattaaattattacttttttaaatcatccaccttaagatctctaatttcattggatgcatgcattatatttattagggtgatccaaactaggagatgataataattatttcttgtttttttaggttaagggtggttgtgccttatattttagaacggagtattactcaagcttatcagaaagaagaagctccccgaaaaacaaaaaggaaagaagaagctcccctacgtaattgcagcaggagaagatcacacccctgttctttgtccagctggtaactaaccagtatgagagtagtaagcatgtttctcaagctggtaactaaccttgtaatttttagaaaactttatacacataaatctattaaaatattatcttaaatctatttttcaatctcgtaacagttaattaattcatttgcttgtaatatcgaattattcatctatttagaagtccattttattccattattcagctcagaacaacacatccggagttagcgagcaagcgagctacctatactttattattatcatctttgctaattaattaattgcagctagatcgctcgtttccgtcgtttggttgagtgtatatatatggatgaatatatagtgtgtatgtacatatatagatactgtcatatatacataatgtggc

SEQ ID NO: 46759 - DNA, 239 bp, Oryza sativa
caataatgaaacctttttataatatacatagcaatatttaacaccatataatttactagtataataagtattataagatgtattcctaaaacagacagtgtatagtgtatgggacacatggccattcatatcttattgtactagtagctaaaaccaaataaacttataaatatcttcatcgcagaacaggttttctttatcgtaaaaaagggaacaaccgtaccctcttgttggatagt

SEQ ID NO: 46760 - DNA, 315 bp, Oryza sativa
gtcccatccatctgtctctatttccttttctcccgctgctccccacctctctatgtcctcctcctcttgttcttcatccaaccccccatggggaccaccacctggtgctgtggttgctgctgctcctgcctcgccaccgctcgaagccggtgagtgagtcgtggtcagtccaggcgccaacgatcgagctgagctatagccagggtgaaccagaaggcgaggagagttggtggtgagttgaactggatcgaagtccgaagagggaaagagggtggaagtgtttggttggcttgccggtgtggtgaggattggaca

SEQ ID NO: 46761 - DNA, 836 bp, Oryza sativa
atatagtgtccatgagctataagatgcctcttgtggctggagctgatttagttgctgttcgaaattatgaattaccctccaggtctccctagtcattagcaatctatacatttttacgttttgctacggcagtgtacactatatgctgaaatatggatcataatctcatgggtgtagtaactctttctgatgaaatgctctcaattcactggcttaagcaatcagcatagcattcacccctaattcaatatttccatggctagactccactggagtgtaaatatagcaggcttgttaacattttctgtctgctggattgtgctctactgatttaagtagtagtcaccacaaccatatctagttgcatacatctgtttgctatgctattgccttgtaggagtattgcatagtggatgcatattagacgcatagtgtttcccttgggaaatgttttccaattggaggcgactataagaggtggtgggacatttgcgtttgcccttagcctgatcgaacttaaattgcactgtcgaatctcttttgctgctttccctttagcaaattggttgttcatgagtgatgcttgcagtaaactggttgttgagtcctcaaaattcgtctcatacttttgggtagttgaatcttcttcaatggagtgatctgtcagacagagttgtacctatgtacttttagaacaaaagcaattacactcatcttaatataccactgtgctaatatttctagttcctttgatgctcatgttgaaactgtttgacgtatagctttagaactttattgatgcacttggtgtttacatatatttcttggatgcaatt

SEQ ID NO: 46762 - DNA, 374 bp, Oryza sativa
aaattaccacaaatacttgttccaaaaaaaaaattaccacaaatactgagaatactaggaagctgatagtgctgcactgaatatgtcacagtgattagtatcaccagagagtgaaaccgcatgttttgctatccctcaacacttgatgtaatgacatgaaaaataggcttcttcagttcagttggcataaaagagaaccgttgattcctaaatgaccatgcatgtgctactcaaaaacttctcttgtttgattcagtgtgagggatagaatggcaattttgtgtgcctagaaattcttgattgaatggttgcctcttccagctgtgattgctactgcaaggaaacacctaaacatgctcaccattgtgacaatg

SEQ ID NO: 46763 - DNA, 434 bp, Oryza sativa
ttcagatcatcaacatagtcatgtccatcattactgagcatatcaccttatccatcgtcagctcaactacgtctaatccttggttcttatgattatactatagagcattcccgtgcatgtttattttactgaagatatgcaagagtggcatgctggtcttctgtagccctctatgctctgtaggtaacttgatccactatctcagagtccacatatagaaggaaagctcccccgggcgcctccttaagtctgctaccatgggcaagcgacagctgacaagagtaaggcactggagctagtatcacttcaacgtgaagttgtgaactaacactcatctcttctcttctcagctcagagctctcttgctgcctcttgtataagctaaatgaggcctttatgtgcatatacatagggaccagctagcgtgtgaataa

SEQ ID NO: 46764 - DNA, 327 bp, Oryza sativa
catttgttgtgagcacaagaatgctaatgccaacgtggatatctagttttcaattgctaattccagagtttgttgaacctggatgtatttcaaaactgaagaaacggactatcgatccctgttgtatattttacgtcttactcttaggtgattcatacaaaacaggttcagatcaggcttgtcagttgtcgcttgcccatggtagctaggccaccgagctttcctgatatacatggacgctgagacagcagatcaagtttgcactagagcattgaggggaacagaataccagcatcatactcttacatatcttcaataagataaaca

SEQ ID NO: 46765 - DNA, 1190 bp, Oryza sativa
tttgcccttatgctttaggtttaatataagcttcaaaataattgaaattttgtttgaagtgcacatcgtgtgcattttataaaactaatgagactaaataattagtgcagaaaattttgacataaattttgaaaataaaataaatgtaaaaaaaataaaatttttatttgaaattttaataggacaatggattttttttatcaggagcattcataaaaaaaatattatgaacattggtatacctatctttatatgaatgctcctcatttttatgaccttttttttaaaaaataaatacgtattttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaatggtcaactgacgggaggggtatgcaagggatcaaaatcaaattttgggggtatataaggaagtaagcaaaattcaggggtatagaagggattaggaaaaatttcaggggtatataagggattttctctttaaatttagagttgattttggggattttcatcgaagtttattcttcggtgttttcttttcgatagctaagagcatctccaacaatagctactattttagagtccctaaaggttaaatgggggctgccccaatttcctcaggactctaagaatggttctaactccagcaacaacatctatttcttagcccctatttctttttctcctctattttatcttataatccatcttttatgtttagtttaatatcacaataatgtaaatattaatatttccaacgcatagaatttaatcaaatttaaattaataatttcaaacaacacaattaaattgaaatttgatttttttttataatatcacactgatatgtgcatatacgtacactagtgtgagtgcatggatgactcactagaatgctcaatcagtccatctgttgcggctagtagcagtagcagttcatccatcctacactcaatatccaatgatatacatgcatatatggatgcatataatcatatatgagctggtcaatattaagatatattatatccagtgcatacacgaaactgcatgaatata

SEQ ID NO: 46766 - DNA, 842 bp, Oryza sativa
ttatgcttgcttttctttggccttttaatctcagcccctctgctcaacagtactagatgtatcttggattggcatgtatggtgaggaatctttctagtaccttttttttttgagctgaaaaacctcagttactaccactctgtgtgctaatcactgttatggagcatatatcctctcttcagcttgcagctcaagagtgtgagagtgttgtctaggtgatcatcttctcctttttctgttcagttcttggttcacactgtcaaatcttttcttctccttctcctttttcctgaaaaatatcttgttctactttcccctcctgcaaatcctgggagcaatactagaaaagtttttctcttgtgtgctgtctgtgcccatctcttcgtttggtgccagctttggcaaagccctttattatcactctcatctaatctagtatctgtcccctgtgctgtcctcatcagcaaatttactccctacctgagcttggtatgctagccattaatgctctcccctggactgatgtgtgatgtgagtccttgcatttagctatcaaaggaaatctcctttcgtggtcaagctttaggtggagtttgatgagttcggctgggcttcatttattcccaaagatttgagctcttgatgctgctttaatagttcagagattccagcgtccttcacttcttgcagctcaagaaaggattcgatctttgagcttctagtgtttcttggagctttgctcttcgtgttcatcgatcccaaaatcccccttttttgctggtttctttagcttgcctgatcaatcatcccaagatctgagcagaatgggttcttcttggtgg

SEQ ID NO: 46767 - DNA, 786 bp, Oryza sativa
cacagggaattcactcaaatttaaagctgcaaatttaaaatttagctgatatgagtataagtgtaagcggaaagatgaggttgttcagttggcagtgatccaaagaagggggcttatttgaaaaaaataatatcattggacttgtgttaagtgttaaccgttggatgggaatctaagatcgagttacatttacataaaaatccctctcattttcatgtttgtaattaggctccttctcggtttctcgctctccgatcccccgacgaggcggcggagctccggcgaacctgggaggggatcggagcagggttcgtcaggccgcgacggagggtgagatttcgcgcggatcgcatgccggagacggaggctccaaccgcttggccgttgtcggggattggagatgcagttctgagaggccgcaggctgcggcgagctttctctgaacttttctcatcctgatatcagctaaaatcaatcgaggtaatcaagaacctctcgaattgtttgcttcagatcagtagtgtggtttctgacttctgatatgcagtgtgcagggatcgatgcagcttagtatactcacattttgttgattctgccctggtaaatttggagagattttttttttttttgacgccattgccatctgatctgagtggtcatagctatataacctctcttctgaagtattggagcagaaaatgcagaatcaaactgaaaaggaatatcaaggcataatgcgacatggaagaatctgaagtctgaactcgcctgattgcatgcaggttc

SEQ ID NO: 46768 - DNA, 1056 bp, Oryza sativa
tactaaagaaaagatatcatgatgtttattttaagttggaaccatcagcacagtactacttttctaaactttttaaaaataaacattcgacccttgattctcaagatcaggagggcaaccttgccatgacagaaaaaacactgtagtgtaacaaaggattggcagaatgcctaaaaggttcttttgaaggaaaaaaaaaagtactttggtgggactattttgtttttcttgtttaaaaaaatcaaaaaaattaatatgaagtataatactctactttcttctttatcaatcattgttatacatgataatatcatattgataacacttcccacattttttctagcaaaagaatgtgataacaatatgtgatgttggtaaatctatgtatttatgagaatgtgataatctaattcttctggtttcaaagttgatgagaacggtaaatggtcttatagttctgaatttcctcctaaaacacgaaaatatgaagtcatttctacattgtaactctaattggcatttttcagtagttagttgctcataatttaattgaaatcagtacccaatctattgcctgattgctacaacggttacaaatttaaggttgctttaagttctgaaacacttgagtatttgtacaaagcatgatgtttaacatcagtacttaattatggctagtatttgtacagtaagctctagttctctattttaagctccagttttgaatttcgtctgtagttctgaaattcagctcttgttctgaattttgacttcgttctcaatgtaagctcttgtcctgaattttgtctgtagttctcaaattaagctctagttctgatatttatctatatttctgaaatctacctctagttttgaattttgactctagtcctcaatttaacccctagttatgtattttatctataattctgaaatttacctctagttttgaatattgactctagatttgattttcaatagtcatttaatttgtaggttattaatctgctttgatttgtgcaggtccaagtgtgaagaaatggagatactacccgg

SEQ ID NO: 46769 - DNA, 173 bp, Oryza sativa
cttctattaacagatgttagccgattgtaagttagatgacgatattgccaaggattatgtaagatatatgataacttgatgaattatatagacaagattagagtgtcataaagatggaagcactaatctcgagaacacaagtcgtcataacaagttttacctcttgttgaaga

SEQ ID NO: 46770 - DNA, 820 bp, Oryza sativa
aagaaacaaacatgaatccccttagcagttacctgctgagcatctctcgttaatgccagtctacatttacaggagaagatagttgaaccccacctgaagcatgactacgacgccctatgcaagataaggccggtggcaagagaggagccttcctccttcagttccaggatgtccaatttcttcctaggtttgttctcgcagaaaggataccgtgttagtgctcaggatgtgaagtcggagctgtaggtttatactaggcagatggtgcatcttctacctttcgcactaagctgctactatccatctaccatggataaccaagggactgactcgtggactaaactacggtgtttctgtacttgcaaccctcagtttgatgagcgagtccaatgtgtaacaacacgctatcactggtgcccctcttctttcagatagaagacgtttgttgatcaatgtaatctttgttttaatctggactttctctagtgctcaactgctgactctgttgagatcaaactgaaagtactagcacacggttgtgattgtggcccttgtggtaggttgagatcatgtactactacttggacaatccgtttcaagctttcagctcaatcaatccagatttgggagatccccaattcgagatgaatcatgacaaatcatccgtgtgactgtcacttgtgaggctgtgaaagatccaaaaagttggctgcttctgcatctgcttctgcttctgtcagtcaagctttgtactgtactgtgctacagtgctactagtaggtaccagccacatcgacaataaaagctccaggctcacaag

SEQ ID NO: 46771 - DNA, 1209 bp, Oryza sativa
gttttgtgaaatgtactcgttataatatcatcatcaatttgcacttcgcacactgtcaaataattccaatgagaatggaagaaaaatggagatgccaagacacaagactgctcaccccgttcttctcgcagtagtcaaggtcagtccagcagcgctcgtcgcgcacctcgccggccggccagccggggctgggcacgatggcggagatggacgaggtcaccaccacccgccgcactccgccggcgtccttggccgcgcgcagcacgttcagcgtcccctccaccgccggcaccatcagctgcgcctgcaaacaacgggaacacggccggaggcggtgagcctggagcccgccgacgccgacgccgacgaggccggtacggacgtcgagaggagaagagtcgccggccggtgtacctgggggtcgaggacgcggtccacgatgcagggggaggcgaggtggaagacgccggagcagccccgcgcggcggcgaggagggcggcgccgtcgaggaggtcgcccgggaacacgcggaggcggcggccctcgccgccgccggcggcggcgagcgcgtggaggtggtccgtctcggccttgtcatctgcacagcacaacaccattgtcttcatcacctcctccgccttgcaagcaaacaagcagcagtaatggcggtttcgcactgaccggggttgaggacggcggcgtggacggagtagccgcgggcgaggaggcggcgaacgagacacgagccgatgaagccgctcgcgccggtgaccagcaccgtctccccctcccctcctccgccgccgccgctcgccattgtcgccgacgagagagactcgagctctcgtgtgagagagctgtggcttgtgagcctggagcttttattgtcgatgtggctggtacctactagtagcactgtagcacagtacagtacaaagcttgactgacagaagcagaagcagatgcagaagcagccaactttttggatctttcacagcctcacaagtgacagtcacacggatgatttgtcatgattcatctcgaattggggatctcccaaatctggattgattgagctgaaagcttgaaacggattgtccaagtagtagtacatgatctcaacctaccacaagggccacaatcacaaccgtgtgctagtactttcagtttgatctcaacagagtcagcagttgagcactagagaaagt

SEQ ID NO: 46772 - DNA, 382 bp, Oryza sativa
tgcttttggatttcagtttttctcaattataccactattgatgactatacttaactagcttgtgtccagtaatatgaaaatgttatgagcctgacatgctatgcctccttagcagttatcagttcagtgataagattactcagacagacctatttctcaactgcactatgtactttctgttatctggttgttgtagaacagtagtatttacactggataacatctggaaactatatacactgcacatgaatgcttctagagcattaatcatcataatactttttagctcgtaggtagctcgtaggttctttttggataattgtgtgcaagttaccaaaacattagtgtgcctcgactgattttgattaatgactaacacatt

SEQ ID NO: 46773 - DNA, 1501 bp, Oryza sativa
aacaaaacgaatccgaatttgcagcaaaacaaaactgcaaaaggaggctgcatctgcgcaagggtgaggagccaatttttcggaccattcgacgcgtacgtcgtgcacgcgcgccgcctgccaggccaggcgaggcgagcgagcgcgcgcgtgtttcccctcttctctcccccatacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaggtaaaacatagaagcaatcaaacaaaaaaccaaacataaaacgagataaaatataatctaatacaacgaatctagacataataaagtatatcccatcttatcctagtttttttaagagagtaacaaatactacctccgtcccaaaatataacaacttttagctataaatcggacacacagttgtctagattcatagctaaaaatgcttgcattttaggacagacggagtagcaatatagtactccctccgtttcacaatgtaagtcattttagcacttcccatgtttatattaatattaatgaatctagatatatatattaaattaacatcattataaacgtggaaagtgctagaatgaattacattgtgaatcggagtgagtactactcaactatacgtcggctaggagcctaatggatttcttaaaaaaaaaggggagcctaatggattcttcttttgcaattttatactactaccagctgatgatgattcagcagctcacgccgtgatcacatagaaaaggatcaaagaaggaagagacaacaaatctcatgcttccacgtagcacactctacttctgaaaaaaaaataattttacgcgggaaaagctacatctgaagctgtgattgtgtgaatacgcgttaaagatgattcctttatcgatttctgaattttctttacgtccattcagactgcctatgcctgaagaattcttttccttttcgttaatactgatctcaagaagaatcctgcttagtacaggagccatagtagcgaaacgatatatttacaaataaaaagtatttgtgaataaaatttttatttacgtatttctagcgatctaaaagcaaatgctgaaaaataaactttaataaaaaaaatcttaaaatcagctttaaatttaaggttaaaaatttaaattttagttaataattagtataagcataagcataaaactgaaagcgtcagtttgtttttgtcaaatctgatcacggtcaccgaccttcctgccattgtagtggtcaaatctttcagcgtgggcgtggacgccagaggaggaagacgcgtcgccgcgcggccaagccatccccgatcgatccccacccgcagcggcggcgaggcggccggagaggagggagatggagatggagg

SEQ ID NO: 46774 - DNA, 1501 bp, Oryza sativa
gtgttttttcaagtgcttttgacctgcacagtctgggtgatctggtgagagatgttcgttcatcaacgttgctaaatctgcacgttttggggtggagcctgatcctgatattaataaaaggagaggatgcacctgcaggctgcagatcatgtctgaatgttttttttccttgggattgaatgcttgatctgatggcacatttcagaagcaacatgtaacctacttaagtacgacagaaattcagaagcattttttcagataattgcctgaaatcaacttattacgaagaggaaaaaaagctgtatgtatttggtgaccaagatacaggcaaactaaagaataatcttccatttataatccagctgcacttcttcagaggtgcatgaagctgaattcccattttggctttcttattaaccgaggtaaggggggtcggagttttagtctccaaaccctcaaaggtagtgtattttgcttccgtctctctccaagcgaggtcagggggttcggagttataatctccaacccccatgagacggcaatttaatttaatccccgactcacttgaacttgatctggttgccaagaagagatgcatgcgattaccgctgtcaatgaccaaaaatttcagaaacaaaccttccttttttagataatcagaaacaaatcatctgaaccaaagcctgttagaaatgcatgaggccatggtgtctactatattaacatttcagaaacaacttatctgaagtctgaaccaaagcctgaattatctttgtgcttcttaacagaggtcatggaggttcggagttttaatctccgagcccctttgcatttggtctcgtcgccaagaagagataacggccaaaatggtaattcagtttcagataaatttctgaaccggcctttatttacgaaattcataagcgttttcaggtaatggtctgaaatcaacttattacgaagaaaaaataagttggatatattttcttcccgcttgattccggctagcaagatacaggcaacctcaattataatcttccagtaattcagctgcacttcttcagaagcgcatgaagctgaattaccaattctgttttgttctgaaccgaggtcaaggggggtcggagttgtagtctccgaaggtagtgtattttcctttcagtctgctcccgagcgaggtaggttcggaacccgttgcactcgatctggtggcaagaagagatgcatgcaattcccgctgtcatctgtccaaagatctcagaaacaacagatgtttaccccgaatattttcccctagggcttgatctgattagacacttcttattatcatcacggccatggtttcccacgggcttgatctgaagtctgaaccaaaggctgaattatctttgtagaggtcagggggttcggagttttaatctccggacccctttgaatttgatccgagatgcatgcttgtaaatttctgaaccaaggcctgtcagaaattcagaagcagttc

SEQ ID NO: 46775 - DNA, 1501 bp, Oryza sativa
ccagatataggtgtttgtaagttgcaactccttttagttgtccagcacatagtactaaattaaggttggaaaaatgaagcataatacttttatctgattgaggaaaaaaatgagataaatttaacctccaaatccaagaatgagcgtcttaaacattaactgcatttcaaaacggcccaaataaaatctatagatttgggcctcacaaaacctatttcatgagcacactatcctcgcttgaccttactgaaatctaattgggttttccttttctgatagcaatccctggattgcatttgtttaatttactttaatttcagtagcaaaactctgatctgttggtgtttgcttaaactctgatgaataaatttgtcttatctgaaggactaactatggagttctgaactggtatatatgtatgccagcctgacagactacggttggaacaggttgttttcagaatggatgaatatgttttggcctatctgtattccgacttctcaagcaaatttgtcaaggttgtacttatgacattgatcagcactagagcaagcgccccacaaacaaacaattctaacttgactgcacaactgaaacctgaatcaaatagaatagatggatatcttccttttccttctaaatggaggccagaaaaacttgctgaacacaaaagttcagaagaaggcatcccgttgttcatatcatatcgatctactatactcgatcttaactgaatcacatcacgaaatgatggtgacaataaaacccacggagaggagatgtaacctactaccgttcatgccatcgacataaacagttcttgttgtctgcccgaagtcagcatcagtttggactttggagaagagatcatataactgtcgaatacccggctgaacagcttaaaaatcagagtcttcagataaccagataggcgtctgtaactcctctaatttcatgatatttttttccagcattaaacatgtttatctcattatctgacgagacactgcagcagccactagacagtaaggtggagactagagagagttggtgagttctaccatgaattgaccagagttcttgcttcccgcaattaagaagcaactgataacaattattccaaacaaaaaaagtatggcgtgaataaaaaaaattgcatcgatatagtggcacgcgcattcgaagaaaattgacctcgtttattagggattcggatttttagtttccgacccctctcgttatggcccaaataatctctataattgggcctcataagcccgccttgtttttgtaatttcggcccatcaaaaggcaacctccaattctggatgtgagatccaaaaacatctgtgcaactccaggttcttgctcaacagagtgatcctgaattggtgatcacattagttaatcttgatgcaagatcgtggattttgtacacatgcaagcaaataatgctagcttctgtattttcacttcgttcaaaaagagaagaggagagaag

SEQ ID NO: 46776 - DNA, 408 bp, Oryza sativa
aacgagctgctctactggaagctcttcttccccgcgcgcgacgaggcgatctgacctcatgacgtcacgccgccgccatcgtcgtcgtcgtcgtcgtcactaatcggtgtaatctgctccgttcccgccatttcttttcttggcgatcgatgtaatcaaatctctctatacttgctcctcttctctcctcttctctttttgaacgaagtgaaaatacagaagctagcattatttgcttgcatgtgtacaaaatccacgatcttgcatcaagattaactaatgtgatcaccaattcaggatcactctgttgagcaagaacctggagttgcacagatgtttttggatctcacatccagaattggaggttgccttttgatgggccgaaattacaaaaacaaggcgggctta

SEQ ID NO: 46777 - DNA, 1233 bp, Oryza sativa
ttgttcccacctccctccttttatcctcttcctcccatcttttgattttttttttttgctttttttcactttccaccacccccttcctccgaagaacaacatgtgttgaggaaagcacaggaagaacttacgggaaattcctttctgtcttttttttttttttgcttttcttccctttccactatccctgagttttctgctgcttccctacacaaaactttattatataaaaactcataagcaacacaacattaatctggtctatttttttcatgtggttgtaatgcaaaattactgcaaaaaaaaaactgccctcaactatagaaaatcttgtgcagagtgtttgcttttccttatgcccaactaggtgactgaatttctaaagagtgcacaactcagaaatatcttgattcgctaactgttaaaattgcacatttgttctcttgtagtcatgctttgaattatgggagctctcagttcatgcaaatgccattacattgtacagaaaaaaggatgtaatgccatttttttcatctatccaaatgtgcagggcacagaggcagaatcaaatgaagactatgggatgttattcagattatcacaggagggaggcatcacctatacaaatttaatccagcaagtctctgtctcacctaatgcaattcttcctagtgctgaggtggcagtgagtagaaaaaataaaacacatattaaatgaaatatttaactaaaactttatgtgcacagtcataactcccacactgtctttttttttttgcaaaacagggtggtcttcctctgctccaaaacacttatggcagtttcatgcagctattgcaagctcctattgaatcagaggtgtgttcccttttgtttatttgatttgtgctgtgccatcccattatttgattaaaaaacatattcatgattggtgtggatatatctaatctggttaaaaagttcaaatcaaaatagaactataaaaaagatctctttattagaattttttttcttaccactgcagagtgctctatatttgacatccaatagatttgagtatgacaataccttttggggttttgatcctcacaatggttatcaacaaaatgacctgcaaaatgcacaaacagacacctctcagatgtgcaactctttgccataaagtgtagctgtgcatcctcctatggcatctctggacatgctatatgatgaaatgcagaaatcaagcgctga

SEQ ID NO: 46778 - DNA, 1501 bp, Oryza sativa
ggatccgcgttccccaaacgtgtcgaggccggcggtcgttaggcgggcaaggcggcggcggccggcggtcgggaggcggaggaggaagtggccgacggtggggggagaggccgcggtggccgaaaccgcgccctgtaggccagatccggcggccggcggtcggaaggcgggggaggcagcgtcagctggcggtcaggaggcggaggaggaagcggccggcggtgggggaagaggctgtggtggccggatccgcgccccataggccagatccggtggccggcggtggccgctactcacgcatggagtcagaggccgccaccggacccggtgctcggcgcgtggacgctcgatgctaaggaagaaagaaagaaaaacgattgagagagagggatggacaaggaagaaagaaaaaaacgagatatgggtggtctcaggctgtcggtgggtgatagataaggattgggttggatagattccacctgtgacggaaaaaaagggacccactagagatggtttcataacatctttgacgagctggatctgtatggcccgttggttccattcttgacccgtcacaggtgactagatgcctgtgacggaccgtagccggatggctcaccgatgacggcatcctgtagaacccatcaaaggtgaccctcattgttgaccaacaccttatgcatgtcacagatatgtcgtcaaatgtgtgaggatctggcgtagtgatattattcaagttaggggcagagtatattcttatatacatcatagaagtgttttatatcccataatacctttacgcgccactcctacatgaccctgacttttgatcatcttgactggaatgacacatcattgtagtatgttagcttgggcttttaattaatatagggcacatgatagttgggctcaacatattcttttatttggattttcaattatggtcttgcttagtctctttaattaactctcatggatccatccacctgcctcccccacatgataggcttaaacatgtaagaaagcatatattttgaccggggtgagccatgcaaattgttcttttttgaaattatcatttatactgacatggtatccgatgtctggcatgttctctgtctatttgtcaggtgtaagaagtaaacaaatggtgatctaatatttattgtgtactccctccgtcccaaaaaaaaggcaaaccctgtgtttccgtgccaacgtttaaatgtccgtcttatataaatttttttataattagtatttttattgttgttagatgataaaacatgattaatactttatgcgcgatttatatttttaattttttttattttttcaaataagacggacggtcaaacgttggacacggaaaccagggtttgtcttttttaggacggagggagtatataacaagtaaacaaacggatgattcaacaggaagggtcgtagttgttaacttgggcatttaattaatatatgttgcacatttaataaatatatt

SEQ ID NO: 46779 - DNA, 1501 bp, Oryza sativa
ttattctaggcggtagagaataaatattagatgaccttttgtttacttgttttttctgacaagagaacatgtcaaacatcggttaccatgttagtatgcatgataatttcaaaaaacagcaatctagctcaccctggtcaaaatatatgctttatagaagattaaacctgtcatgtgcggaggcaggtggatggatccatcagagttaattaaagagactaagcaataccataattgaaagtccaaataaaaggataactccaaaaaaaaaaaatgatagaggaaccattgagctcgctcacatcaaaatatatgctttctcacaaggtcaagccaatcttgtgacgaagcaaatgggtagatcgatcagagttagctaaaaaataaccagccaagatcataatagaaaagcatgacttaacagaggacaaccatttattatcatatacttagcttgtcagtttccttcaatcgagatgtcaattatgtttacacctatgtgacaggttggttcacatgcgtaatactctctcgtctatataaaatataaagcatggttatactaatttgaaatgcaaatttaatgcaacttcttttaaatttcaatattaatgtacatgattagttgaagtcaactcgctaggatcgacgccatgtagtattattttagacctatgattgtcttgcagtaagatagtgtagaagtcttggtcattgcgagctgctcgctttttgtcattgatgtagcattacattgtttagtcaagaagtactgctgctcgctcgagtcattcaattcgttagacgttgcttctgattgaatcatgcatgaagtacctatctgtaaccaatgttattctagatggtagacaataaatattggatcaccgtttgtttacttgttatacttgacaaatagacacagaacgtgacaaacatcggataccatgtccagtatgcatgataatttaaaaaaagaacaatctagctcatcaccccggtcaaaatatatgctttaatttcttacaagattaatcctatcttgtgaggaggcaggtggatcgatccatcggagttaattaaaaagactaaggaagaccataatagagaatccaaataaaaggatacacattgaccgtaactatcaagtgcaattaaaagtacaacttaacagaccacaatcatgtgtccttccagtcaagatgatattattgagatagtgatcgagtagtggtgcattaagatattattggatcggatgcaaatctgttctacgatgaatttaagaatacactctgcctccaactatatataagaatatatttattaaatgtgcaacatatattaattaaatgcccaagttaacaactacgacccttcctgttgaatcatccgtttgtttacttgttatatactccctccgtcctaaaaaagacaaaccctggtttccgtgtccaacgtttgaccgtccgtcttatttgaaaaaataaaaaaaattaaa

SEQ ID NO: 46780 - DNA, 297 bp, Oryza sativa
gcgagctggttcataccaagtaacctttccatcatctcatctcactcccacatgatggagaactactagcttgctgttgagtgttgaccactggaattgttatattagaaaatcttacttagacctggtttggttcccaacttttttttcaaacttccaacttttttatcacatcaaaacttttctacacacaaacttccaacttttccatcacatcattctaatttcgatcaaattttcaattttggcgtgaactaaacgcacccttactagtacttggtattcttcaactgcagg

SEQ ID NO: 46781 - DNA, 1501 bp, Oryza sativa
attaaatgctcgagttaacagactaccaccatttattagcatataaaagcttgttggtgtcgttctagtcaagacgatagcggagcagtggcgcacgtacaaatgaattatcagatgtaaaaccctctccattggcaaatttaagaacacactctgcatttgactttaaggataaaaatggtacatttttgtcaccacgctcatgccctaaataccaataggcagagaacatgccaaacatatgttaccttagcagtgtacacgattaatccaaattaaaaaaacaactttggtagagcaaccattgagtttgctcccgtgtcgaaatatatatgatttctcacaaaatcaagccaatcttgtcacggggcaagtggatggatccatcatccatcagaattaactaaaattcactaggcaagactataatagacaagcacgacttaacagacgatgaccatttattaccatatattagcttgtcagtgtccttcaattgagatgtcacgtgacaggttcgctcgctagcgttatagatcctctgtaaaatttttttttcgagcccctcctctataaaatatgaagcaaggttataataatttgaaatacaaatttaatctaattgcttttgtactaaattttttttggcagagatagataaccaatatgggacagatggagtaattaagaagatatagcaagatcacatggtaaaatgggctgtatttttgaggactcgaggttgcagtgaccttatcaattataactagcaattattaaacaggaaacgtactttgattacttgaagtcatctcactgggatatacgccatgcagtattattgttttagacctacacagcttgtctttcaataagatagtgtagaagtcttggtcatctcactgggatttcgctgatggctgggctgctcgatttttctctttgatgtagcattacattgtttagtcaagaaggacagctttcccgaatcattcaattcattagacgttgcttccaataatgcatgtaaccaatgctattctaaatggtagacaataaataatagatcacattttgtttacttgttgcagtcaaaaagatagagagaacgtgccaaacatagggtaccatgtcagtatatacatgataatttcaaaaaaacaatatgatcattgatcaaacaacaatctagctcgctcccgtcaaaatatatgcttccttacaagattaagttgtgaggaggcaggcggatggatccatcagaattaattaaaaagactaagcaagaccacaacagaacagtgtttttcagccgctttaatccagccagaacagtgtttttatctcacaacaaatcagccagaacaacagttatcatttgaaaccatagttataagggcatccacaatgtgaccaaaaagcagtccttataactctatatgggtacctttaccattgtgggaggtggcattaggaagagctatatgataagctacccata

SEQ ID NO: 46782 - DNA, 744 bp, Oryza sativa
aatggttgggccctttgcaacagggtatgttgtatagtgttggattaatattgtttaattatcacttaactgttttataattctcaaatgtttgctaaatgctgcttttgcaaatgaaaccctactatgccatcctttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagtcgtctgcgccgtttaatttattttccgctgcttagattttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaatcagatagcttacattttagtttctcgcacctatgttgatgaatcttacttagtgcaagatcatatacataagcatggagtagatggatcactcatattctttttccaggttgtacaaatgaaatcccgttacctaacccagggtatcatttgtataattgtcttgagctaactattcccctgcagacgatagaggaatttcgtgctggtacaatacatagagagccctgttacatggca

SEQ ID NO: 46783 - DNA, 189 bp, Oryza sativa
agaataaaaaaggggaaaagaagagagaggatgtgaaaattttgaagtggtgagagggaaaagagggagaggtattttttcgtgcggtccacttaaaaagcccgcacgcgaaaatcgatttttccatgtgtgtcagggttacggataaggtataccctctatccttggatgtacgttgtatgccgatac

SEQ ID NO: 46784 - DNA, 1501 bp, Oryza sativa
ttggttgttttctgcactttgaacgaaagcaagcaaattatcccttcttttatttggttcgattcagaattgacaatacataataaatctgagtaaattgttaagcaatcttagtatcttacattactcctttcctttaattgtgagatgatgctagagatattgagtgggattttataacatgatatatattcagctactacctgcagaatgcattctcttgtgccgtctaaaatgggaaaagaaatggctctaatttcactgagggttttttaaaatgtaacaatgacatagcattgctattgacaaattttatcattttaatttatttctctatcaggtcactgctaaccttgattatctaccctataattcaccaacttcactcctacatacctcattcatcaaatccaatgacccaaaattcttgaatctaacaactcacatacacggtgattgaggcaagaaattatgtagcatgtacagcaggttttcttggggaatagttgtgtttattgcttccaggataatctttttctaaaattatctgcactgctgtgctgcacattactatagtcaaggtctggagaaagcgtgataaggagagtattcttaccttagtgcaaagcaataggaagctaggcttcagaagaattatgagtacaagcagtgatggggcttctacaactgccactggaatcctaatgctcttatttattttaccatggaactgccactaaaattatgtgggtcatgaattttataacagtaccctaatagaaatggattttatttacaactgccactggaatcctaatgctcttatttattttaccatggaacggctactaaaattatgtgggtcatgaattttataacattaccctaatagaaatggattttattttatcatatttaattacattctttattgtgcttactgcattcgatttttgagatatgcacatgggtaagttcattgcactctataaatgtggtaattcactagcaaagttttgggagtataaacttgtctaggaaaatgcctgggaactggtcagaataccatgtggctctgaacactctgatttatagggtttatgataacacactgacttacttacctgaatattgtttctgaattttatcttattatcttcctcagataatttattttatgaggaatggttaaaactaacatgcaaactgttgtattcctattaaggccactgtgtgagggacgacgctgcagctgctgaggtcctgtcactgtctctccgtctccatctcgttgccacctctgccacctttgtgctgtataaatactttgggtttattatatcttgttttatttccccaaataggactaactttcatgagattttacttctatgcaattcgatatttggtgtgctttctaatgcagactgtttttgtgtgcatgtaggaagtagattttatcatctgaatcaagtttagatttgtacaatatctgcacaaa

SEQ ID NO: 46785 - DNA, 711 bp, Oryza sativa
atattgataaaaagaaaaattaattgcacagtttgcatgtaaaatcgcgagacgaattttttaagcctaattagtccatgattagccataagtgctacagtaacccatatatgctaatgacagactaattaggctcaaaagattcgtctcgcggtttctaggcgagttatgaaattagttttttcattcgtgtccgaaaaccccttccaacattcgatcaaacacgtccaatgtaacatccaaaagtttttatttcaccaactaaacatgccctaaaagcatgtaggcctgtcaattgcctaagtactccgttacattcgcagcccatgtggcaaaaattgttttgggggttattatgacattgattgatggaaaccagaatagttctctgacaaataattcagcgttttgtctcgagataaatatatatttaaaggtagtttatgaaatactgggagtaaattgtatccattttgtgcaactatttctagttaatggaccgttttctttatcatggcaacttaattagtacgatgcatctctacatcgctttctaaatgacgagttaggtgtccgtgctttgtaacatgaatggaacataaattatgatgagtcgattttttccggtaccggtttcttatgatgggttaggttttttttttcttggagaacttttttttttttgggggagacggtattttcttagggaga

SEQ ID NO: 46786 - DNA, 579 bp, Oryza sativa
gtttctttatttctttagagaacaaagaatatagaaagcatttacgtgaaatacctcatcattactagtataataagtgtgctaaaaaagaccgaacaaataacccgtaagtactccggccccctactcttaaaagagatcgttttacctataaacattgctattatagaagtagccaattttaaaacaaaattaggtacaagtagcgatatattaggatgagggagtagatagcaaaaattcagtaaagaaaaacaaaagggggttaatttctagttttcagtctagtaaaacccctaaaatttaagccactttttagacggtcgagatcgagattcacacgtgaagagtgaaccttatatgctcatttgtttttctcctcccctcattcccgctcgcgcgggagagatcaagcgatccggtgccgccctccccctcccctagccctcctcttaccccaacgtccaccctcagaccctaaattctaaacctagtgcggcagtcacctattgcgccatcaccggagaagacattgtcactataagtcctggccgaccttccctctcttttctctctaga

SEQ ID NO: 46787 - DNA, 983 bp, Oryza sativa
gtcgcccacatcgcgtacgtccactcactcaaggaggaggccatccccatccccgaccagtccgccatcaccaagggcaacatctcatccagatcgacggtgtcctctacgtcaaggttataactcgctccttgccttaagccgtttctgctttgctgcattgccgattactgctggtggtggatgcaatgagttgtgttgtgcgcgatcgagcttgcaattttgggcggctcatctggtgtgcttggtttagtgtcggtagcgtccctgaggcttgtgggttgggttgtggctgtaccctatttttgcttggtggtgttggcgccggcagtaactgctttgttgtttcttcggctaactaagttggtccctttttttctttttcagaggtaactgaaagatgttgatttacagtaatgggggtgactaaattgtttttcgaaattaaacgctgtctaaattgtttttgttagaatttttggggaaacttcaaattgcatgttctaggtaattcaattaccctaaaacaattttgtggaagcacatcgaaattcttttattaataaattgtcattcctggtccttatggtcatccattttggtaaggtggagctataagtgtgtcacaatgtactgcatttgatctgcatttctgattgctgctctgtttatttgataactttgcatgattgctgatatgttcctgtttttacttacagtgccagcaatttgcctccctcatcagggccacatctacatgtggagttcatctcccataaaagaggatgcacatagtatacctcacacatgaactctgtaataagctatggtgatctttatatgcttcaccaactggtgaccaatgggctcttttctgagaaaatagcccagattcctcttaattttgttaattttgcaccttggtgctcgtgaagtaagagcactaagttcagatggtatgtaacagtccatagttatggttg

SEQ ID NO: 46788 - DNA, 344 bp, Oryza sativa
gaaatagcataggcctacacttgtgaacaaccacataacttatagttttcatccaactgaaacctgcaataaagacatgacaactttggtgtgtttagttccacgctaaaattgatagtttgaaaaaattagaacaatgtgacgaaaaagttaaaaatttgtgtatgtgtagaaaagttcgatgtgacgaaaaagttagaagtttgaataaaaaagttggaatctaaacagggcctttggcagataacactagtccttagtaggatggcttcatttaaattatctggaagcctactattttcggatgcgcgcgcgtcttctgctcattgcgctaatcttctagc

SEQ ID NO: 46789 - DNA, 1450 bp, Oryza sativa
caaagggttaggtaacccatattgtttccggtgttacactaaagggcatacaatgcaagaatgttcttccaagttatactgtgaaatttgtgaaagtaaggatcatgttgctactcgttgcccgatatttaggtcaactaataaacctattgctcagttatgtggctatgctgcagatggtcttggttttttccatattccactttcagctggacagaggattaggcatgatccaaaggctgttttggttaaagtgactaacggtcagatgacaataaatgctgtcatatctgagctacatagattaatccctggtaagtgggagtgggtggttcatgacaatggagatggtacttttcgcactatctttccttctgcagctaaattgagtcgcatggtggagtggggcaaggtacacactaaggttagtgaggctcagatggagattgtagaatggggtgtaggaaatgaggtgaaatatgtggttccgaaggtgtgggtacagtgcaaaggccttccttctgaattgagggagtttttaattatttgggctgttggttccattcttggcattactaaagccgtggatatggttttcactagaaggtatgacatcgctcgtctgcaggttttggtccttgacccatctttgattccggatgtagtggatgtggttattggggatcacctgtatgagctaacctttagagttgaacctgaaaatgggcctgaggagcctatgcccatggagatggaaaatttggaggatggagatgtggagaagaatgatgaggggaatataaatcagaaagttgggaaggaagctggtcttgatgattcaggaaacggttctaagttgggttctggtgttcagtttagtgagaggggttgcccacctgctccttcctcacagctaaatctgatacatgaatatgatggcttgactgcttctgatgaagattttgatggctttgttgaagatactttaatggttgacaaggttcagactcagcaaaatttggtggcaaaactctctgctatccctgaggcagtactctctccatcaaggaagagtaagagaagagcaagtgacagtgatcagcttgttcttgaaagggcggagaagttgaaggctgataagaacttggagaatctgcatactaaaggtatttatttaataatgtttcttttactgaattttcaaataatcaaatttctgcttatttggatagtcttggtgttatacctacttctgaaaatgttgttttagatgatgtaattaatgatttgaaatgtgtggagagtaagagattaagtgaatatgattgttctgctattaatcaggtttctacccctaatgttgatactgagtcattagatgactagttggaggacaattttctactacaacatctatgtagtgaaattatggaggaggtcatggatttca

SEQ ID NO: 46790 - DNA, 1501 bp, Oryza sativa
ataactaattcatttgaactcagtttaatgtggttcaagttgcaaaagttgtgtaaaataaagatctacatactaaaattgtccataaattgaattaaatttatttaattctttttaaatgggctttaaatagatttaatcttgtaaaattcataataaattcatttgaagtcagaatgaggccgttcaagtctcataattcatctaaaaatatgatctacatgtttgtttactttttatgtattgtttatttggtttttattagtcttttctttgttttgcttgttagcttgtcgtttccgtcgttgtgaaggttcgcgagtgcgccggaagtattcaagaagattaattgaagaccgattattgcaaggcaagtcacacagatcctaaacacaatcctttgagcatgttgttcctatatttaaattctctatttatttcaactgtgcatttattttcgaatgtcaccgggtggtgtgaacttattcttttgttatggccaatttgcattgattattctattccttgataccttgggttattataattggactagttgagctttatatatattggttcaactagatattagatataattgcttagccatgcttagaaacattagcacactattgggataatttatgactcattattatttaataatggcttaatgatagttcacgatggccaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgcctctggtttttgagggggtgattatgatccaggaatggtgcgctgcggtgggttgtgttatgcaaggggtaatgtcacagctcctttccgaggtaccgtggtggtactgaggcacatggtgacatgatgtggagctgtgtcttgtgggtacagtggtacacctctggccagagtaaaactattcgaatagccgtgcccacggttatgggcgagttgagcaatgtttttcgtgattagtctcacacctctcataataattatagatgttatacctggtaataatttgtttagctcctggtttggagattagatctgtacagccgggtatggttgttcaggatggttgggcctgtgcagcatgggtgtgctgttcagtgttgattaaaatttctgattaattactccattgttttacttctcttaaatgttttgctaattgctgcttttgcaaatgagccaatattatgccatcctttggtatccttgtgcacttgcatatttgctgtgtggcttgctgagtatgtcatatgctcaccttgcaataatcaatcaacctca

SEQ ID NO: 46791 - DNA, 1501 bp, Oryza sativa
ggctgtacagatctaatctccaaaccaggagctaaacaaattattaccaggtataacatctataattattatgagaggtgtgagactaatcacgaaaaacattgctcaactcgcccataaccgtgggcacggctattcgaatagttttactctggccagaggtgtaccactgtacccacaagacacagctccacatcatgtcaccatgtgcctcagtaccaccacggtacctcggaaaggagctgtgacattaccccttgcataacacaacccaccgcagcgcaccattcctggatcataatcaccccctcaaaaaccagaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattggccatcgtgaactatcattaagccattattaaataataatgagtcataaattatcccaatagtgtgctaatgtttctaagcatggctaagcaattatatctaatatctagttgaaccaatatatataaagctcaactagtccaattataataacccaaggtatcaaggaatagaataatcaatgcaaattggccataacaaaagaataagttcacaccacccggtgacattcgaaaataaatgcacagttgaaataaatagagaatttaaatataggaacaacatgctcaaaggattgtgtttaggatctgtgtgacttgccttgcaataatcggtcttcaattaatcttcttgaatacttccggcgcactcgcgaaccttcacaacgacggaaacgacaagctaacaagcaaaacaaagaaaagactaataaaaaccaaataaacaatacataaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttagtatgtagatctttattttacacaacttttgcaacttgaaccacattaaactgagttcaaatgaattagttatgaatttttaaagattaaatcggattaaaacctttaaattgattttaattaaattatgacgcaataatgaattatttttgaaaaggaaaagaaggattattgcgtcagcggctagggtttgcggtggaccgggtgcacggcagcggttcacggaaacaaacggccgagatcaaccctatccaaaacggacggccgagatcgatcggtccacgaccggctcacgggagagggcgacga

SEQ ID NO: 46792 - DNA, 162 bp, Oryza sativa
gaggaggactctgaagtgaactgccatggcgagcatgaagcagcagcagacgccggcgagctccgcggtgaccgcggcggcggcggcctcctcctccgccaccgccgccgtggccgcatgcgaaggtatactgcttttttttttctcttctcctcgctcgtc

SEQ ID NO: 46793 - DNA, 162 bp, Oryza sativa
ggactaaaaatcgacaacaaccggggactaaagatggctaagccacgtgtcgggccagatgagtcaaactatgggcaaaataaagcccgtcaccgatggagatcatccgtgacgggctcatacttcactcacgagtatatctttgtcggtgttttttttagc

SEQ ID NO: 46794 - DNA, 404 bp, Oryza sativa
tgcaagtagttcatcacaattctgctgaggtgtaatatatatccactagttagttactttatggatgttggtgttcttcacccttggcaattcaggacgatagaattaagatgcaagatcactttgtgttgttgtgaagatatgagatattctacacgctgagatcaaaaatagagagaattacatcagtatttatcctgcatgttgcgtgcacaaaagtagttgaggtgttgcaggcaatctaatgatatttgcggccacaagcactgctccagcctccatatgaactgtttatttgtgaggtgaccatcaatataaatgtatcctgacgagcgggtcagatggttattccaaaaattattagaagacatgtgaaaaattaaccttttttaactctcctcaga

SEQ ID NO: 46795 - DNA, 289 bp, Oryza sativa
cacacacccaaaacatgcataaacaataaagatggagttcaacatttatcaggtacaactttgaccctttttctctatacacataaaattatttttttgtactataattaatttattttatagacgtaaatagtaacaatcagagggggggaatcaaaatgtctagaaagaataaaaagattatctagccaaatttatatttgcacaatcatgttagatgttttttcttgttactttttttttattttttatgtggatgattttttgttagcaaacttcactgcaaaca

SEQ ID NO: 46796 - DNA, 1501 bp, Oryza sativa
agtgatatgcttttcaagacatagggttatgacatgaaagttcatactctgcactgtaaatttctgcacaactcatgtaaagttttggccttaagctggaagtcatctcaaatttgagagatgtctgccgtggggggaaagatggtggttattatctgagattagtatataaatgtttctcttttcttgaaatgttctcgtggtacccgttagtttgtcatatctgataaaatgactttccgacactatcatttttttttcctaaaatgacatccctgagctgatccaatctgctggtttaaatataatcatgctgtattcggattctacgcatatactctttggaattgtgtaattaattagagcaatgaatgtactagttaatccacacgaaaacatgtctcaaacatgtcctaaattaccctacaggtcccttcactttgcttttttggaggtacaagtaagaacacaaatcaatgcaactccacacttgcaccatcgcatgcacacacacgtgcgtgtcttacacacataggagtactttttggtacagattatatgccacggacctcgaaacacggaaaacgtgcgttcagcgcacacttttgggtagagattagatgccacggacctcaaagcacggaaagtgggcgactcccgctaagagccggtacaatagcaggctataaaccagctacaaatatattttaagaagataaataaaaagagagaagagcagtgggctacagatttgtagccagctgtagcacggactccaaaacgcagtgtgtgcatgacaggtgagaccatacattaatagtgtagtatgtaactattgtatagatgagctattagattaactatagataaattggagctagtagttggccatactattaaacttgctctaaacgcgcacacgtgtgtatcccattctatgggaattaatctcacgattgatccccaaggagcgaggaaaaaatcctcctaggccacactcggaatattggatttcgtaaccaatcaagcgtgaggggcatatcatgacggtatgttgtcaccaaaattccttgtgacggcatttagactttttgtgatagtaaggggtagtcactaatagtccattttctagtagtgtacctttgtcctagagtttttttttaagataatggaagctttattagtattagtcaattactaacactcttttttatagctaagatgcacataaccaaaatacacttaaaaaaagtgatcacaggaaaagtattaaggactatcaattatgagactagatatctagatcaccgcctatgttcccggctaaaacacatccttgaccaccttgtccaatcgtggacaagccacactcaccaggtccagcaaaccaagcttttgaagaataactcatgtacaaaactagtaagaaaataacatgtagaggagataaaatagctttaacaatgctatttgcacatcataattgcaaaactaatctgta

SEQ ID NO: 46797 - DNA, 483 bp, Oryza sativa
atacatataagagatagtcatgagttattcggcagtgagaaaagggaccacaatcgaatactttattattgagcaaaatcgagggtattattttttttatctttttttaagtagaactctgtattgttatgttttaacatatcatgagattattagtaatagttaagtagaccgcccaaccataccatatagtaacgataaatctgtagtgacttaggatagcatgagactacggctaatggacaaaaatagtaaattcattttgtacaacgtatttttaaaaattttcatattatatcattctttaatcattattttcatttataaaatagctaactttatatttttgtttcaatttagacaaccccattctatccatcttcaagtccggtggaatcaccgttgcttcacctccaaatccagtgactctacaaccactccatacacacactctctctcctttttctttttccctctaatagc

SEQ ID NO: 46798 - DNA, 1501 bp, Oryza sativa
  unsure (1)..(1501): unsure at all n locations
gtccggcccagagcaatcgcgacagacatgtgtcatataaaatcagatctcctaccgtagatgccaaccacgggtgtgtttaattcacgccaaaattaaaagtttggttgaaattggaacgatgtgacggaaaaattggatgtttgtgtgtgtatgaaagtttggatgtgatggaaaagttggaagtttgaaaaaaaaatttgcaactaaacacggcccacgtgactttctttagacagttcagagttccggatcgtcaggttcaacaagatttgcagcattgaaattgaaattcaggggatttaacattttaacactttttaatagatcagtttaatccctctcacaatcgcatctctcacaaaacggcaaatctattgacactacccatccagagtggcaaaacattaattattccaaaattcagtggtagaagcaacaagttcaggttctaatatcttgattctctttagatagataaagaaaatggtcatattgatgtatgaagaaatattctttggttcgggttcagttgctagtaaaaaaatacaaaaggttaagcagaaaataaaatgaagaaaatcaacgggttaaaaaaaatttaggagaaggttaaaaaaaatgaagaaacattaagggtgtgtttggataatgggataagagtagtgggattgagatagggaaatggatgaaggctaggatgaaatgagggagggataatggatggctaggatttgaagaaactctttggtgggtggaaaattattttcctaatcattagctaaacatgacctaaggagtaatagcgactagcgaccaccatgggtttacgtcagtgtagagtgattcgatcaacttcaaatccatagtaacatcctgctctttaaggtcggttttagtgtagcttgaggggacatttgcgtccaaacaaaagacggatcgatgaaaatatgtcaatgccgccgggagttctctttttcagtagctaaccgtttccgtatttgtttttttttcttttttntcccttcttntgngncncngcccntgnggcaacggccnccttntnctgaatgtttgttgtgtaactaaactctgctatcttcttctaatatattaacgtgcgatttttttgagcgttcgcgaaaaaaaaaatatgtcaatgccgccagacgacgacgaccacaaatggcacgaatcagatttgacaagaatacctgtaacatgattacgaatagatgattattaaatgcatttatctaaaatggtaattttttaagggttaattggatccatgccactgtaaatatgccaattcgaaaaaatactactactattcgcgatatcggctacgtgccactgaaatttagggaaattggaatcatgtcacttccgtccagttttatgtcaaccgccgttatctgtctccttcttcttttcttcgcttctccgccatagacaccggtgagcactccacctcagactcgctggtccttgccactgc

SEQ ID NO: 46799 - DNA, 1501 bp, Oryza sativa
  unsure (1)..(1501): unsure at all n locations
aaaattcaagtgtattttaaattcgttttatttttaaattaataccgaaaatatgcaaatttattattatcaaacttattattattattattaaattgaggcaaatgttatataatcgaaatagtcaaattggtccttccatgttaaaaattgcaaaattttaatttttcttgttaaagttcaagtgcattttaaattcgttttatttttaaattaagaccgaaaagatgcaaaattattattattaaactaaatattattattttttaaaaaataaaggcaaatgtgtggtccttccaagttaaaaaaaatcgcaaatttttagctattgagctaaattatatgattaatatcataatataagttctcaaattttttgtccaaatttaaagtaaataacaaaacatgtgatattttaaaagaaaaacaacaaggtagagtcagaggataaaaaacggaagaaagtatcgtactggtgtgggaacatatggagaaaaaacatatgctaccaacaggctagcgctccttttgttgtttactatttctatgcattatggctgtgtttagatctaaagtttgatccaaacttcagtcattttccatcacatcaacctgtcatacacacgcaacttttcagtcatatcatctccaatttcaaccaaaatccaaactttgcgctgaactaaacacagcctatactcagaaaagaggtcagcgccagctactacggtgccgcgctcccctcacgtggcggcaattgatttcgtgccaccttggacatggtacgttatatcctggtgccatcggggttgacgttgaggtcatagtttatttttggaattagttttttatatgggttattttttaaataagttttggaaaagtgtcaatttatcaaaacctacctcgtcgcgtttagctcaccgtgagcagtcgagagctcaccgtgtaccaatccggcagatcgccaaaccagttccgagcgcgagccgaggcggaaacacttccatttcgggcgcgagaacagcgacacgctgccagagtggctgcctggctggagacacgtgaggcgagacgcgcgagtgatcagctaacgtgcacgtggcttacagctgtgcccttgttcactgtcaagtgtagctggcanaagaagaggaggtaaaatatgatgcggcttattgctgggcagcctggggccctgggcttgatgagaataatccgctaggaaaaagtacacgcaatgtccctcaaatttgttagccagatacaaaatcgtccccaaccataaaacaggatatctggcgtcccccaacttataagaccgatcacaatagcttcctcggcggttttgaccacggttttatcccacgtggcggctgactcagcatgggacccacgtgggccccacatgtcatggagactatgtcagcaccctctctctttctctatttctctccttcctttcgctctctgctctcgcacaggcggcggcgcgcgcggc

SEQ ID NO: 46800 - DNA, 1085 bp, Oryza sativa
agtaagtattaagtcttcacttaggatcatcatttcttttctcatatatatctcttaccacatctgattgtccaagtttatgaacatgatatatttatccttttctttggtgacaatgtaatgactgtcctattaagtaggatttgtttgtacctataaagggatgtgcttacctgccaggtcttgattctgacaccagtcatggttctgaacatgttgacatctcttacagtaacattggagacacatgcttttgtgttgtcccggcctaggcctccaatgctgattccatggccaggtccacaattcacattgtgtatatttatattgctgcatcctgtttgaatggagacgcagtcatcacctgcatcatattcgaccaaaaattacatgttaactatgtttttctgcttttgttgagtaactgcaaaagatagcttcatagttcagtactcttgaagtttttcctggtaccctcctgtcctatacactgcagaatttgcaggacagggagacaggatttcagttgtttctaggccttattgagcatacacatgtctcttgcccttgtttcatgtatggaggattttataaaagaaaatcgctaagcattttgatgtactttagattcatataggctctaagttctgcttcagttcagttatggaggtagtaccacaagccaggttggtatgatgaatgctgacatctttagagttctgcaggtgtattccatcagtgttgaggctgttttctggggaggatattgttacgtcatggaccatcactccttgacagctgtcaaacttgagatgacactgcgagctgttgacaatagtgataccagctactacaacgttgaaactaccatagaatctcagtgcctgcatcagagtaaagttcttatgacttggttttcgtgtgcacccagacaattacaaatgtgatttgatatagtgatcttcttactgtaggtttaacttgtggcatcctttcaaactccacatcgtactgtggaagtatccaaggtaagtactaaatgacccatctttggaatggttggtttataaggatatgctaaaagg

SEQ ID NO: 46801 - DNA, 1501 bp, Oryza sativa
ccccaccaaacggcagccacatcggcggcgccgtcatgttcgatctccccttcctctgccgcctcaccccgacgatgaccgccgcgctcctccccgcgcgacggcagccatcggcggcgccgctcgtcccatcggccctcctgtcgcgccgctccttccccgtcagccgccggccacgccggccctcctccacgccgcgtcgaagacgctgccgccatccacgcccagaggaaaaaggagagaggaagagagagaagacgggaaaaagagaaagggtggtgacgtggtctatctgacatgtggggcccacatgggtcccacgctgagtaagccgccacgtaggacaaaaccggggtcaaaaccgccgagggatctattatgactggttttgtaagttgggggacgtcggatgtccggttttgcggttgggggacgattttgtatctggttataaagttgagggacctttggtgtactttttcctaatccgctatagctatacatggccatcaggcccgaggcccgacggcccggcccacagcacagtattttggccgaccctaccactgggccgtgcctgggcctccccaccggcatgttgggtcggcccggcatgaccgacccggcacggcacgatgggtcggtatgccaggcccaacgcataaagtatagggagtaaatatagacattatcgccacagtccaaagaatagggacgtaaaatagacttatttcagcccaaagaggagggagggaaactagacttattttgctggaccaagagaagggtggaaaaatagacttatttaggtagccctaaggaaggcctgatgggccacccgtgcctacaggccggcacgacacgggcccgactgctggtgggccgtgcctgagccggaggtgcagcccatgggccagcacggcacggcatggtgtgttggtcgggccgtgccggcccgacagattttggcccgagcacggccgtgccgggccgggccgttcgtttgaccatctatagctatagctagctaattacttaaacagcatgcaaagattaagactgcactgtgttttaattttgtcaagctaggcaaggactttgtgacgagttaactagagtgagtaatatattttgaggtggcgagtgtacggttgagcttgcagtatgcatgcgcttgctatgcatatgcactactaacttttaacatatcagtgaaaggccaatggataacttcagttattatacatatgccctcctgagtacttgtatttgggaataaactaggcattcaagataggaataaaaaactccactacttatactttgcagataagctgagaatcttgttttgatgagcatttgtcattttgtttataaaagaaacgaaggaaatttccaactaattttatcactggacaagttcaaaaatccacaaacttgacacagttaattagtggaacacaaaacatgatgatgttaagtgatgtgtttattttgtagc

SEQ ID NO: 46802 - DNA, 1501 bp, Oryza sativa
ccatccagagttatcctccggtttgtcttcttgtccttatactgaatggtgtcttccattaatgttctatcaactacaacctggaaatatcaatagacaaaccaataagtacctttcagttgggacattatggaactgaaaaatatgtgataattctagaggaacaaaaatccatatggtttttacttgcaggtagctgggaattaggatgagtaaggaagtgcatttggatatgtcgaggattaaaatcctccttttgaaaaataacttagaatatttttaaccaagttatttagattgggaatattagaatacaaaaaatttcaaatgagcacataacagacattgaatgatgagccatgttgtttaggtaggaatatggaaattgggagaatgacttacatgttttcctttgataatatgcctgcacttgattattttatcagaaatggcagcatcggcataagtaattttagcagaatcccctgcctgggctgtgcccttggccctgataataatcaaatcaactatctttccatatttaatgaaatagtctgctaggtcagctgtcataaaaaatgacagaaaccaaattagtattacaaaaagttagtatgccatggaaaatctgtttaccaggtagctgactgtaaatattataactatggaattcagattagttaatgagaaaatcgtaatcattgaaccggtgcaatagatgttataatccatcatcctccattataggaattattcactgttgttcttaccagtttcaactcataaagtacaaacatctcttaaatcgcatgatggagttatgcctttgagtcaattgaactgtatatatttataaggaaacataaataccaaccagggcagacgaatgggctcatgaaataggtgcgcaccatttgctacttgcatagaatatagaaacaaaaacccagaaactgagcacacagattgaagaatttgcctcagcaacctagtgtgtcattccagtcagatatttattgtcaagtacagtacttaacggaatctatgaatatctatcttccaggacttgctttgagctgttagaaacttttatttggagcagaaaaaataacggaataatatccccaaaaaatacctgcaataatatggaaatttaaaccaccctacttaacagaatatgatgtggtttcattaactagggtataaaggagcaaattaccatatgacaattcgctaggcagccctcttataacaacttgcctgcagcaccaaccagaccacactgatgttaattaagatcaataaataactggtgaaatggtgggaaggggtggggatagtgtcttacccagcatggctgctgccctcgccaagttccttaatctgtaccatcgctgcagtttttcctttcttttttcctggaggccggaaacaccaaaaatcaaaaaaaaaaaggggaaatagtcaaattgcaagagagagagagtgtgtgtgtaaaaat

SEQ ID NO: 46803 - DNA, 616 bp, Oryza sativa
gcgcattgctgcgggaatttagtatgataacaataaaaaataacgtgtaagatagctagataacatcagattaagtaaattaatgtggtttatgataatttaaatttaaatagtatatagaatgttgattcaaacgtaaaatgtaaggtggtatgactttatggaagaagaaaagtagggagatagtttggaatgtagattaatcatctaaaggctaaaaacaattgatgtgatatgacttaattagaggaaaaaggagaaagataatttggaccatagattaatcatttaaacactaactaagtgaggatgaactatataagtatataggatatcataaaacataataaagatatacattgaaacattatgtgaattatattggatgataatttaacatgtttgtatttgaagagctcttaaaccataaaaactataaagatatagcatgtttgcatgatgtttaaatgtgatgattgttagtcgatgatgatgtggcatcttgttagtggatgatgatgtggcatctttgtatgttaaacttaaggagttagtggggtataactttatagtaagataggattccacatgactgtggtgcctctctttatataga

SEQ ID NO: 46804 - DNA, 192 bp, Oryza sativa
acttgtgcatgaagatgtccttgccatcgagtggctgccgacaaagatcatagtacgcctgaaactccaccacctagaacacagtcgtgcccgcactgaaacaacacaggttagtggcgcatcgccgctccccctgagctctaagacctccaatggcgcggcatgggaccatgtggtggtggaggacgacga

SEQ ID NO: 46805 - DNA, 215 bp, Oryza sativa
actcatgctagataatatgcactggactagtagatgaacaatatagcctaattcaaatacatacaaaatgttaatgaacctaaggatccatgggtattcatcggtttctgtggctttcatgttatgtgaaagttgcatcgctacctttgctcctgctcaattatgcaggttctgtggatatctatctattgatctttcaaatggcaaccccaata

SEQ ID NO: 46806 - DNA, 231 bp, Oryza sativa
agatctttctacatgtggtagctggccgtgtgatccgttcatggcacgcgaaatggatttatattaagccgcaaataattcacacggcgaatctttagagagcgaggaccatgctcattatacaaagcaaaatcatgcaatcatcagcgtgtcatgatcgatagatttgactaaacttttgcttaattgccataaattaacctagaaattttccattgggcggagcaataa

SEQ ID NO: 46807 - DNA, 1201 bp, Oryza sativa
ccccaccgatcgatcgatcgatccgcggatgcggtggaaacggaggaggtggaggaggagcaaagcgctcggccgcgtcccgatcggtcgacgcatcacgcacgcgcgcgcatgttgcgcgagttcacgacagcgcggccgggccggtccgcatgctgatgcaggcgggccggggctgactttagaatgcgcgcgcgtgttctacgtgactttagaatgccgacggccaaccggagcaaacacgttttgcttgatggtgagttggcgttcctacaagttactactacaagactcagtataaacacgttgtatacggtcttggaagaattcaggcccatgttgtacgggatgtaatttttttcttttggaaaacttaagatattactatagattaaaaccaaattataggagctggggtaagatcactactggataactgatctttactcagatactaaaaataacattagtcccgattctattaggaactgagactaaaagatatatataatcccgattcaaaagcccagctgtactttttgatcatttttagtcccgattcaaaaagtgttagccccccactatctttagactatagattaacgcggcgtatataactagcacttagtgatgtgtgtggcgcctctctcgatcccctctccctctccctctctctctctctcaagctctctctcttgctccggcggtgggaggggaggagatggcggcggcgcatgttcattctttttttttttaagaatttgtgatgtatttgaatgtgtgaatctatgatgttatttgttaatccgtgatattatcttatttgcgaatctgtgatttggggatgtagtgtagagagcaacttgatttgggaaaattaatatgcaaacagtaaaaaacaatgaaaaaaagaaaaaaaacacatttagttctagttggtaatgatccatctctagttccggattggatgtccggttttcgattcagaaataaagggattataaactgggactaaagatgagttccgtggatattctctaatacattgtcttggaggataaaactttgagttccgtggatattctctaatacattgtcttggaggataaaacttagaaaaccaaaagaaaaaaaataaaaccatccaattgaaaagaactatggaataatctttcagataaaaccatactgtaataaagga

SEQ ID NO: 46808 - DNA, 1008 bp, Oryza sativa
catcaaagttagttcgtaccgtagaaaatttggatctaaacaaatctccttcttatcattacgttgagaagaattttgtgacatattattctcgtcgtggagggggtgcaagtaagactgagttggtacgagaagacttggagggggaaggagagaagaagggacctttgcttggaaatgatttatgggaggcaggaccatcaaagagacattgcggtagtgatgatgtggatgcagcgagggagatgaaaagggagttagtacaagaggggcttgatctaagtgaacatttgtcggcgagtgttcattggtcatcgtacggagtcaaccctgaatacccgacagaagtagcaggccaatatgtgaatccagatgattactttgatgtcgaattgagtggtggtcacgattctgtctcagtagaagtcaatagagatgatgttgacgaggaggcaagtgttgagcaatatgatgttgaatttgctgaagactctgatgatgaccgtccattctctccacttactaataatgacaagttagcattagaggaatgtcgtgcgtttgagaaggtgtttgggaggaagccggacattcctgagtttagggacctaacacatgcccatggtgcactactagatggcggcatcaacctagatcagttgccagaaccattccaggtggatggtctcagaaagggtttagagttcccatccatggtcgcattgaagctatggctccaggattacgccatcgtgcaccatcatccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcagctgacatcaaagttcatagcaaataggttatgcaatgccataaaactgcaacctacactctctgcttctg

SEQ ID NO: 46809 - DNA, 187 bp, Oryza sativa
ggcagtgttcattggtctgcatttgccaagattgagagcgagttgactttgcgggtttgtggcacgcgactcggttcaccagacggctgacgtgtgcgcacgtatttgtgcatgcatatggttcgtccaatgtgcggccaagcaaggccaggtgtaaatttgaacatttttgtttttgatttttagg

SEQ ID NO: 46810 - DNA, 1501 bp, Oryza sativa
cgctttttaaactgctaaacagtgcgtttcgtgcgaaaattttctatatgaaagttgctctaaaatattataataatctattttcaagtttgtaataattaaaattcaatcaatcatacattaatatcacctcgttttgcgtaaaaacttcatcttcatcttcatctccatcttcaagagaaaataacaccaccaaaatatgatgcggcttagagcaggtacaatagtaggctataagtcagctacaaacatattttaaagagataaatgaagagagagaagaacatcgagctacatatctatagccagctgcagcacggactccaagacgtaatgcgtgtatgacagatgggaccaggtattaatagtataggtattaatagtatagtaagcaactattgtatgaattggctattacattgactatagatgatttggagttagtagtgggctatactattaaacttgctcttagccggctatttctgggcagcatgggcttgatgagaatataatctgctatagcttgctaattactcaaacagcatgcaaagattaagactgcactgtgttttaattttgtttggcaagctaggcaaggactttgtgacgagttaactagagtgactaatagatttttgaggtggccggcgagtgtatggttgagcttgcaggatgcatgtgcgcttgctatacatatgtaacttttaacatataagggccctctttagatcccgacaaaattttatatcctatcacatcgaatatttggacacatgcatcgagttttaaatataaatgaaaaataactaattacacaaattgcgtgtaaattgcgagacgaatcttttaagtctaattgcgccataatatgacaatgtggtgctacagtaaacgtttggtaatgacagattaattaggtttaataaattcgtctcgcggtttacatgcggattatgtaatttgttttgttattagactgttcaatactttaaatgtgtatccgtatatttgatatgacacgccaaaactttacccctctgatctaaacacagcccatgtgaaagaccaacggataactccagtttttgtttttttgaaaaaaaaagactagtttttcgattcaatcattctgtggactttatccacattgtggatgagcccgttccctcaaaagatgatccgtcaatacggacaggtttggacttgtacccgccgtcccgaaatggaagcgcctcaaaagaaagcatcccttttcttttgccaaactcggcaagtttgcagcatttcgcaagctagccacgacttcggagagcatgtggctccactcacaaacatgtgcgcaatgcgtaaagcactaaagcctcgtgacctcgtcgcgtctatataaacaccgacggcgccgggtgtccgatcaatcaggatccaagtgtgcggcagcaaatccaccgccccctcacccgtctctgctctgctctgctctctgttcctcgcggcacgc

SEQ ID NO: 46811 - DNA, 1501 bp, Oryza sativa
  unsure (1)..(1501): unsure at all n locations
cgagttccacccgcagtgcgtcacgaacccgccgacggccgggtggttcaggatgagcatctgcggcgcccagccccggatggtgaggccgcgttcgccgcgcggcgcgatcagctcggcgaagccctcgggcatccactccgacgcgtcggcgtccgcgccgttgataacccacacgaagttcttgccggagaggtcgagtcctcgggcgagctcccgcatctccgcnnnnnnnnnnnnnnnnnnnnnnnnnnnggagacgtacaccaccgagccgcgtggttcgcgtcgagccaccgcaggtagccgtcggcgtccggcgagagctcgctggtacctcgcaccgccacgtccttgttcgcaagagcgaccggcccgacgagccacacgcggcggccgagcgtcgtgcggtagtgctcgacgtagtccggctccagctcgtggaagctgttgaacacctcgccgaagctcctctggtcggcggcgtctaagctctggaacttctcccagtggtccggccgcttcttcgggtccatcatttggctccgcctcagctcgacgcagtgaggcaagcccggcaggggcacgacggcgtcggggtcgtcgggggcggtctccagcgggttgttgcgcagcatgctgttggtgcaggccctcgcgaacacgctggtgccgaggaaccccagccgcgggacgccgtgctcggcggcggcgtccgcggcccacctgaagaagctgtccaccacggcggcgtcgacgtggtgctccgacaggtaccggtcgaagggctcatggagcagcctaatgccaaggaagaacttgtcacggtcgtcctgggtcgtaagcgccgtgccactctcgaagcccggcgggagcccaacgtccggaaatggcacgacggtgagttcgatcgccaggccgccgttgttgcgacggaacgagtcgttggcacggtccacggccgagcggatcacggcggcgttgacaggggtggtgaggatggtgcacctgacgccacgagcggcgaacagagcggccatatcggcgatcgggatgagatgaccgggcgcgaggaatgggaagaagaggatgtgcagtggctgctgctcatccttgatagccatgtgtgacctagtcagctagaacagagtagaatgctagttcagaacttgaaagcagagtgtgttgcaagtccaaaacttcagatgcctgaaaactttgtgctctacggaagaccggaaccacccattttatagggtctaatcgaaatgacttcagttctcattatcgagcggaaccatcgaggaaaactagtgtaataagtcgtatctgacttggtgatcatctccccaattgcttggggtgccgtccaagtttagcacgggctctgaataattgcgcaggtagtgaatacttttggcagaaatttgtaagaggtagagtttttctcactttgcgttgatccgaatgtatgaataagaatattcagcttatgaataat

SEQ ID NO: 46812 - DNA, 1501 bp, Oryza sativa
cttatttttttaatggaatcagcacgagagtgtgctttttcattgaatatagtaggagaaaaaatgcagcccctagagcaaagaaaaggcaagaacaaaaaactgtacactatacaagatgcaggataagctcgcgtagtctcttggcacccgctcacgcccacgtggcagcctcctcttttatttttgcaatgaggtactttgttgtggcctccttgtgctcaaagattctccgattgtgttccttccatatttcccaaacaacgaggaggatcagggtgcgcagccccttcttggggatgcctgctgaagcagcaagcgtttcccaccaatccttgatcgtctgagtcgtctcccaaagccgagggtcgaggtgaagatatcccacccagttcgctaccatgctccaaatccttttggaatatcgacattccgcaacaaggtgcaaggccgtttcatcctctctcctacagagggggcactgcccgttgttctgccattccctgtttgtgagacggtcagaggtccatactctattctggatgatgagccaggcgtgaagcttacatttcccatgcgcccaagctctccaaattaacgggtcataggtcgtgcctggcgcgccaatgcactgagctttgtaggctgacgaagccgagtactgcccatgagttgtgaacttccaagtgatttggtccggttcttcttcatccagctgcatgccacggactgcaatctatagtgccacgagttgttccacaagggtcactgagatttgcgggtttgtctccaaggccaaatctccgacccaggcatcatacgccaaacaatggctcttaaagaagtgaagagggccttctatttttggttttctgtcatcagtcatcacccttctcttttttgttttgtgtgatgctaatcgcgtcactgcgtcgttcaccacgagcgttccatgtgaagtttacgtaagcggtgacgaagcaagtgcccatgttccggggcggctcctctccaccagtatcagaagaactcaggagatagctgttcagtcgtctcgtcagcacgtacgcccatctttgtcagttttctcttggcaccaacgcgcggttatttatgttgaattattcataagctgaatattcttattcatacattcggatcaacgcaaagtgagaaaaactctacctcttacaaatttctgccaaaagtattcactacctgcgcaattattcagagcccgtgctaaacttggacggcaccccaagcaattggggagatgatcaccaagtcagatacgacttattacactagttttcctcgatggttccgctcgataatgagaactgaagtcatttcgattagaccctataaaatgggtggttccggtcttccgtagagcacaaagttttcaggcatctgaagttttggacttgcaacacactctgctttcaagttctgaactagcattctactctgttctagctgactaggtcacacatgg

SEQ ID NO: 46813 - DNA, 1501 bp, Oryza sativa
gagaggacgacagaggcaacttgcctcaatatgcactggtagtagcaccatcaaccaccttcgcaccgtgatacgccgtgccagattgaggagagacgaggttgaggtcgcacagcccctgttggcggtgacctccacgaggaagatgatgccactcggctaccgtctgattgctcgatctgcctgactacaccactgcagctagaggaggatctctgccttctttctcgtccaacccatgccgcctctaagctcaggggggaaggaggcagcgaggactggggaagggagagaccagcacaacgaggggataaggggataatgggtggcctcagttgaatattcgctatattttcaaataagggaaaagatcaaagtgctctttattaacaagaaaatatcattagggatttagggtagatttgtaaaggcagtgaaagaacaaaatttctcaatttacggatcgagtatacgtaagtggatacaaatttcaaaattgatttatttgaaaatagagcgaatattcctgtagtaacctgctttatagacactggactgcttgccagcatcaaaataagtgcggtttcgtctaccaaaagtccaaaatgctgacggatggaattcgatatcttctcgatctgtttggtggcctgttgttttcttgccctatcctatttttttgagaaaaattgtcttgccctatatgctgagatggcctacggtttgggcgacgtacgtcttcgtttaaaaaataaaaataaatgagcaacaatattatcctgataccaacatgcatgtattatttatatatgtgtgtgtttttaataggaacttataataccatagatttgctgttgttttcgtcgctacaggaaaaacatttgcacgtgcgtctgtgtatagtgtgcataactagtggtggatgcactgccctctccccagatttcttgctcctattctcacttcaccaaaacaagtaggaagcgtggtggatccgtgtttttttaatacttctttcattgcttcctattcgtcctgttcattcttcaaaaagaaaaattctggaaggttcctcgcatccgacggttgtatttcatcgtgccagtttttgtcttcatgtggatccaacggtcaatttttttagcttacgtggctcattatcgttccatcatgagattaatttttcacttagagagatgtgcggtccaatccaacctgatcccccagagtcgcagataacataagctgccggcagattctccaccggaactcactactgcacaaatgattttccagtcatggacttatttagattgtagacggaccataattggtcacgtctgtgaaaatatactcattttcgcgtgcggtgagagccgcacgcaaaaatacccaccctctctttcactcctacctactttaaattttccccactttctctcctctccttttctcctctcctctatcctttctcctctcctccccgttctatctcctctcc

SEQ ID NO: 46814 - DNA, 497 bp, Oryza sativa
gttgttatatgttgggacggagggtgtccagattcatagccaaaagttgttatatgttgggacggagggtgtccagattcatagccaaaagttgttatatgttgggacggaggtagtcacaatatttctatctaagaccatgttcattcagtattttttcattacactggagcaactatgcaattcttttacttgatatgtaaaataaaagcatgagaggcccatgaatttcacctatgattgtcatgtccatttctgtgtggatgttccaatgttcaatacatgcttattgcttttgcattgttcaatacagtcttatttttcaatacagtcatattttttgaagaaataaataccctttttgttagtatgatttggttaaaagctttggggttcacttccctcattggggtgatttttaagattcaggtctttatcatctaataccatagtttccactagtaaaatatctacatttgacattacagatcccttct

SEQ ID NO: 46815 - DNA, 1501 bp, Oryza sativa
cattattatatatataaatttattagcatctatatgaatgtgaacaatgccagaaagctttacattgtgaaatggaggaagtagatgggagaaaacgaatcgagggtgcaatgataaaatggccttcatgattttcatcggtctttgtttaggcttggccttattggcttatgtgatttataagtcggtggatttaatgtcctaagtttagtggtggaattatacatctacctcaaaaaaggaaaaaaaacttctccaacataacttttggcttaatagtgttagagtggcttatggcttaaaaagaccaaacgaataaactgcttgtttgtttaggcttagacttttcgacttataagttagcttataagactaaacaaagagggtctaaggatatggtatccgcaaaagaaaccaataaccgtaaagcttgagagggccacgatgaccgaatcactaaaaaataatcagtcgcgtgcctcccctcgtggccacgtggcacgtgcggagaagagggctgcggtggccctcctgtgcggcgcatttctcgttttttttcttcgtttttttctttcaatttttcttttcggtttttctggttttttcccttgatttctttctgtttttaacatatatgtatataaattttgtattcgtacatatataaagtttgtatgtgtatgaatacaaatttttttgtatacgtggtgtttttcttggttttcggttttctaaatatgtatgtatttacgtagtatacaaacatggtatacgccatgttttttcttttttcttatttttttaatacgtatatatatatatataaactttgtatatgtcgtatataaacttttcatatatatatatatagtataaaagatatattttttatagtaatagtatagtagtagcaacagtgtaatagatagtagtagtggtagaggtagtactttaccactactacgagtgtgtttagttttttaaaaaaaagttggaagtttaaaaaaagctgagagtttgaaaaaaaaattagaagtttacgtagtatgtgtatagaaaattttttaacgtgatatgatgtgatgcaaagttgggaacaggtaataacttcacggcctactagtagtactgccgtactggtagtagtactactgatcgcgcgggggcattagcagtccccacgatgacaggtgggccctccaagtgccacgtcagcctaaaaccctgtcttcctcgccgcaaggccgcaagcatcgccaagacagaatccaagagaagaaaagttacaaaaccccattccgttattccagcattcgccgttgcgcttcagctcttctccctcccgccctctcaaatttcccccaaattctcatccaccaccacgccgagacgccgaccccgccgccgccttcttctgaagcgtctccccgcatccacctccgcttctctcctcgctgctgccgacgcgagcgcggcgcggggaggcgcaggcgcaggccca

SEQ ID NO: 46816 - DNA, 1389 bp, Oryza sativa
gcttccatcccactttgttcaaagcctaagctatatgcccccttacaaatttgcaactttacatctcccatccgtcgatgtgtatatcgccttattgaccagacaaaaactagctaccactgacatgtgacatttagacattgtgactgaccaccctgatcgatggggccgctttagctgcctgagaagattggttggtgcggctgcaccgtacactacgcatgtttgatcctgcatttttttttcttctcttgcttttatttctttttttcccgcgaaatatgatgcatcgtacatgcatgtgtgcatcacatacacgcagtgacattcatcagcatcatatcacctgttgcaagcaccaatttatagcagctagtcacaggctagagaacagtttcatttacgctgagtactatatgaagtgaagtcacttcatttatgtgtgatcattcagtaatcagtattgtagtagaactactagctagcagaaaggagatcgagatggtacagtactaattgaatactgaatcttgagagcaacagtgaaagatgatcagatgatcgtgtccactgtccaccgaaactagtacaccgttgggtgcatgtcgaaactgccggagtaccatccgtgaggtatacaccaaacgccatgaataagtgttccttcttgttgaccccagctgagttgaatatatagtgtgcattcgatattcttgagcgataagattatcggttaggtcttttctttcgctaaagaaaagaattagctagcaaagttatcagcaaggtgctttacatttcacagtgggtcgggtgaagttttcagtttgatcaaaagcaacctctagctctgcaacattttcacaacatatatggaatcatggatccgttagtaacataaagtagttaatctctctttcatggttgttatgatcttacatttgtatatgctccgaaagtaggaagaaaagctaaaacaaccctacatgaattgtattgtagtggcgttcttcagaagaccaaacatgtttacaagtataggcactccaactaatgcaagtgcgagctagtagtaactacacaggaatgattggtcatcacatagtacggttctgttgaagcatagatatctgataggccagtacttgctccactcgtgtggttaaacaaagaggggcacattattaggagtaatagacaaaaatcgccatagtttctagcctacgattcaaaaagagaaccacccaattcacttttgggcattgttcatcgacttgacttggactgccctgttatcagaattaggttcgctgggatgacatgatttaaaagcatcaatgatttgcacctaaaatgtgaatgacatattgacattcctactactgtaga

SEQ ID NO: 46817 - DNA, 1501 bp, Oryza sativa
atatacttactctccgataaagcattgaacgcatgaggcgagtcgatccttcgcaccggtatagacaacgactcatctgtcgatccagaccgtcgattctttggcccgatagcctccccacgatgtgtggtcgctgatggaccacgacgtatgtatgtacaatctagaaatcggcagggtcctacactcctattggccagccaatgagccaattcgacgctgtactgcagagatatgtggccgccgaaaaagatcttttatttggcttcgacgcagccccacatcccatgctgcaatgcaaccacatctgcgcgtctcactcacctgtacaaaacgccaggggcgcatgcagaattgcagacgagaacggcagcatcaggcgcggctaatgttgggcgggagatgtcgctgctggatgaagtggtgcgcgcgttggcgccttctgggtgggacggtccagcccataggccattggactccacgacgatctcgcgcaaaagtttgcaaatcctacggggaaatcttacgaaatctcgacgtttcaaacggggccggagaggcggagattgaggaaggcgtagcggtcgtgcgagcgtaattgcctggccagagaaagaacgtggcgcatggcgtcgcgggaggcggaaaacgaattgcacggagcgacagcaaccggcgcagaaagcgtgcaagcaccttggacgatcggtagttgcagaagcatgtgacattacatgagctctttttttttctttttcgcgagaggggtttttgtccccgtttttttgtgtggccagcagaagaggtagtagaagttagaaccggatccctcgagggttctttttcaccggaggatgcgagtgaaagaggatctatcacggcgtcgtcacagctcggaattggatgcgctatcctggcgcaagtagccatcacgatttcacgatgatgaggagggcgcggttgagctcaggtggtgcgcaagccagccggcgatgcttagccttgtgctcttgttgcgtcagagacagcatcttgtcccggatttggttgtcagtcagggaccccccttgtcccagctaacaagtgagatcttcagcaaaaggatccagcaatttatgtgttagtgtcagtactttccatcgcaagctgggggacatgtttgttaatcacctgtagcagctgtcctttggtttcaagttgtacttgaaattcgagggcagttgtctgtggtacatatcccagaagtttcactcatcaggctgaaagcctgaattcagaaacaatggatacaaaagcccaagtttgctactaatgggctaagcattcatcttcttactggtcgagggccgagcaataaacaagaccatcagccttccagtttcacacatgaacagttgagcattctgcatctaaaagaacagttgatcacagaagcaaaacaggccggtctacgctattgcaatttactactccatacatacattgcggtcatcagcacact

SEQ ID NO: 46818 - DNA, 1501 bp, Oryza sativa
gaaggtttcaaaaggagatgatattatcatcattcgatccactctacaacgtactaagtgcaattgtcctagcggaagattctgctacggttgggaaatggctcattttcccctatggatataagtgcaaactttttttttagataatgataagtgcaaatacattatggatcaaatgctctcaacatcttgttccttgtgatccatatacttcagtacattagcatgtgaagaatacactcgtgcaatgaccgaggaaaggttagatagttttcaatttcctttatgaattgaattatttccagttgatgctatgtgcattctaagtacagttctatcaccttaatgtacttaattgattaagtttaataaaaggctaaaagcttcccattatctttaaaaaaaattcttatagaacttgtgtgatctcagcgaagctaaagcttgcaaaatcaaatgtagattcctaatctgatattaagttcaaacttcttgaataacaaaagtggtctagcaaagcttagggtgtgtttggttgggctgtggcttttaaaaagtagctgtgggttgtagcttttcgaaaagcagatgtgaaatatgggttgtggcctttggaaaagctcgtttggttcaacagctgtgggcgtttgaaacaactagtcccgcttacaagtgggccccatatgtcacacacatattggatcttcttcctctcaccatcatgggatgcccgagcttgctggagctgctcggtcgttgcgatgcgccggccaaagcgcttgcgacgggcggaggggcggcgatgccccaaccctatggcaaagcagcgcgtgaggaacgacacattgagaagcgacggggaagaaaagaacgaaccggtatcaacatcataaccaatatcaggtgggtaaaaacttaacccaaaaacagctaaaagcagggggtggaggtgctttcaatttgtactagagcaaaagcagcttttgggtagaagcagctatggcttttgagccctttggttgcttttggcttttgcaaaaacaaaagcaagttcaaaatcccaaccaaagacacccttagttcaatgttcattcagtcaccatcagagagcactgagcaagtatgccaatcatctcaaactattcttttatgctcagagatgatgtagattccatggcgaagtaaaaaaaaaaaaaaacccttagggtatatagtatgaggtcgtatgcgaagtaatttccatactatgctttgcatttaagcttagctaggggtgtttgttcagattggagcagccttggcaaaatataaacaaagtaatcataaataatttatcggtaaaatatttatatttgtattgtttgcagtaaaatgtttatctatgtattatgtttgcggtttaaagactcaaattttgcctacaggctttcagccaacccaacaagcaacacaacacacccatactgggccaagaaatagaaacatcttaacaaagctagtg

SEQ ID NO: 46819 - DNA, 1353 bp, Oryza sativa
gtagacacctgcgaaaagtttcgaccaagcagccggtcttttggtcacctcggtacgtgttcaatatgttgcgcatatttgatctgttcatgttatactgtgtagtttacatgtgtagatctaatgatgcgttcatgctactttcatctgtaatgtcatgatttatttatggaatagattaaatcattatatgtctataatctcaacaatatcatgcatggtcatatcgatccaaatagtttttgaagagatattccaacttagtggctggtattttttgttttcgtaaaggatgaaagtgacaaccctgctgtctgcactacatacgaatcaaactgaaagttgacgcctgacaagcaactccagatccgacaactcccatttcccataaggccacacttttcttttcagcgagccactattatgacacacacaaaaagtaaaagaacatgtaaaactagtactacacacgcagtcaataaattgaatatccattgttagctctcagtaatttgctgcttaaaatattgtgaaccagaactgatactaagcatcatttaccgggttggcgacgatagtaatgccggtttggacttaggaactgaaagtgatatcaatttgttcggtagtgtaattcttttatggacaagacggtaggcatgaaaaactagggcaatgtttagcaaatggggaagggaaatgatttcccacccatctttaaatcctaaccattcattccctctcttccatttaatcctaacctttcattcatttcccaatcccaatcccaccccccatttcccattatccaaacacatcctagtagtgtcaaattgtgctagaggacaaccatattggatatattttattggagtttaaaaatctcttgcttcttcattagtatcacaatcatccaacacatctattagtttttctacttgaaatactagtaaaagtctaactacaacaatattatattattttttacaacttgtccattaatatatttaaaactaatatttagattatattctgttttgcaagaattatatatttatggcacacagccacatcttttcgcttatgcttatacttatcagccaaaatttgaatttgcatccttaaattttcatctaagtttatttttgagcttttgcttttagatcgctaagaacacgtataaaagttttacgtaaaaaatatttttcttttgcaaatatggtgtgtttgcctattcgccgaaataatgaaacgatgagctggaaaagtgcttaaactattgtaattatgtattatattaacataataaaaaattaatggtgatcaaactaaaaccgcatcttaaattaaaaa

SEQ ID NO: 46820 - DNA, 359 bp, Oryza sativa
ccttcctttcttttttactcgatattttggaaaccagacaattctgtgatgctcgtgttaaaacattattttttttttgtaaaaatatgctttagaggagccaacggaggtggcgtggaagcttggaccaggtctgtgctcatggcaactttcgagctcacaggtagcaatgatgcttgtggcggcagactacgtgagatttgaggaggtgggagacaccggcgggcgtagatctggagttggtgccacaggatgacgatggcatgagcctccaccacccactagcacttaggggtgaaaacgaagtggatttagacggataatagctataccatatcctaaaccatatttttataagc

SEQ ID NO: 46821 - DNA, 529 bp, Oryza sativa
tacgtattcttcgcgaggaggtacgtgtacaggaatgagcagaaggtggtgacccaaggagggactatgtgtgacactgggaatggtgccgatatgatctaatcatgaaatatgttgtgtttacatttacgtgggtgtaataatttgtacaataatttgtaggaacaggagaaatgcaaggaactttattactctattcaataaagagacatcattatcaaggagaaaacaaaaatcagtataccatactttatttcaaaatatgtgaaaaaaaattgcatcttacgataggcgcggccaagaaagaaaggaaagtaacatagacttttataaggattgatgttcggagcttggtgaataaagtagagggagatcatatgtactttttagccggccaaagggtcacggggaggaatagtccagatggtggctcccactagtgggtcccacttccttttcttttcttctctctctcccttctttcaatcggtttctcctctctgctctctctccttccactcctctcagg

SEQ ID NO: 46822 - DNA, 1501 bp, Oryza sativa
gatccttcaactacaattcatcagtacataggcggtgtttagatccaggggtgtaagttttagcatgtcaaatcgagtattatatagggtgtcgcatgggagtgttcggacactaataaaaaaattaattacataatccatcagtaaaccaagagacaaatttattaagcctaattaatctgtcattagcaaatatacactgtagcacataacacattgtcaaatcatggagcaaataggcttaaaagattcgtctcacaaattagtcgtaatttatataattagttattttttagcctatatttaatacttcatgtaggtgtttagacgtttgatttgacatggtaacaatttttaggtgagatcaggcccgtttagttggggaaaagttttgggtttggttgtcacatcggatatacggaaacacatttaaagtattaaacgtagtccaataacaaaacaaattatagaatccgccagaaaactgcgagacaaatttattaagcctaattaatccgtcattagcaaatatttactgtagcaccacattatcgaatcatggcacaattagtttataaagattcatctcacaatttacatgcagtctgtgtaattggttttttttctacatttaatactccatgtatgtgtccaaatattcgatgtgtcagcatgaaaaattttgttttgggaactaaacaggccttagtcgaaatcaaaatataaacgcaataaatttggtagaacatgaagagagccttcaactacaattcatcagttgcccgtctacatcgaaccacgtagagaccaggtttatcctatttccttaaatcaacatcaattcggcttgttgttatcatctaccatcaatagtacatacaaacgcctagtgggtagcacgtttcagagaccacaccatcgtactattcatcgaagcaatgaattaagataggtgctatttaaaataaaggttgcgaagtgatcagtgtggcttaactggttagctagatttctgctggtgaaaactattcatgctgattcaaattctatacttggcacaaatgctcgtatttaaggttatttattttttttcagtgaatcggtgtaccgctattagcaaggcatctactataactctcaagatatgatggctcaatcttcagatgtatggtacttatatagttagtacggtgcttatatagttaggtgtgtatgtttgtgttcataggcctcgcttatggtgactttaccagtcacaagatatatattccgttccagttttcaaatgtagagtacaataaatgatcgtacatgttcacataaacacccacgacactaccctactgagaaaaaaaatggtaaggtaggtggatggtgtggcctgcactcgttcggcttctactatataagatagacatcgtaccctagcaagtgcaagctccttaatttgttcaccaagcagtaccactggtaaaataaagcaaaagcaagtaggcaagca

SEQ ID NO: 46823 - DNA, 507 bp, Oryza sativa
ttcggaagatccgctcttcgtggaagttgaagccggcgtttgggaaagcgagcaaggcaagtcacatcatccttgaacatattaaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctacttacggtaccactagtatgattttaggtagatgcttcgctgtttaattaggtaacattaggtggttttacaactctagactttgggatattctcatcacctggacactttggaattgttggattattgtggaattggattcacaccgccccctctattcaaaacccccaaaatggttttaggctgggctcggggtgcatggtttggatagtagcacctcggccatataaggaccggt

SEQ ID NO: 46824 - DNA, 498 bp, Oryza sativa
acacaagatggctatgtactgtacaacttattggtaaattcgccataaaggcaacatcatctagagaaagtttgaggagctctttgttgtccaccaaatggaggagttgttctatgtttttttttctctagttgttcagaatgcaattgggaatgggtataatctgtgcaaccaatcatgcagaatgttatccttgagcttggtgttgtggcctgcaacctcctggtccatttccatagctggggttatggtagcctggtttgttgccagagcctgatggaccatttgatcttccaggatgtccgtagtgatggtgatggtgttcttgccctggatgcagaactggacgccaagggccagggggagcaaaattgctaggtggcctcacgtgtcctgaagttgcaggaagattggccattaaatcaaatgttgttcatcaggaaaagtaccatttttgtttccatggtttcacggggaatgaaaattacctggagtaaa

SEQ ID NO: 46825 - DNA, 339 bp, Oryza sativa
tgtccaacgttacaccacgttgcaacaggcccaaaccaccacctaaactaatcagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgtataaccccctctaaccgatcgcaccacaccttagggttcgcccccgtccccagcaggcaacgggcagcccccctttcgtgccgcgg

SEQ ID NO: 46826 - DNA, 225 bp, Oryza sativa
tcgtagtcgtgacggtccgtcgagtaatggtagcctcgagctgctcggcgctgtatgattgtgtcgcgaagatcgatgggccgccgacgaggtggtgagcaagaccgttccactcggcgctccctatgaaggtcggaaggtgagtgaacagaccgctcgtcgtgacccctgctcctgcggttggatcctgcgccggtgatgctgaggcttggatgacggtagtca

SEQ ID NO: 46827 - DNA, 665 bp, Oryza sativa
tttggtttggtgatctgaggatggacgccggcgatgaggaagaacatggttcgctcgtctgaacggtgggttatttacccaccttgcagattttaaaagtagtctgagccgatgcaaatttcctctggattcatcgttttccttgatgagttactggctttacagttttagaccttaaaaatcctttgttttcacttatgtttctgtccagtgaaatctctccgttgggatattcagttgcagtgatgagtatctcttttttcgagagcaggtctcgatctgcttgatgagtctgggaaataatcaccttatttcctcctgagcggttacctgagcaactcttagcaccatccaaactctttggagtttccccaacacatctgacttttcttggaatacaattttttttttttgctttcttagcttcttgtttgtctcactttgctgatttaatagattaacgtttgcatataatctcaattttcaggttcattttcaactgcaaattcagaatgtacttaaaaacatcattacgcaagagacacaaactctctagaatggcacacatatcattacatcaagtttagtagaaagctacatcatatgattgaggaccaacacttaacctgcgattgcaagttgccctcaaacaagatcagggcaac

SEQ ID NO: 46828 - DNA, 1501 bp, Oryza sativa
atgttctcagccgatcaagcttgctaggaggaccggatggtagcaatagtagtactactactcgtagtagctataactaagctagctatggactgaaatcatgcatgcaagccgtctgtttctatatgtaacgttgtgctgtgaaactgtttgcacggttcaatgattgatgagatgggagagaactatactagtggctgctgattagtttcactgttgagccatcgtgcaacattgcatcaaactgcagtgccaagaaagacgccagctcaactagcgagctggagtaggactagctagctatagcaattacggcattgaccatccaatcgtgactcaacctactaacaactgattccgttcaataatggtgccatgttggatagcggtgtgatgctgacaagatagcatctggataatgataatcccgcttcctttttcctagttagagatagtgacttggataatcaatccagcgtaaaccatttgtatttttccggaacacaaagctgccagtttctagggttgcgcatgtgtgctgtggtatgtggagccaaagctaatgacaggggaccagcaagggcatcagattagcagttagcttttgggccatggagaagggatagaactgggcctgaaggcctgatctgtcaagatatgtgaaagagaaggaatggacagaaggccccgtccggtacagcccatagaaacgttcaattggagttctctttgcgggccttacatgggacacgaattgacagaagcccatatggagatagcggacgtcccacacgcttggtgtcacgacgagaggaacctgcatgtgcgtctcggtgcgggcgtcgcctggtggcgtagctatccatgaccgcgcacacggtccacgcggaaaatcctgcgtacgtttccgtcgtaccggtgataaccacggacaccgctcgcgatataacctctccaaacttttcatcaccaacaccaagttgccgatgtgcttatctggtcctggtgttttctggggtaagagctagcaaccgaatcttgtatttcccacacagatccacggcaactgtcagcaacattgctgcgagtacttgatactgtatcagtgtattgcatctattgttggtgatcactgtgtagatcgacaagggtccaaaccgaccacggcgataagccatgcgtcgtctgggactttcccttcaccacgacacgagtccaagcttcgctgcccttgcttgcaaccagcggccgccaccgaatggcaccgttcacgcgtgctccaaaagccgcccacctcagttggagccgggaaaagttggcaaaaagccaataaaaaagacgatgcgcattgcccggattcccacttcgatcccccctcaccttcgtcttcctctcgacctctccgctgtctctccgatgggctcagcttcaggtgagcgagtacacctcgtcgtctcttgtgcgtcagcttcgtgttccagtgtacgtgctgacgacatgt

SEQ ID NO: 46829 - DNA, 1501 bp, Oryza sativa
gctactaggacgcaggcgcacggcgacaccggtgaattgtacagggggattcgaggggcgagcgtacgtacatgcgggcgtgcgtagaagtttcaaggggcgtacatgtatacgaacgtcgtcgtatcggttggcttggcatggcaggtcgacaggtttgcagcctctatgggccatggtgatgcgtcgatggcttcaccgggagcaagttgccatggcgcagctatcattggagtgtacttgcacagtgccgccgcgtccagatccacggagatgcaacgtgggcgatgtcccgagcagtagcatataaattcgtactgttcttcttatttcctctctcagttttaacgcaggttcacctgtacagtacgaatggccatggaagctgtactacgcggtaacagtaaaagcatttcacagtgagcaattcgctgatgtgcgtttcggagtttcagattctgaaattatgaatggggcgggcaagtatatggtggatgctgtagtattaatcgaactcgatctggagcagtgtactgtacttacgtagataatgaacttggattaatttacgccataaaattccacagaaataactcgcgaatgaagtactggtcctgctgcctgctgatgagcctgaatgccgcacgggcaacctccggaaaattaaaaattttcaggagcaaacattcaaatttcgctgagatcactagccagagcctcacgtgtcccgaacttggatgatccagtccagagcccccacctctttccgtgctgcctcgcaaagcatcgacgtgccacctaccccatccggaacagtaattcctcactgccatgtgggacccacgccgtgtcatgacagccatgtcagcgactgaactggtaatcacctcgcgtgtgcgtctgtgcgctcatccttttttttttcctcctcctcccacgagcattcattccctcgcaacgcgcgcacgaattttatttttatttgaaaaattcccgatattgcccttgagctgtcagcattagtaggctatttaatgacggacaaaacagtaatctcgcgtcctaacgttcttaaatgcgcattactagctcgaaacaggggtctctgctccccagcccatgctgctccctttgcccttttctttcgggaaaaaagggaaaaaaaatactccattcatctactgacacatgggcccacatccccacaactaaactgtcagtggctcagtgccacccgtagtgtactgccactccgcgacaacccgcacggcgtcgaactggttatcctcaccggcggagcagcgcagcggcgagtggccccacccttctcccgctgccactgccactgggccccaccgcccggaagatccggtcaccaccgcagagcgctagtctccaccgctattattaccccctaccgcttggttacaaatcacactcgtggttgtctcgtgtagtggaggtggagtacatctaaaatccctcgtcttgtcgctgctaa

SEQ ID NO: 46830 - DNA, 255 bp, Oryza sativa
ttggaggagaccagcggcgtggttgggggggagattttaggctcgcagaagcagtcgcctcgccgccgcccgtcgaccgcgaccttcccgtccgcacccgccgcgatggccgccgcctgaaagcccgaccccgcgtcaccgccaaaggcgccgttggcgaagaagggggttttcatgcaccgcatcttcccattcctcctcgcatgattcgtcaaacactcaatgttctcactttcggagcctttgcttccaagc

SEQ ID NO: 46831 - DNA, 164 bp, Oryza sativa
atctctgcagtggattgcgcaggtgttcatggcgtcacagtggtggatcgagcgagcggcttgtcgtctacgtctactccctccgtctcataaaatcaacctaacaccaccaaatataacacaacataatactataaatttagatttatattcatcgtactaga

SEQ ID NO: 46832 - DNA, 183 bp, Oryza sativa
ccgttgtacttgtgccaatatttccaagtactcctagcaaggatatatgtggtacatacaggtaggctataccaggttcagcgagctttctgttgaggcatcagaataaaccagtggtaatctgatggcatatctgctgggataagccggcagtacctgaacattctttgtggaactgccgca

SEQ ID NO: 46833 - DNA, 168 bp, Oryza sativa
ccacccttttccaacctaaacctctcctcctcctccccctcctcgccgccgcctctcttcccatctcccctcacctactactacctctccatgtcgccggataactagcgtcccaaccagcctcgccggcgaggaggaaggtggtgtctcgcattcttcttcggggga

SEQ ID NO: 46834 - DNA, 218 bp, Oryza sativa
aatactgcttaattattacaaccgttttcgcattcaattcctgtttataaatgccagtatttatgcaaatgaaccactctagctcttctttgttaattccctgcatcatacccctattccggtatgacttgctgagtacagtgggtagtactcagtcttgctctactttttcccaaccccagaggacgggtatgtgtcagatgaaggtttccccgagg

SEQ ID NO: 46835 - DNA, 321 bp, Oryza sativa
agaataggcttcaccatggccacagcttcctgggatcacacgagaatacatgttattgcttcatttttttcacaagagaacacatgttattacttgcatttcatataggagattttgagaaattaaaaatacatttcagataggagatttggagattgaaaaaacatgtcattagtactttattactggcttcagacttcagagttcagaaacatgcatttcagagaggagatttggataaattaaaatgattcagagatcagaaacatgcatttcagaaagatatttggagaaattaaaatgattcagagttcagaaaca

SEQ ID NO: 46836 - DNA, 275 bp, Oryza sativa
ctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgtataaccccctctaaccgatcgcaccacaccttagggttcgcccccgtccccagcaggcaacgggcagcccccctttcgtgccgcgg

SEQ ID NO: 46837 - DNA, 219 bp, Oryza sativa
atgtttaatactgcttaattattacaaccgttttcgcattcaattcctgtttataaatgccagtatttatgcaaatgaaccactctagctcttctttgttaattccctgcatcatacccctattccggtatgacttgctgagtacagtgggtagtactcagtcttgctctactttttcccaaccccagaggacaggtatgtgtcagatgaaggtttccc

SEQ ID NO: 46838 - DNA, 280 bp, Oryza sativa
cctaataggccaagtaaacatttaattttgagactctgaatgaatcagctcggccattatatcttagataatctattgctcaaaaccttgaagctttcacatcgatccatcgagagtttacacggaagttcacatatctcagcatcataaatccataagatgccaattagatatgagacagtgacatggcgatggagacccaatggtccatggttaggacaaataacgaaaccaccgagtaattaactgcagttagcctataccactagtacaagagcca

SEQ ID NO: 46839 - DNA, 190 bp, Oryza sativa
cttctcattttgagtgattgtagatttcaaagactgcaacccccaaaacacagaacttgttctttagatctgagctagattacatggatgatttccttgacacctcagagagtttcttgttacttcctgttacttgcaaacaagattcaaatactccttcagaatgatttgtgtatcctcaattgaagtt

SEQ ID NO: 46840 - DNA, 196 bp, Oryza sativa
cgactcatcgttgatatcggtattaagtatacttaaggttcttcatctttccatcaggtttaatatcattatccgtacacacaatactaaatcctaaccccaccttagaaactggactaaattaggtcctatgacactataggtggttggttttctgacggtggcatcctagttagcaaaaataaataaaaaccca

SEQ ID NO: 46841 - DNA, 154 bp, Oryza sativa
ttgtcctgagaacttggagaaatcagggattttaaaccgattaggaagaggaaccctttcaaaccactcgggataaggctgccgtacaaactcccagtctcttttggtctcagcccaaattgctccctcattacatcacaatgacatcagccca

SEQ ID NO: 46842 - DNA, 1366 bp, Oryza sativa
tcatctattaaaaaacggagggagtataaattagagtggttgattagtatgatcaatgtcggtgaatttttagttaaattagactatcaatgggatattaacagattgattgtatataattaatctagtcagtttttattaatgcaactatgttatgccaccttaattttccatccattttttacgcatatatatgcaattatgttcttatttatttataccttaatttttcatgtttatatatacggagtattgagggttctggatttttccatcgtcctccgccaaatcagctttagagcaaaacttatcttccatgacatcggccgatgctgccgttgcccccccccccccacctccaaacattttttatcatatacaccctctgttccattttaaatgcagccatgattttctgtgtacaaatttaactgtctttcttatttgaaaaatttttaaaaaaaattaaaaaacataagtcacatataaagtacaattcataatttatcatctcataacaataaaaatattaattataaaaaaatttcaaataagatgaacgattaaagttggacaccgaaacttccggttatgcttaaaatgggatggagggagtatcttgaaaatctacatgtactaactcatgccaaaaccactcaaaaactataatggacgagggttgtttgtctagtgtgaaaaattaaggatgccaaatgtttagaattgtagttcatgacagtaatttggactgcaccaatagtttaggggtagtttagagggaaagtaaagagggtggaggtatatagataaaataaatataactctctattgtgttaaaacaatagaaaaaatcactaaacttgaaagattttagtaaaccatttgacaaagtaaaaaaagatcatgaatataaatataactttgtattgagttgaaaggcatattcaatttcaaaaatataaatatatacatataaatgcaactctctattgagttcaaaaaaaattcaaaatactctagacctgagagaattgagtggaaaagaaatacatgaatacgagaaaggcttagagcaggtacaatagcgctattaaacccgctccaaaacttgttaatcaacttaatctgagattaaggaaagaaaattgtagagaaagaaaaagaaacaagcgggcgcttgttttgacgccggcgcttgcacagctccccaaaccgtaacgcctgcgtgcagccagaagagacgataaaaatgcgtttatgtgggtcctacacagaacctctctgatgtatccatataagtatttaatgatttaatgtatgtatgctttaaccaaggtagcttatagctaacttgtagttagcttat

SEQ ID NO: 46843 - DNA, 1501 bp, Oryza sativa
cttagatatagtgaagatattttaccggctgacgcccgtggttttttctctcctgttttggaagggttttccacgttaaatctcatgtcttttatgattgatctattgttttttatcgtttgttcacccatcgtttcctaacagtcgcccggcgcgacagttcttggtgcggcagaagcggtgtcgttcccggcgaagctcctgggccccggcggcggaggtgtcagcccgcggggatggttggcgctggcgcgcacgcgcgcacccgcgatcgccggcgggttcttggccaggggagctcccggtggcagaggcggcgtcgtcttccccgacggttcttggctcaaccgagctccgggcgtcgcacgtgtcgcccgcgggaaaggttggcgcgcgtggacccgcggtcgccggcgcaggaaccagccgagccgcgagaggaacccacgggcgtttcttgcttcttgccgcgtcgaggcagaaacagcggaggcgccgcggcgggttcctgtgttggcggcggagttcttggcgagttcttggtggaggaagaagatggaagcgcgagtttttggtggcaagaagagagcggaattgcgggagttactggcgagatggtggtggagggagaaaatgatttgacggcgagttcttggcggcgacgagggggcgtgatttggggaattcttggcgagaaggtggaggaagaagatgattatgacggcgatttcttggttgtttaagagggaatggggagagaggggagatggagaaggaaatgttgtggtatttatcggggaaagaatcgtctcgatccttccaccgaccatcccggaaggccatcgtcttctccggcgccgtcatgtgttcgatggcgagctctgcaaactcgaagcttctcgaagcgttcttgcggctggaacgcaatacttcttctccggtggctccgttttggtggcgagcgtggctcgcaccggcttggcgagagtatcgccgccggcgtgcacgagcgccatggcagctcacggcgccggtgacatcttagcagaagcagatgggctgtgggcgcacgtatgagacgtgggcctatcacttgcatttcaactttcaaggcccaaagagtgcggtgtttaatcccacctcgctaaccaaaccacagcagcaccgcttataaattgaaccgtgttttttgtttgcaagtgatatcaggcatttgagtattgaagtttcattggtctaaagacttatttttgttcagtctgtgttctctctctcccattctttttttattttttttctacaatgttttttttaagaattacacttactattgtttagtgtgtgttctctctctcacattcttttttattttttctacagttctctctctcccattcttttttattttttttctacaatgtttttttcagaattacacttattattgtttagtgtgtgttctctttctcacattattttttattttttacaatgtttttta

SEQ ID NO: 46844 - DNA, 175 bp, Oryza sativa
ctcgagttagcccagctccaactatgccagttagacctggttataaacacaagagcagacctattatgaattattatctctaattcatattttggtgattagagcgtaaaagaaaggaatgataaaaaaaattgtatgtttttattatatagaaacactggagaaaattatttga

SEQ ID NO: 46845 - DNA, 1501 bp, Oryza sativa
aggatttggcattaaacatggaacatatgtcctggtttacctaattaccttgctccattactgaagaaggcatactgataaatcaaaagaagagaccagctggaacaaaatttggggttgatgagcagaagcatacactgcctgtttgatgtgccacccatgttagctcaggttgcacatagcctggatttaggggcatcaagggcagaatatgtactattcaagagaagctcagggatatcaatatatgattgctgggtgcaccgtgcacgtaggttgtgatgctggctcaaggatctaaattcctgctatccttttttgggggtgtgaataatatttcttattggtactatttcttggtagtagggacaattccactgtctcaaaatcgtggtaaatattaagcagtaaaacgattttaactttttctatatcttgattttcaggtcatgctagattgagcctattactgtttctaccctgaagcgctaatgtttgcaggcctgaagtgtctcgtattcagcttggaggtgttggtgaattacttaaagcgacgaatgcagaaatctgcacggaagcgatgcatcccatttttgccatttggttaagtaggttttggttattcttatacgttgagaggatacttatcatgggtttggtggattagacgtggtataatccagttctcattttggttttcctttttgtttgctagctgaccttaattacttggtgccatttcctgctttgatttttaggtgttactgtaaatgaagagatgatttattatatatactacagaatatagttcacgcgtattacaaagaaaaccggtgttttgtttctgttgggcactttagttagcaaaagagtaaaatagcctttccaactggggctcttcccatccatttgtttgtgatcataattttccgaaccatatgtttcattttttcttctaagcttatcttagttaaaacattcaacacactttcagtttcagttttcagtctttgagcaaggttgcttcagaattatcaggcatatacatggaaatgaaatgattccattctctgttcagtttattttccttgtaggcttagattgatcatacagcgagttaaatgaatataacttcaaacaaggctcgagtaaaaactacggaggaaaatgcagtcaatagtgacttgtgattgtgatctgcatcgaggattaaaaagatttgtctcgtaccacatgaagtccttcagtagatttgtatacttgttcaaaagattgtaagagcgatgcatcaacttgtttagttgcagaggtatatgatctgagcttgttcattcggattattcagatagaaagacgctgtactaacggaaatcttatacaggttgaattcgaatcttcataccccactggaccggggcccacacgtcagtgacccatctcaagactcaaattaaattggtcacgtctcgttcgtcctcatctcgctcgcgtctcgtcggca

SEQ ID NO: 46846 - DNA, 318 bp, Oryza sativa
gactctagaggatccccgatctcaattttagaaaaaattagagacttgaaccaactaaatccgagctaagatgaattagttatgaatttttatagattaaatcggattaaaacacttatatgggttttaattgaatgatgacgcaataatgaattattttttaaaaggaaaaggaaattattgcgtcagcggttagggttcgcggtggaccgggtgcacggcggcggctcacggaaacgaacggccgagatcgatcctatccacaacgaacggccaagatttaacggtctacgaccggtctacgacggacggcaccga

SEQ ID NO: 46847 - DNA, 222 bp, Oryza sativa
gttaggacatcggccaattcttcgggaatcagagcttgaacttcatgcagccgtgtcctaattgatccgcagtcaactaccaagctatctaaagaagaggcttgtagctagccgatgagagatatcttcaagtgttatctgtacatcgtcagatagaggagctaaagctttgctagaagtatcttcttctgccttatcaagataatctctgatgtcaaaaga

SEQ ID NO: 46848 - DNA, 425 bp, Oryza sativa
caaatagctttgagccactaaatggcttaaagctgtttactgcacccctaacccttatagtataattcccttgtactcccttgcattattctgcagttgcgggtgtgtcttgttaagtacggtggttgtactcagtcttgctcaatttttcccaaccccagaaaagagttccttgaaaataaaggctttggtgtctagctcgtgcctgccgtcaagcgcctgtggtcgtcgccctattcttccgctgtttcccgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaga

SEQ ID NO: 46849 - DNA, 160 bp, Oryza sativa
cttcacttcttgtaccaagatgtggactatgagttaggcaccatcaaaggtctccttcctttctatgcctatctcaacaagctcttgcgcaaaactcttaatcctaaggaaggtgatgctagcaatgtccttgcctatacaagaaatttgctccacaaga

SEQ ID NO: 46850 - DNA, 376 bp, Oryza sativa
atattgaatcctataatggcattagcatgtgcgatgagaagctagctccattggtgtgggggaggaagagcttgcttgcggtggcaagatgaggtggacggacgacgcgacatggacttgcaatgccgccggcttcgaagggatggaatggcatggaatgaaataattcacgtcctcagtggcatggaatgaaacaattcatgtcctcggtagcatgttctgaaagtattgcgaattgagtgacaaatattgaaagtggtgcaaatcgaatggcatattctgaaaattctccaatcgaatccctagccgacggtgagggcggcgaacacggtggcgctggaactttggggaggggaattcgtctggtattaaaagt

SEQ ID NO: 46851 - DNA, 1501 bp, Oryza sativa
aatggtcaaacgttgatcaaagagtcaacggcgttatacattaaaatacagagagagtagtaggctttatgttttaaattgtccatggaaaaatgatgacagcatgcatccagccatagtagagattgctcaggcagcagctatcatcactgcaaattgaaatctatctttggatcactttaattatcatcagggttattaaaattgggtcactttactcgaaatgacattattttcttttctcctcctacaagtctttttctagttgaaactattttggtaggtagatgataaaccttgctatgttatggaaatcgaatgagctcaatccatagccactataaaaggttagccatttctctttgacgcacttgttacacctatcatggttaattgttctcgacttaattagaaccgtatggagaacattgttctgatctattagtttcaaactatagctgcagcagttttcaagacggttttgtgaggcagtgatggccctctttatctcacttactcttttccaaaggcggttaatcaaaccttctctaatgctagtaaaagatttaaaccacccgtaatcgatgacattctagtggtgtaggtaattttagctggcaatttttatggttgagtaagattaaattaaattagagtattcagtttgtatatagtacatttgttccaaaatatagcaacttttgacatcattatattttgggacaaatgcagtattatatatatgcaaaaaaaaaagtagaggaaaaaaattcaatgtgaaattaatgaactaggcatgtgattatttttttcagtatgtctctatatatgtctaatatataaatcatggcaaatgattgaaactttgaagtaacgttggtgcaaattaatacaaaattctaaaaattgctagaaaaatataaagatgagtaatggcatatatattttatagaaagtatatatatcagttcttcatgaataaaaaatattaagagaccaaacatggattaattagtagcacaactatggatgcacaaccttagcatcccctttaactttcctcagtagtgcgaccaattccaggcactgcacaatttctagaagctagctacctgtgcctggccttgccctggcctcttaattgcagccatttatttagcattcacagttaaaataacccaccttgtgatcctagccaatggggggatatctctcccctcctaactaaataaaggaaggaagcaattaaaggaaagccaacttgcaaaggcaccaacaaaagacccctccatttccattcctcctcttcctctcttctccccccccctccaataattcaaccccctcttctgggaaacctgggagctttctccttcaagagctccctgctagctagatctcctcctctctttctctctctctctctctctctttctgtccatttctatctgtgctctcgcctgagcggcgacaatccagctgagatcgatcgatcgatcga

SEQ ID NO: 46852 - DNA, 427 bp, Oryza sativa
ctttgcaaaagcaaaatgagaagcttatgggactccttcacaatggcttgcttaagtgccatatgggtagtaaggtactaaagaaatacctaggctatcaaagggacaacttcaaccatgaaggccttgggtatgttcctccaccaaaaggaaaggtggacaagagtgtgttgatcaagaagccccaaggtcttagcatctttgttaaggccaaaagtatccttcctaatggtcatgcttcacattgtccttttgatgtatcatatgttcttaggaagaatgctagtggtcgtgtgggtgctaaatatgttgggcctaggggcaaaaatgtttccatcaagagagttctatgggttcgtaaggcacttgtcactgacataagatgacccaacaaagtgtgggtacctaaaactagagattgatctct

SEQ ID NO: 46853 - DNA, 1269 bp, Oryza sativa
agggaaaacgcaaggcgtccggcatggatgggtggttccggctacgtcggcgggagaagcgacaacgtcggcggcggcagcgaggcatcgggcgctcggaagccatgggggatgggagcgagcagggctagtgggtcaccaccggaggcatggctgtggattgggggagaggccgccggtgacggggaggtcaatggaggaggcggtggcatgagcaccgacgcccaactcctctccaccggccgccacagtcgccagagccatgcctccgtcgcgagagaggagaggggagagagagttgatgagaggggatggggattgaggaagaagggggttgagaatgacatgtggggcccgcgtgggccccaccattttttattaatttcagtgtgaaactgacatgtgggtcccccgaggtttattattatttttaattgaattgccaggtaaaggccacgcgggccccacatcagatcaagacctagtcaaattagtcatataggcgccacatcaggcaaaaccgccatctaaaccgccgagggacctaatctgaaccggttttaatagttgagggacctgtaatacctggttttgtggctgaaggacgaaaatcagattcgttgacaagttaagggaccgagatgaacttattcctattcatctagatagatagagaattttttgtatttttagatttttttttttaatatttacagaaatattatagcgccgaaaaaatttgcaaaactagaccctgccgcccttcgcaagggcggcaagccgacgtggcacacgccgcgctggacggcgcgggacggccgtcctcctgccctcttgccgccctggcaaagggcggcaggacccacttgccgcccttacagagggcggcaggcctggccgcctataaagcccagccggctcctttgaggagcccattccctcctaacctctccacatcaaaaaaaaaaaaggagaaggggaggagaagaaaagaagaggcgaagccctgccggtttcaaacttcgatttcaggtaatattcgtagattatatacgtgactaaatatatgatgttaactaggatatcacttgtatttttgtagaactttggttggataaatgcattgtatgaaatagagttttacctgtggtactatataaatatatattgttagatgtaggcagggtttcaaaaaccgccgggggctcggttaaacactgtagtcgtttattatgtaaaataacggcctagtaattaactttgcagata

SEQ ID NO: 46854 - DNA, 209 bp, Oryza sativa
tagataccaatcttcttgctgcattggagcagctccagaatataggtaaccgataagtctatttctgagaataccattttttatgtcagtattggacagatttcataggtcacatttagcatgataccaatcataagcacacaaaataatgcctatatgttttgtagagacacacatagaatctttgaagagaaggtacaattggagta

SEQ ID NO: 46855 - DNA, 854 bp, Oryza sativa
cctgatatttttagcgaacatcaacatcctagaagtggattgaaaaaaaatacaaatgccatgcatgaaattgtttcatatgccctgccattgataaacataacaagtagccaatgaatgttgtgtgtgatattatgcctatcagtatttggttcatttcacagtgtctagtctactctattgccagacaataaaaatgcatttgttctgattagtatccatgatggagctataatgtgattagatctcttttaagttcacgatcaattcgctgtttagcctctcctttgtgaaggccgcaaaaaagtgaagttgtggttaacaagtagttcatttatgctccggaccttgcgtcttgaatatagtagattaataatgaagctgccatgtttattttcaaaaatgggtaggttaaactacaggtttcttaaaagaatgtacaaatagtactccctccatcccagattgatcatcctctaagtaaagggcactaaagccaatgacatcaaaatactccctccataccacaatatatggcgcgcacacatattaagattcaacttttaaaacatttgaccaacacttagtataatatgaaattaattttatttattaaaaattatatcattagattgagatttaaatttactttaatatggttataattttgttgctacaaaccttatagtatatgagaaattataagctaaagattagttttggagaccgtgccagctttgaccgcgtgttatatatgggatagagggtgggatggagggagtactgtttactaattgtcatcatttagtctttttacataacaattgctatgctacgttggacaactatttcat

SEQ ID NO: 46856 - DNA, 363 bp, Oryza sativa
ccaaaccagtttaaaataaagtaatattttttgcgccatacataattcatcatacacccaaaaattttataaaacatggtcgatagatatctttaatatatatatatatatgtatgtatgtatgtatgtatgtgcgtgaccacaccatgtccttatccctgttcctctatgtccatagaccatagcagcaggacgaaatcgattaggcgctagccgctaggcagctagccaccacaaatgacgatgtcctgcacgtgtctgcacgtgttgcttgcgcttggccctggcggctggcctgtcgggcgctaggctgctagctgctgcagtgttgcactgctgcggactgttggccgcacggcagca

SEQ ID NO: 46857 - DNA, 308 bp, Oryza sativa
aatttttttaaaaaattgacatgataggttagtatttaatatatcacttcacaaacatacaaatccaaattcgacttctacaagttgtaacaaaaacaataaatttaactgtgaatatatgtatactagttagagtttgatttgttactttcgttacaacttgtagaagtcgaatttgaacttgcatgtttatggagtgatatattacatattaacctatcttatgaatttttttgaaattttttcataatcatttaggtggcatgcaagaaacaagtggacgtccacccgaaagattagaatccatc

SEQ ID NO: 46858 - DNA, 504 bp, Oryza sativa
ccactcgcccgttataagatacttcctccataaaagaaaaattaagattagatgcaacgttttatctagatttattatactcagatatgtctgtcggtgacatggggccgggggtatcgtgactagaggcttgggtagccgcggtcacccacgtggcccgaccccctcgggggggtcgggcccgagggtgacgtggccacccctccctctgtctccccgaggggtcaggccgctcccgtttcggccccgagggctggagcgccccggccccctgtggttttggcgccacgtatgtgggttagatgagcacagcgggctcacctaaccgcatttatagcaggttggacgagcgcgccacgccgcatttaatgcggcgcagcgcacgcttatccggtccgtgaccggtcacggtgtgtaccggtcacagaccggtcagatcgcgggttaggtggcaacaggcggcctgtcacacgcctcgccccgtcccgtcggaatgatgagagc

SEQ ID NO: 46859 - DNA, 152 bp, Oryza sativa
agcctaaaaagatttgataaaaaataatcaaaacgacttataatataaaacaaatgaagtatgtattaactattgtatcatcatccaacatgcatgacgcatgcggagaataaggcgcgaaggcaaaagcaacttaactcgagacggaaaca

SEQ ID NO: 46860 - DNA, 160 bp, Oryza sativa
ccgtggtggagcctgtcgcgtcgtgctccgccacggacagattagccgccgacagatcgtacgcggtaacctggggcgccttcgtctcgctcctggaggccaaggccccggccatcgtgttcacatcgccacggtcggggtcggcggcgatggggaggat

SEQ ID NO: 46861 - DNA, 159 bp, Oryza sativa
cctgcagccctctatgcacaatgtggtcgccttaattacaagtttaaaattgcaaaatccaaattagcctaggaatcagacaaggagtagaagtcgtatctcaagctgcagcttccacccaacactttgcctccctccttggcgcaacccctcgccagc

SEQ ID NO: 46862 - DNA, 351 bp, Oryza sativa
  unsure (1)..(351): unsure at all n locations
cggtggannagtgactgcttcatttcctgcggcccctacgtgngataagatcgctctagattgagtcgaggggctaatttgtcccgtattgaaccaactttggttcttcggtttgggggggggtaattcggccaaccgcaatagttcaggggggtaattcgtacttttttccggtggccctcccttctcctcctcctcctcccgatttgtggcggaggtagcaccaaaggctggcccaaagcacgaggtggtggccggtactaggaaaaaaatggaggtggaaaaggaggctcccccctctctcctggtggccctcctctctgttcacctcctcccttctcctcctccaga

SEQ ID NO: 46863 - DNA, 391 bp, Oryza sativa
tcacatgatcaaatgataaagccaccctcccatttacatggaaccatctattgcatcacaaattcctacacatgtaaactgaattgatttcaagcaaatcataagataatttcaccatctattccaaaataatttggcctgcacaaatgaactaactataagccaaattatgatacaaacacatgcatgcatgtccaagaggttgattaggtcccatagatggtgcatgtgcaaagaatcgatgaggggctcaccagcgaaggagaatttggtcatggcgacagtggccgaagttgaagacgatggaggccgatctccgtccatggtgctccattcttctcggttcttgaggggtttttaagaggatctcatggaggagttgatggcgcga

SEQ ID NO: 46864 - DNA, 1501 bp, Oryza sativa
agaggcttggggcggcgcgggactcaccggagcttcaggtccgggttccacatggcgaccatgccgttctcgaggccgcccgcaatgagaccagcctggcacgagaagtcgttggacgcagatggcttcgctcagtcgatgctgcagaatccctccggcgacgggaacgaggccaccatctccagcatcttctcgcctgggcttgtacggaatatactcatcggcgtacgcggcgagatgccgttgtcctgaactacgccgccggcgaggagcgggacatcgccggcgaaggctatgacggaggtgggtattgccttggacttgaggaggaagacagccatggcggtggcgggcgtgatggattgcgtgtgcgagtcgctttctcggtcttattttatagctgtgtgagccgagccgctcggaaggacatcgtataccgtcggatccccagggagtccacgtgtcatccatccaaagcgtttccttgggcttagatgagccggtgcaaaatggaatcgtttggttgcctgtatcacgtgatgactggaatactagtagatgcaatgagaatatgttttggtacggagtatatggtttgagcaggttaggacatgaacttcaaaatcagttgttattgcctattactacttctcaacaattttcttctggtggtaattattcaaacgctctaaagaatttttgtcaagttaaattgctatccactacaactgattctggaaaagggacaagaatcaatacgtggtataaatttgtagggttaattagatacatgccattataaatttaacggatttgaaatatgccattacaatttgtgtggatttgaaatataccattacaatttatgtatttataacaatgcctttacaacttttatatagtttgaaacatgccgctagtatacatattttacccatattggacaaaaatgcccccgtcttcaacctctcgtcgttcatcatcgttgccacctcattgcctcgcaggcttcgggcttccctactccggcccccgtcgtcgctccgggaggacccgctccacgtggttgcaaccaccgccgccgcagccggaatctggaggccgtcggcttgccctctctgtcgcttgctgctacctccaccgccgccggaatctggaggccgccggctcgcccgatgtcatcgtccccaccttgccgccgccggatttgctcgccgggtgaagctcgtgccttccaccgccgtgaaccgccttcgctgacctcgtcgccgtcttatctgctccgcgcaaagctcgtgccagccgccaccgcgagccgccttcgctggtctcgccgccgccttatctcctcgcgagctcgtgtcgctacctcgcaggaggccgccgacggcgtgaggtggagggagacaaggacgtcgtgggtgaaagagcgccggagagggaggagacagcgactgcgatgtccatcaccggccgcacttgccactgctatagatggcca

SEQ ID NO: 46865 - DNA, 1305 bp, Oryza sativa
ttggcccgtgcctggcccgtgagtgcggcacgtgggctggcatggtacggcccggtgcgtcggtcgggccgtgccggcccgacaagcctcggcccaggcacggccgggcctgggccgtgccgtgccaggcggcccacatggccatctatagcagtggcaagtgcggccggtgatggacatcgcagtcgctgtctcctccctctccggcgctctttcacccacgacgtccttgtctccctccacctcacgccgtcggcggcctcctgcgaggtagcgacacgagctcgcgaggagataaggcggcggcgagaccagcgaaggcggctcgcggtggcggctggcacgagctttgcgcggagcagataagacggcgacgaggtcagcgaaggcggttcacggcggtggaaggcacgagcttcacccggcgagcaaatccggcggcggcaaggtggggacgatgacatcgggcgagccggcggcctccagattccggcggcggtggaggtagcagcaagcgacagagagggcaagccgacggcctccagattccggctgcggcggcggtggttgcaaccacgtggagcgggtcctcccggagcgacgacgggggccggagtagggaagcccgaagcctgcgaggcaatgaggtggcaacgatgatgaacgacgagaggttgaagacgggggcatttttgtccaatatgggtaaaatatgtatactagcggcatgtttcaaactatataaaagttgtaaaggcattgttataaatacataaattgtaatggtatatttcaaatccacacaaattgtaatggcatatttcaaatccgttaaatttataatggcatgtatctaattaaccctacaaatttataccacgtattgattcttgtcccttttccagaatcagttgtagtggatagcaatttaacttgacaaaaattctttagagcgtttgaataattaccaccagaagaaaattgttgagaagtagtaataggcaataacaactgattttgaagttcatgtcctaacctgctcaaaccatatactccgtaccaaaacatattctcattgcatctactagtattccagtcatcacgtgatacaggcaaccaaacgattccattttgcaccggctcatctaagcccaaggaaacgctttggatggatgacacgtggactccctggggatccgacggtatacgatgtccttccgagcggctcggctcacacagctataaaataagaccgagaaagcgactcgcacacgcaatccatcacgcccgccaccgccatggctg

SEQ ID NO: 46866 - DNA, 1501 bp, Oryza sativa
ctgccattgctatgacccatatgcattcgcagtgactgattgccttcattccttgctgggcaaacagttgatttgcgattagctggaatgttcaaaggcaaagacctagaagcctctctatcaaagttattgcttagacttcttattgaagagtgcgtatgcctcataacagcgcccaaagagtgtgttatgtgctgattctccatcagagttggagttggcagtggcctgattatcggctgtctctccatcagagttggagttggtggtggcctgatcacctgctgtctctccatcagacttggagttggcggtggcctgatggcaggacccatggagcatgggtttcttcccataaatagctctgtcatttgttggataacagctgcaggtggaataaatcatcagcacgatggaaaatcgatggcactaattgaaaacaaatggcaatggtccgatttaaccctggaaaaaaggctaaaacttcatgaatccatattataaggattgtaccttgtaactgctttggagcaacatcaaactcatgccaccatacttttccatcagaaggaagtctaaaattattaaacttagcagcaaggtagagggaccctgctgctatgtagtgaggtttaaactgcacaaccaaagtagtccgaatcctgcataaacaggacagcagtaccaactcagaaacaacagagttgcaatttcaagaataaacaaataacaaggtgacgcaaagaacttacgcatcatttattagattcaccgcaacttgtttcacttccatctggaaaatgcccagcttcttgagagcgagctttagtggctcgtaaggatgctgtatgttgaaatcaaacctaattgttgaaagcaacagcgtctcccctaccaaaatgagctctttctgcttctcaagaacttcctgcttttagtaagaaaagttatgacaaagaagccggttatatagcaagagtatactaatagaaaaaatggaaagttttaagcaccttctggtagattctgtgagcagcgttacagtctttccggtacatggtttcatatgccacaatgatgacacgttgtaatgggcaaggtgtgtcttcaatcttcgaagcaagaaatacgcagacagttgcaacggtctggaataacagatagtaactatgatttacatgttcaatagtaaaaattgttaaataaacttgcgcatttgtgttagttagtaccatgggcccaaatctaggattaaatttcccatggctagaaataaataagcacctatattggaaaaggcaaatagcaataaagacaagttgttattacttactggtaaatagtactaatagaaagcattgccttcaagtttgataaagtcgctcccaagaatcacgtgtcttgcccaaaattgcaatttttggtgctccgagtaaaattgcttaaagctatacctcacttccagattcattacttaaatgggcgaacttcaagtcgaagt

SEQ ID NO: 46867 - DNA, 352 bp, Oryza sativa
ctcctccgtcaaaaaaagttataaaccttaacacatccggtaccgtgaatctgaactatcctaattccgtccaatacacagtctcatctttacgattatgtttatacttattagctaaaatttattttttcaaccttaaatttatagctgattttgaaggtttttatcaaaatttatttttcagcatttatttttatatcactaaaaacacacacacacatatatatatattatttataaattattttttgtttataaatagtataccgtatggcttattccacaaataaccgagtaaacaattgggctgacagaacagcaagtacggtttctaccatgatggcagccacca

SEQ ID NO: 46868 - DNA, 1501 bp, Oryza sativa
actactatcccaaatttattccaacccaaacaacccatgactctattgatattgcatgaactcaattatatgatattcataacttgccacataaacatcaatgtatacatggttaacgttgatagttatcacgaaaaaccactttgtttcacaaaaccgtcggcagctggtttgtaacatgttttagctgatttttatacggagttcatcagaagtccttgaatatttttgttcggttttgtttggttctcaggtagagcgatttttactcccaaactggtaatcttttcatacatatttttcatggtcttatcaggctttcaacaaaccaacaaagaatgggttttactcccaaaacggcaaaggttaccgaaaatccttgcttttttttttagttttgggtaaacagatatagaacgggtttttactccaagacggttagctaaacccccaccgtacccaacgcctccatcgccacaaatatcagccaacccagggaggacgcgaacgcaaattcccagaaacccgaggggctgaaacggaagcgaatccgaaaccacacaagccgaagcgaagcgcgcaccgaattcccggaggaatcggcatcggctgctcctccttccttcttccacctcgtcgacgtcgcctccttcctcccatcttttccattactttaaagttacctccactactttacctccccactcctttcccccaccacccacccgcctccctctccctctctctcttcttcctcctccgcgacgcctctccccaaaaaattcccctccccgaccgcctcgcctcggattcgattcccgcgccgccgcttcgccggcgccgacgacgacgaccgaccgaggtgggtacatcatcggggggcgagatctccgcggtgctcgaggtagccgcggtggtgagttttttgtttttttgtggggtggagggggctagggtttctgacggggaatgcgggttgcgttgcaggatccggaggtttgggagaggaggaggaggaggaggaggaggctgtgcttgttcgtccgacgacgtccatgtcggggcatctcgatcgcctcgcgcggccatgtgagttggggattttgatttttctctccgttctgttttttggggttttttttgctcgatttttttttcctgggagatttgattgctggggggttatgagattggattggattggctgcattgggatgtctcgccgtgaggattggcctgcactggcgccgcgttagaacccggattaatcacagagactagattagatttaggatttaggcgaatcaagctcgctgcgagttctctcgcttccgtgtgttctggtttggaataagttagggcttagtatccatcgagtcgtaggacggtttgcgtccagtctatgtgtggttcgagtttgaccggttcaatattgtgctgttctggtcttgttgaaggttccatgttctctggttttgatggacgcgtagctcccagaatg

SEQ ID NO: 46869 - DNA, 746 bp, Oryza sativa
caaaactgttactccatccgttttatattataagtcaaataactttttcttagttaaaattctttaggtttgattaagtttatagaaaaaattagcaacatttataacactaaattagtttcattaaatttagattgaatatattatgaaaatatttttattttgtattaaaaatattaatatatttctctataaacttagtcgagcttaaagaattttgactaagaaaaaagtcaaacgacttataatataaaatggagtacttgttagcaaagcgcacgccaggattaaaacatattcccctcttctcacatattcacacacacaccaccaccaccaccaccactaccaaactcccatccccctcttccggggagttgggtcccttttaaaacaaaggaaaaacatgaattctaaaggatttataccctatgggaataatcctttaaaataaagtattgatttctaccaatttctctaaaatttctaaggaatggactattgtagaggaattctagagaaaaatagcatggggtcatacctcatgttttcttcttcccgtgtcttaatttcctatgttttttccatgtaactatcaaacaatagtgttgaagcttttatgcgtgttcaatcccgtaggaatccaataaatgtgtcatactatttttacgttttttctattcccgtgttttgataatcatacgtttcaaaggggccgtaagaattttcagttacaactcagaatt

SEQ ID NO: 46870 - DNA, 896 bp, Oryza sativa
gcatatttgctgtgtggcttgctgagtatgtcatatgctcaccttgcaataatcaatcaacctcagttgaagacaagttgcgaaggaaaagacgtttggcttataccccagttgagctgcctgtgggagtggagctggagcttcgctagattttattttccgctgcagttttcttcttggtgaggacttagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatcttgactgtaggataagccaaatggtcaaaccttaaggactaattttccgaaaacatgatttgtgaaaatttctcctttcttccttatctagaattctttgcaaattgtttcattgtctactcccctctctctttcaacttgagtagttctgaaactagttgttgaaactagaaaatgctgatgtggtcaacttatggaggttaagtcaagtggatcgataaataagaaggtgatggtcgatctgaagtgccaagtggtcaagatggaatgaagtttggatcctaccttagaacctaaaccaccaaagtgactttgaagaatagttagtaggatagaacgtttgttgtttgcttgtgtgtaggtatggttgcatttccatcattggagtagttcagtgatgagtgtgtaactatactaggttgcttgcttaatcaacttgaacaatatattggtctacacacatcagatcagtgttaacctggttaaggtcttgtctttagtgtaacccctctcctcctatcttctctaatctgcaacaga

SEQ ID NO: 46871 - DNA, 1501 bp, Oryza sativa
acagagcgtaggttccttggttcaactaactacgaaataatcttttggaaaaccttagacccaaagaaatacaaactctttgcatagcattttgtgataaatatagtgtggacaacacatagagtggcaactcgaggttggccaaactactgtttttatcctccatgctagcacaccatcactagtacagatccttctatctgtgacgggctctaatatgcttagaaatagcgggccgtcataaggaagtcatctcaattgggccgaaaagtgcccgattgagatatggtcgcacagacatattagatgggcataaaacttaagctcgtcacggatgacacctatcagtgacgggccgtagtgtaagcccgattgagataacattccatatctcaaacgggcctaaagttgtggcccgtcacaaatgaccatcatctgtgatgggcaccaactttaggtccgattgagataacattccatatctcaaacgagcctcaagttctggcccgtcacagatgaccatcatccgtgacgtgcaccaacttgaggcccgtttaagataacaactaggcccgtcaaagatgactcatcagtgatgggctatatacttaatctctatcgggcattaactaaagctcgtcaccgatgactatttttccatttttcatatgaaatgtttatatttgtaagttgactatagcaaaataattgtcacgccccaaactagccccgaacgggactagcccgtgacgctccaaattaacctgttaatcgataccagtcccaggaaacagtgctggtatcataggaagacagaatatcacagccacaaaggtctctttattacagagtaggagtacagccatgttgggctgcggacaggtcccgagctcacaactgcattacaaaagagaaaacggaagccaagacttgggccaaacatcacaggcgcgacttgggaactaggccgaaaccctaaaactcatcgtagccgacttgctcctggaagaactcctcgtcagcgggatcctcatcatcttcttcagcgactggggggggaattatttatatagaacaagggtgagtacgggagtactcagcaagccatgggaattaagtgtttaatgcaggcttcaaaggaaaggctgttgtttttgcaattgattttatttaaactcctttttgaacaactaagtgtgtgcttctcaaacgacacggatgggacagtgcgtctcgtccggtcggagtatgtgcaatgtatcaatctttgaattgattcaaggttggcacctggccaacaaccttaaaacggccacccgggcctggctgatcccatcagccgcagatttaccaaacatcgaacccattccacaacagcaaattcacaaagcagtagttaaacaaaactacgctaggaatcacctcacatccgcccatgaccgtgggtacggctgtttgaacagtttaataacctctgcagagggggtacactttacccaca

SEQ ID NO: 46872 - DNA, 449 bp, Oryza sativa
ttgattactttattccttgatacctggggtgattataatgggactagttgagctttatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccatgggggtcgctggggagtccatgccttgttttataagg

SEQ ID NO: 46873 - DNA, 674 bp, Oryza sativa
taaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcataattttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttacacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcggctagggtttcggtggaccgggcgcacgggcgacggttcacgcgaacggacggccgagatcgaaccaatccaaaacggacggccgagatcgatcgggtccacggcggctcacggcggacgactccga

SEQ ID NO: 46874 - DNA, 1501 bp, Oryza sativa
ttccaaaccgatttaggcgaagcttccaaagaagaaaaggtagaggagatcccgaggatcattttccctcaaacgattcggccggataaggaaagacgcggccgaatttggaaggagacggcggcggcttgcgctagggtttcgggcggcggcggcgacgcgaggaagacggatccgacaagcggggcccacctgacagcggctgagagagagaggagagcggcggctcggcggactgggccagctgggccgagggaaagagagaagagaggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaaatcatttctaataattccttttaaacaacaatttataagttaaggatttttaaacaagaaaagctcttaataattatacttagatcattaatgatcaaataattactgaactgttctttgtattattaagagttgagctctgaaaaatccgagaaaatttcagagagttgacttaaccatggagaatttaataaaaattaaatccatccatgctttatatttaggaaattttatttcccacattttacttcacttgtaaattaaagaacatttaacaaaaattctattattaatttattaaataatttataaatcctgaaacaaaaaatcaggatgtgacagtgaccgaccgggaagtttgtatttcccgcgtgggtgcacacgagtgagggctagccaaaaaataaaatttatttatttatggattatactcatctgtgatgggggggacgggcattaacttaggctatagttaatgccccacccgagtgggggctagccaaaaaataaaatttatttatttttagattatactcatctgtgacgggcattaacttaggctatagttaatgcccgtcacagatgacaggcataaaagtttgaatttcccgcgtgggagcaatttcgggatgggtgaccgaccgggaagtttgaatttcccgcgtgggtgcacacgagtgagggctagccaaaaaataaaatttatttatttttggattatactcatctgtgacgggcattaacttaggctatagttaatgcctgtcacagatgactcatctgtgacgggctatagtttgactggtcgtctgggtcaaaactatcggtgacgggctttacttagagcccgattgagatagattcatccgtgaccgccgtttgcccgattgagataactcttcacattagtgacttctagcctgtgacggacgccatgcccgattgagatggggcttaccgcccaattgagatgagggtatccgttctagtgcat

SEQ ID NO: 46875 - DNA, 436 bp, Oryza sativa
taatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaaatgtgtgctaatgtttctaagcatggctaagcaatcatatctaatatctagttgaaccaatatatataaagctcaactagtccaattataatcacccaaggtatcaaggaataaagtaatcaagaacaaaagggccataacaaagaataggttaatttcacccaatgacattcgaaaataaatgcacagttgaaataaatagagaatttaaatataggatcaacatgctcaaaggattgtgtttagg

SEQ ID NO: 46876 - DNA, 437 bp, Oryza sativa
ttatttaattctttttaaatgggctttaaatagatttaatcttgtaaaattcttaataaattcatttgaagtcagaatgaggccgttcaagtctcataattcatctaaaattatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtgaaattaacctattctttgttatggcccttttgttcttgattactttattccttgataccttg

SEQ ID NO: 46877 - DNA, 882 bp, Oryza sativa
cttagctgtgaattcaatcaatggaccaagcattcatgcatgtcaagctaccactactgtactacttagctgtgtaaatctcttatgcactggatgacctaatttacctaagctaaattgcttcactctttcctcgatgtcacattacatggcattctctaaatcaaacttccagatgttcaagattgaacccagcttcactcttgcctgatagaacaaatatattttaacctaaattaaaattaagatttacagcacgcacaagctcacatagatacattcatacattccatggagtgctgatgatggagatggtcgtcaggcagacatggatgggcctggggcaacggcctcggccgtggggcagataacggcctcttggtggaactggccagatctgcttcacagcgaagggctcggcggtagagcggccagcgagcaccgtgatagtggtgtagtggaggccacgatgtgggtatgtggccgagttccatggattcccctcgcaagaccggaccagcgccggcgtcggtggtggcaagggaagagcgagcgcggtggacgcagtggtggtgttgacgggagctcaacagtgttggaagaccagaagagcgagcatggcgttggggaagaccatggctccgtcttcggcgggggcagcggtggaatgtggcggcggcggcggatggggacgacctcggctccagccgcagtcgatggggaagaccggctggggacgacctcggtggccagcggtggagtgcgcggtggcggcggtggcggcggaaggggttgtcctcggctccggccgctgaggagcggcagatggggaagaagtaggatccggcagcggctggagaagtcggctccggcgaggatgcg

SEQ ID NO: 46878 - DNA, 1436 bp, Oryza sativa
ctgcggatcgaggacggcaccgccgctcctatctccccgtcggctgcctcaccgctctcccctctctccttccagatctggcatgcttctccctctccaccctcactccatggctacaccctccctctcaaccatccgttgtaaaaaaaataaaaaacgggctagcgacgatgatgatggaggggaggtcgcggcggaggagaggtcgcggaactccggatgggggtggggagcgcggttgttgtgatataacgtgaggagagagatatgctatatttaccctttctctctcccgttttagcgcatgcgctagttttggatgactggatggcgcatccactagaagtggtttttttcgctcctatgcgccaaattagggatggaggaccagatagaggagctgttgggatgctcttagtatccttggttgttggatttttagtttgctttatgttgagcgaaccaagtaataagtagctgtagttttttaagcaaagatcaggatttatttcatcaattgaaaaaacaccaatcatgttgtgacagcatctttgaaaacaagaaattgctcactactcgcatacacaaatttaggcatcaaccggttacttgtgtggaagcgatatcgaaagtggtaaccggctgattgccaccggtaaatagagtgccgcataatacccaaatctttactttaagaactgaccaaatcttttgtgtgcaaaaatgttaaattccacgtgtagttcaaaaattcaaagtgtgggtttcttcggaaaaagaaaaaaggaaaacttcaaagggtgtgtgagcctctcaccgttcattgtcccgtgtccacttgtccagtggatatggacagcaactgttcacaatgtgatgctaattttatatttattaggaccatagaatgcaataaaatattagtcaaagtatgtttttaaaaacagtgtactacacagcgacgcaacggaccacttgtccactggaaatggacagcaactgttcacaatctcggcaagttatcatttactccctccgtcccaaaatataataagttttagccctcaggatttgttccaaaatataacaacttctctaccaatattcttttcccaaccgatcataatcctccaccattcacttttcccatatacctccactacttatccaatcacaatctttcaccactcacttctacctatttttttaataattgtgtccaattctaaagtttcttatattctacggatggagtatcaaaaaagagaaaaaaaaaggcctctagtaacacaacgacgcaacaccttccctagccgcttaagtgcttaactgacgcttcgcattaattatcgactcgactcactcgagaatgcgagaatctcgactcgagcagacaggaagaatggcttcctccacctccgggagaagaggacgag

SEQ ID NO: 46879 - DNA, 1501 bp, Oryza sativa
ctcccgccttgatccacgctcgcgcattctctttgatcttggtgataattgtagccattgtggtagctatgtgtataaagatcctggtatttcgctcgcaccaaagcttcgaggccacaaggatgatcaccaattttagtgtctttctcggcacatggggtatacgtgacagtttgtaccaccattcttctacattggcgcagtttgcccactcatttatttggaggtcgatatttatccatctttgaagttttgtccatatccttctcgacagtctgcagttggctaggaggtgtaggaccgattctgtagaagctcggcacattgggcaattgtgttggtttgtcctgtctctcttttggagcctgtctattatccagactctgttttggattatgagccaagaaaagaacttgcgcgcacttagtggcacccaacattttgagattgtctggttgaagatcgagcccgctgccccaatgaattgtaatgtatgctaatttggttgagtagacaccgttctcactacaagaaaacatacaattagctaccgtatatttagttaccaagaagtttggtgcctagatattaatcaatagtaaccaacatgctaataccttggtttctgtagctgtcagcacgttacttgagttaaacaataccaattacctctacagttaccaagttactggccagtacttggtcactagtcacgtgacaacatatagcaaccaaggcatgtacctgatatttgaatatgtggagtactggagtgcaaaacacacttcctcccgatccccatccagaaacaaatcgagaggcaagggaaaggtctcctgcggcggcggcggcggcggcgaggcgagatctgcggccggcggcggcaccgtcgacggagttttgcggcgacgacgccgccgccgccgccggcgctcggtggaggagtccttcgcggcccctgtgctagcgcccaggaatcggtggtctctgcgatggcagcgcccgagggatcgctggtggtttagctacaacgtcgtcggggcaagcagttgattcattgcaggcagcaggaggagtctccactttgattcaaggtaagtggttaaattctcctgatattctatgtttgcacacaaacaatttgtttaactggatgtgccttgaacctgatctataacccaaatgaatgtttgtatgcactattattcaatggtttttgtgtgagatttgatctgctataacatgagtataacatgagtgtgacttacaaatctggttgactgcactaatttgattagcacacagtatttcgaattttagggttttagaaatgaattgatttccatgacattgggttagcatgttggtttgtgagtgccatggctttagaagttttattgccatttgtgaggagattaaatagttttagattaaataatctgtaatacttgcattaccacattggtgattaattctaaggaaacttgcatttatgcagagg

SEQ ID NO: 46880 - DNA, 1501 bp, Oryza sativa
cggtgccgccgccggccgcagatctcgcctcgccgccgccgccgccgccgcaggagacctttcccttgcctctcgatttgtttctggatggggatcgggaggaagtgtgttttgcactccagtactccacatattcaaatatcaggtacatgccttggttgctatatgttgtcacgtgactagtgaccaagtactggccagtaacttggtaactgtagaggtaattggtattgtttaactcaagtaacgtgctgacagctacagaaaccaaggtattagcatgttggttactattgattaatatctaggcaccaaacttcttggtaactaaatatacggtagctaattgtatgttttcttgtagtgagaacggtgtctactcaaccaaattagcatacattacaattcattggggcagcgggctcgatcttcaaccagacaatctcaaaatgttgggtgccactaagtgcgcgcaagttcttttcttggctcataatccaaaacagagtctggataatagacaggctccaaaagagagacaggacaaaccaacacaattgcccaatgtgccgagcttctacagaatcggtcctacacctcctagccaactgcagactgtcgagaaggatatggacaaaacttcaaagatggataaatatcgacctccaaataaatgagtgggcaaactgcgccaatgtagaagaatggtggtacaaactgtcacgtataccccatgtgccgagaaagacactaaaattggtgatcatccttgtggcctcgaagctttggtgcgagcgaaataccaggatctttatacacatagctaccacaatggctacaattatcaccaagatcaaagagaatgcgcgagcgtggatcaaggcgggaggcacatgaatcatagagatcatcccctcgaagaatagccctattctagttcttttgcgggtctattgtttgtgatagaccctgtatatatttccgtgctgtgaatttactcctctataatctattactagtacaaaagtgagaaaagcttttgcctttttcaaaaagaaaaaaacagatattagttcttatgatttgtgaacaatatgtacaaatgcagtaagaacagggacggtaaataatctttgcatttatgagtatattgggctattatcattattcggaaacaaaattgaatcactttaaaacgttccatatttaacgtgctacttctatccttggaagggcttgaaatatgaattgctgccgttaccttaccaggagatttaatttggtgccacaatcgggttccgacgccaccaggccgatcttggaaagcattgacacattttgatccgcgttcgatcacacggaggtttataaaagggggtctgcatatgcaagcaatgcagaacgatcgcgacaagtatatatctctctctagcaatcatctcgatctgtacattcttggcgatggagagcttgatcaggcgccatggggggcgccgtgccg

SEQ ID NO: 46881 - DNA, 457 bp, Oryza sativa
ccatttgaaaacgaagctttctctctcctaaagcaagcaccaattagggggggaggttttcaactcgaaatttttacttgaactctatacgaaaggtgaagaactctctatcttgcttcatttggctccatttttggtatatttcggttgggggaaagtggagtttttttaatattttgacaaggtttggtccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattg

SEQ ID NO: 46882 - DNA, 1501 bp, Oryza sativa
  unsure (1)..(1501): unsure at all n locations
aaagcgacgttgcccgtgtccgccagcgagtccccgaagctgaacacgcgcaggtagcacggcgccgccagcgcctgtgccgccgccgccgccgccgacagcacaactgccaccgccagcactaccgccggcggcgagaggaggcctgctcctcctccggaagtggaggagaccattcttcctacactttcgtttgcttctgctcgacgtcgggcccgaaggcgaagcggccactgggattggctctgcggtgttttttcgcgttggcccaaaaaaggcaaatactccaagaaacgtaagcgtggctcgttaatgttaagtgggctcgagtgacgaatgcccacaggtcagtagggcctctggtcgctgttagcctattacacatgagacggtgacaggtacgctccatcctccactaaatgcactgtgaaatgcgttagtataattcttaagcgatcataacaagtacacattgatccctatatatatcactcatcgctaaaataataattacccgtaaatgcaaatgctcatgtcaagtataggatttgaatcaaggggacttcgttctaccacgagaaagctaaccagttgagttgcgtttacaagtacgtttatttcgtaagtcgtaaggtaacacttttagatacacagattgttgtatatcattactttggaccaaaagatttgatacatccatatattgattttttttcggcgatgtatatttaaccaagcgtaagtgaaaatatttttccccgtcgttcgcattctgccatggtgaaacaacttatcgaacgataatgaggcttgcagcaacaaatcacaaaatggttcaggtgataagactcgaggagatagaaatgggaaaataagtgtagtccaacgacaatgacaatattttttttacttcctctataaaatatactcaaccttgtatgaaataggataatctagtacaattatccatatattcgttgtactagattattttattccttactagcttacgttttttgtgacggagggagtattaagtaaataatcgcttctcttaagagtgttaggtgcaaggagagtaggtagtgaattaatgatgttgcaacataattgacctgattgatatatactgggagttgtgctttttatattatctaatatttgaagtgttttcgntatttcgatttctttaaacaatatcccgcacatgtttgacactgacagtttttttatttaagctatatggcacttctgatgattgtggatacaaataagagtcatggaactcactaaaaattagataaagcgatcggattgcatgatctttatacaatatcgctcataagaaatgcctctacgagaagcgacatcacggccacatcagccacgcagccaaggtgaccaaagaatgtagttgtctccctgtaacccctaaccctttcactatacacagaagaaaaacaatggagctaaattataataatactacacataccctata

SEQ ID NO: 46883 - DNA, 1501 bp, Oryza sativa; identical to SEQ ID NO: 23141

SEQ ID NO: 46884 - DNA, 1501 bp, Oryza sativa
tccacatattatatatgaatgtggattgacaaagtcatcataacctaaatacgagcaccatgtcacataaagaataataaacctaaatacaagcatccgtgtgatgtcaagtgtacggtttgaacccatgtgaataggttttattacaagtaatttaacctagtgagttattatgctaaagagcatgactaacatttttgccaaaattcaatctccttaaatctttttttaatctctaatggaatttaagggataaaaatatcctttccctctaagagatagcccaatttaacttctcaaaataaaaatgtgtctacataaaaaaacttcagacaaaactagacctattttcttgtactcccacggttgactcctaagcgtgtgaatcggtcggtgatggctatccggggtgaggccctccctcgacttatggagagacatttatggtgatggggatgatgttttcagcttgtttagggctattgtgggaggttaatttttttgaaaaaacctgcaaaatatttatattagaagtagtatagacaatccattgacatgctctaagtttgttattcttaaaagttaggagtatatttcaaattttgaactttttaaaataatgttgtaaaataaactacgatgagaaaaccaaagattcaaagaaacaacgctagattaaagttgtaagattttaattttggtttataaggattgcccctccgagccgttctgcgtgctgagcttcgtattattgttctttgggccgtttgcccatgggagaagcgagatgacgaaaacatattttcactcacacacggttttcatcatacggaagtgcctcaccattcggaatacgtaattttcgtacgtccttgttgcgttttaccggtttcaccaggtcacgtagacgtagagtatccaaaacctttgccttaattaatacttccttcgtcctaaaataaatatagttttgtactattcacgttcaacgtttgaccattcgtcttatttaaaatttttttatgattaatatttttattgctattagatgataaaacatgaatattactttatgtgtgactaaatatttttaaatttttcaaataagatggacggtcaaacgtggggcacggatatccacgaatgcatttattttgggacggaagtaatactaaaaagaacatatgtttgtgtgcaaaaaataatggattcgacgtgtacttcaaagagggcctcttaactgagcacatctcatcattctcgaaggttagaaagcacacttgtcacacgtgagagcgaccactggccccactgacccgtgggcctctgtcaccgcgaccccacatgtcagtgactaccgcagcgtttataaaagccacgttagacttggaccaacgcaaagcatcgccgcgacgactttctctccttttctccgttcatctcgagcagaggagaggaatggattcctcctccacctccgggaggaagggaggaggactcc

SEQ ID NO: 46885 - DNA, 1501 bp, Oryza sativa
gctggtgtttttgcaattaattttatttgaactcttttctgaaacaactaagtgagtgcttctcaaacgacacggatgagacagtgcgtctcgtctggtcggagtatgtgcaatgtatcagtctttagaatttaaacaaggttggcacccggccaacagctttttcaacggccacccgggccaacaacttttcaaacggccacccgggccaacaacttttcaaacggccatccgggcctagctgatcccatcagctgcagatttttcaaacaccgaacccccttttcacacagcaatttcacaagcagtagtcaaactaaactacgctaggaatcacctcacatccgcccatgaccgtgggcacggctgttcgaacagtttgttaacctctgcagagggggtacactttacccacatgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtctttaagtgcgagagcgggaaaccgtacacccggtacgtttcccggtccgcggttttggaaattcatttagttcgcaagcaccgacccaggtgtcgggttttccaagtcttttgtaaaactccagttttacccaagttgttactcagattttaagtttgaaggcgaccgtcgatactagcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcggactccgaaactacacgcaaaacgggacaactcaacaaacggtgaaaataaagccctattaatgacctctaagcgtgccattagatagatctcgagatttgaggaattttggaagttgaacggagtcaaacggatttatggttgggaagatattgaatttctaagattattggatttttggtctaaaggaaaaggatttaattaaatcctttttggaaaagaaaagaaaagaaaaagggagagggagggaatatagacttccctcgggcggctagggcgcggcccgagagaaagggcggctcggccgagcttaa

SEQ ID NO: 46886 - DNA, 1501 bp, Oryza sativa
gggtgaaatataagtgcatgtgtggtggttcgctggtgtgcagtgacaaaaattttctagtgtctcttcagtgcatcttctttgtgtgtgtctttcatcaagtgagaaagagagaggtgtgtgtgcaagtgagtgtttgggccaacactattgactcttgagcaggtataatagaggcctataagctggcaatacaagcatccacgtcatacaaatcataggtatgtaacatctgttggtaccatctatcactgacgtatacaaatttgcaacccatcaacggacgatactattaaacttgctctaattcacagcgcggtgtgctgttatttggcccgcgccctccatgtatacgagtaggagagattcgatttggtgccacgtttttgggtgggcccacaaaactaaagtccgcatgacccaagttaggccattcacagtgctcctgcatggagtgtggactcatctagccatgtagaacactagctgtcgtggaagaaaaagtaggtggggcccatagttttagtttgcttctcatgtcttacttttgctacgagagccttgcctgcaagcatctgccgcatggcccacagagctatgtggagggaagaaggggaagcggcggcgctgcgcgtcgtgatcatcgtcgctgagggccgtcgggttgtcgttgtggtcttcatcgccgagggccgccggggtcgctgtcgctgaaggccgtcgggccgccagcagatcagccgccaattccgccacccaagtagatccaacggtgatactgcttctacaagtagattggctggcgagaggacgaagcggccatttgttaacgccaaaatttagtaagattctttagtggattcagttaaggaaagaagtcgatcagctgatgggaacctatgcaaaagaaaccaagttcaaggaggaatagtgaagaccatggcatgacagtttaattctatctattaattaggcaagatttaataacttcccttttatctttaggaaagtgtgtttagtgtttgatcaggacttgtcattttccttttatttttaggaaagtgtgtttagtgttcgatcaggactgttaacagcctataggtataaatatgtacacccaaggtccctataaattatctctcgatcaatacaacttcggcgcatcgccaccctttttatttttcatctttctcgacgagctcttgtttcgagttgggctgcttcagcttcgatcaccgatgaggggtaaggcttgttatggctatttgtatcggcgaggctagggtctcgacactctaatcttgtcgttgtaatacatatttatcatatatctcagttaatcaaagtcgttgtctaggccataccatttctagggttttgttggtatcagttaaattgcttcatcgatctagattagctaaggtatctaccaccctgaaaatcagacaaaggcttgattgtttagactttatgcttcttttcatatttagtgttgcatcaa

SEQ ID NO: 46887 - DNA, 1501 bp, Oryza sativa
cgaacagccgtgcccacggtcatgggcggatgtgaggtgattcctagcgtagtttagtttgactactgcttgtgaaattgctgtgtgaaaagggggttcggtgtttgaaaaatctgcagctgatgggatcagctaggcccggatggccgtttgaaaagttgttggcccgggtggccgtttgaaaagttgttggcccgggtggccgttgaaaaagctgttggccgggtgccaaccttgtttaaattctaaagactgatacattgcacatactccgaccagacgagacgcactgtctcatccgtgtcgtttgagaagcactcacttagttgtttcagaaaagagttcaaataaaattaattgcaaaaacaccagcctttccttgaagcctgcattaaacacttacttcccatggcttgctgagtactcccgtactcacccttgctctatataaataatcccccccagttgctgaagaagatgaagcgaatcctggtgatgaggagttcttccaagagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctatctccctgtgataccagcactgtttcctgggactggtatcgattaacaggttaatttggagcgtcacgggctagttccggtcgggactagtttggggcgtgacatggcgtggggcgcaaggcgacgtgacgggcgagcggcgacggcgcggcagcggggcagggttaggctaggggacctcgtcgaacacctggcggccgatgaatagtgccgttttccatttacccgatttaagcctatttatttatttaaaattgattctataaaccttaatttttgtaccaatgaagttcactcaatatttgtgttattccaaccaatgggtccacccttgattaattttacccatattttatttttatataatttccttgaatttaattagagttaattcttattccgacacttttcaatttaattgatacaaatatagtcgtaataatattttactcatttctatactcactaaatattattttaaattgtactttaattatttacttagtcaatttactttttagggtttattcctaactaattatccattattcgcgatttataaactctgaaatcaaaattcaataaaataatcgaacaaaattggcatgatgcaactttatttaaaaagtttttgaagatccgtatttttagagtttagattttgtcgtcgaatttttagggtgttacacgataccagcaaatgtcgatagggttttgagcaatcagctatatgtccaatgtagattctgacacttgagtaaataataatataaagataatcatgacacttgagtaaataat

SEQ ID NO: 46888 - DNA, 601 bp, Oryza sativa
acatccagttttctcacgggttctcatcgaatatccccccggatgttggaatggacagtattccttagtacaaccagaagccaccaatcttcaatccataaataaattccactatttcttggtaatgatgaattgctttccatatttttgttggtgcagttctcctctttggaagcacaatttattgttgtgccataaactaagtaaccacatttgactaagtaaccacaacacataagagtttatctttccgactttattccagacaatccaatattcccacttcttaaacagaaaatgaacatggaaagttaaggaaggtaaactaaaaaaagtgaggtacaatgtttctaccatccacggcactgatgccgaacttttgaactaatagtagatgatggtttaaccacaactctcactggatgatctagtgccatgaattgttctattaggatttatgaaattctcttcattctcaaatagattatgtcctagaatgagtgcagtacaaaccatcaaatcttaagtcactaatatatataaacatattaagatttgatatgttaaaatgacattattatattttcatggaaaatatttt

SEQ ID NO: 46889 - DNA, 428 bp, Oryza sativa
cttcagagttaagcgtgcttggcctggagcaatttgggatgggtgaccgaccgggaagaattcccgggtgcacacgagtgaggacaaagtgtgcagaaataacatgtgttggtctgtgagggcagtctatgacctatgaaagctgccagatgtaagtgggcccggcctgggggaggcgggacgttacaccatcgctgccgccctgtcaccacccgtcccgtcgcgcgcgcgtcccatcgcccgccgctgcgccgcgcaccgtcgccgtcgcgccgcgcgcgtcccgtcgccacgcgcgtcttatcgccgcctcgcgccccgcgctgccgcgccgccgtcgcctcaccccccttcaccggcccctctctctcctctctcacaccctataaaacccccagcccttctcttctcccccacacccattcccc

SEQ ID NO: 46890 - DNA, 785 bp, Oryza sativa
aattgctttccatatttttgttggtgcagttctcctctttggaagcacaatttattgttgtgccataaactaagtaaccacaattcataagagtttagatctccgactttattctagacaatccaatattcccatttctcaaacagacaatgaacatggaaagttaaggaaggtaaactaaaaaagtgagatagaatgttgctactatccatatccacacaaccctcactgaatgacctagtgccatgaattgttctattaggatagaatgcgtgtagtcaaacctacaaatcttagctcattaatatatataaacatattaaaatttgatatgtgaaaatgacattattatattgtcatggaaaatattttgatgcaactatatatttaatgtttcatatgatcagagatagtgatacaacatgctgataccatgtcaataccctaacaagtaaagaaatggatggagtatatcaatatattatcatggaaaatattttgatgcgactatttatttaatgttttgtatgctttctgtcgcgttgcttgccttggactaggtggccacaacgtacacacccatgacgcatcacaatctatcgagcgatgcaccgttgcgctagccaagggttaaatgtgtcatgcagccgtaggggctgcacaagcctcctctgcccctattccgttcgccagcctctcccatctggcattcatttcccagatggagttgtgatgggagaggcgtaccgcgcacagccggcaaccacacgacggatctagaacaa

SEQ ID NO: 46891 - DNA, 486 bp, Oryza sativa
tggacttattcctattaaaatcttcccagcccaatagggaccgaaataagtgtttcagcccaagtgcctacagcttaccttggaatttggatgcataattgcgtatgagccagacgcgtccgaaccggacaccgctgaattccatgttcgcttgacctctacggctctacccctctgttcgtacgtgaaccttagcgcaagtatgaattaggagggcccctgcatggcagcggtggatgctgcttatcgggccatacataactgctaagctttgtgcagtactcgcctcgctcgtttgtcacgtgtatgcatatatcaccacacaaaccaacagagaggaggaacgccgacgggtgcaacgtcgccgttgcagcacacaagacaagacacgacacaatgccaaaataaggagagagagagagagagagagctgacgcgtacgtacgcactcacctagttttcctggggcctggaagatgctcgtca

SEQ ID NO: 46892 - DNA, 1501 bp, Oryza sativa
tgctcgccgatgaacgcctcgtacgtggccatgatcatctcgccgtaggtgatgaggcagcggcggaggtcgacgtccagcgggtcgagcaggccgtcccagtggccgctgccgtgcagctccctccaccggctcgccatgtcgcaggagaacatcgtcgccagggtacctttctgatcgatctgagagctctgctcttggtgctatcctgtcaaactgttagaattttgttccgacaaagttaagttgacatggtgcattctcaaatatagtaatcatttttatgcatttttcaatacgcacatttagaaaaaaaacatagaaatgattatattttggaatggaggtagttccccaagatgctagatatttgtatcagttgctctgaaacatctatgaaatttttcgtgggacctagagaaaaaatgtttgtgtacaactgtttttttaggcttatgcgtatattggcctgaaaaaagttggcagaatataaatgtgattatgctggcagctggaatcgatttaacatgtattcatggtccattattcttcagataaggctaaaactaggagcattatgcaagataatgcttacatttttcagagggggatgatattatttctggtaggttacctatggcaattattcttttgtttcatgcgattcattttccttgccttttttaatttacaaataaatatgattaaaagcactggttttggatatatcatgcagatgaagcatactagtcttgtaaataacaaataaaaaaatggcagattattgtacctaaaccgaattacccaacacaggaagaaacaagaaaaaggttatcacctttgatttggaaccttccttggcgccgcctacaatctgaggaggcgacttggtggtggcccgtcaaagtgaacgaaccggcggcagccgctggcgaggagaggtgtagatcgccggtgatccattgaccatcgatcccgagttcccgactgccaggatgagaatgagatctcagatatggagaaagggagtgattgggacggtgccaactggaccgggcactttattgggtcattgagtcagtgggtttggtggctcataatttgcgattaattttttggcatgcttttcatctattttaagagatggatgtgcccttttctgcgctaatatgaaaaagaaccatttaaatataagttgcatatggaaagtgtatttagtagcctcttaagattcgttagatttaagaactgcaggagagatgtgcttctacaatgatttgaacataaagtactcgtagacgaataactcaaatctggttccttccccctgaaatgttcgagaagatcatcaagcacaattatggagtcaacacattttaaagcaaattactcagtgcatctgattctatccaacctcaggtgctattttccaactacatcttcacaatgatataccaagactgccttcacttgctttgcttgtcagaaacgtcacaactta

SEQ ID NO: 46893 - DNA, 1501 bp, Oryza sativa
caaccgacagctcaaaactaagactctgaaaacaggggatactttcatgtgttcgttattgctcgacaatgaagtaatgcatatgtttggaatcattttgtttttaacatttttcagttcattgtgttttacttaatgttatctgtaataagttatcaaaattgcccgctgaaaaatgaattatcagaattgttaagttgtgacgtttctgacaagcaaagcaagtgaaggcagtcttggtatatcattgtgaagatgtagttggaaaatagcacctgaggttggatagaatcagatgcactgagtaatttgctttaaaatgtgttgactccataattgtgcttgatgatcttctcgaacatttcagggggaaggaaccagatttgagttattcgtctacgagtactttatgttcaaatcattgtagaagcacatctctcctgcagttcttaaatctaacgaatcttaagaggctactaaatacactttccatatgcaacttatatttaaatggttctttttcatattagcgcagaaaagggcacatccatctcttaaaatagatgaaaagcatgccaaaaaattaatcgcaaattatgagccaccaaacccactgactcaatgacccaataaagtgcccggtccagttggcaccgtcccaatcactccctttctccatatctgagatctcattctcatcctggcagtcgggaactcgggatcgatggtcaatggatcaccggcgatctacacctctcctcgccagcggctgccgccggttcgttcactttgacgggccaccaccaagtcgcctcctcagattgtaggcggcgccaaggaaggttccaaatcaaaggtgataacctttttcttgtttcttcctgtgttgggtaattcggtttaggtacaataatctgccatttttttatttgttatttacaagactagtatgcttcatctgcatgatatatccaaaaccagtgcttttaatcatatttatttgtaaattaaaaaaggcaaggaaaatgaatcgcatgaaacaaaagaataattgccataggtaacctaccagaaataatatcatccccctctgaaaaatgtaagcattatcttgcataatgctcctagttttagccttatctgaagaataatggaccatgaatacatgttaaatcgattccagctgccagcataatcacatttatattctgccaacttttttcaggccaatatacgcataagcctaaaaaaacagttgtacacaaacattttttctctaggtcccacgaaaaatttcatagatgtttcagagcaactgatacaaatatctagcatcttggggaactacctccattccaaaatataatcatttctatgttttttttctaaatgtgcgtattgaaaaatgcataaaaatgattactatatttgagaatgcaccatgtcaacttaactttgtcggaacaaaattctaacagtttgacaggatagcaccaagagc

SEQ ID NO: 46894 - DNA, 1184 bp, Oryza sativa
atatgaaacatatcactccacaaatatacacgttaaaattcaacttatacaaattgtaccaaatataactgtgaatgtacattaactatttttaattgaatttggtcttgcatgtttgtgaaatgatatatttcatgtcaatcgatgttgatatttttttatgtctatataggtaacatgcaaaaaacgaggggatgtccctaaaggaataaaaattcatctccaatcgattgtacatatgttcatgcccaaagttcattttttttcaactaaattttgagcttagcgaattgagtgttactctatggagtttttcactaattagttagttagtgaacatatatttgtcaacaaatattcgtaagtttataatttgttgacaacaacttcttaatacgaaatgtagcacttgctcaactctaggtacctgtgcaactcgtacagtacgtagtattaggcctatccacctatggaaaccttactaattcagctgttgatcggattcaaccgtgcaaacagaaaagaaagcgaactatggctaagctccaggagatctgtgctctcaagcacagaatctaaatatacgtttcactgaaaacgacacccgcacatgccgttccacccagggagatgaacaaaatgacaatttggaacacctgccaatttcgttagcacaatagaacccgataaatgcttggctaccagggccactcttttcgttaccatttgcatggcctgataaccagaaacaaaatagaaagggctaggaaaaaagagagaatccaaatgcaatgaaccccaaaaggacaagaaatctgtatcatactatctggctgggctgctgctcaacgctgtccttctcagtcgcacatacgaacaacacaggggtctattcatgcaagcgcaacggcattgaactactgtgacttcaggttaagctcatggcttgttcgtgttgaaaggagtcggttaaaaggagccaaggatgtgtctggtactgcatgcgcggcgtacaggaagttgagaataaagcggaaggtgtgtttattcagttagttcagcgtttgccctgtatttatgttggcatgccacggctaggtgctgtctacttccgtgttgattgtgtccttggcaccttgcaattccatccccctgtcacgctacaaaacctcaataatggcgtg

SEQ ID NO: 46895 - DNA, 432 bp, Oryza sativa
tgatggtatgtacatacatggattaaggagcggaaaatcgctcacgaaaacactgtgatcacaaggagaaacggaactcctcaacgagccgtagcctgtagcaacgacgtctcacgctaaatcatgtctgtttgggaagaataacttaaaaggagccatacacttcttcagggatcagtaaaaaagtgtttctccaaacgcatgcaatttgcaattcgtccattgaatcatggatcatagcatgcaaactttgtactagctctttctctacacgaatcctgtaattgaacttcacctacacaatgtactacaatgtttccatgagcaagtaataaaaccatagcacaaagaatggatggatcgatcttctttctaccggtggaggaggagcggtttggtcaggtgggcgggcaggtcttggcgagagggaca

SEQ ID NO: 46896 - DNA, 612 bp, Oryza sativa
agttgagactgttctgatgcttcgttgtgcatagaagaatgattgatgtatcaggagaagctacatacaagtttccatacaccagtttgagagtcaccataatacatcagcatggtacagttcagtccgttacactataatcatataaacttttcttttataatgtctgtcattctatagtattatcaattataattgtattatttctttggtactaagtcataacttttcttttataatgtctgtcattctatagtattatcaattataattgtattatttctttggtactaagtcatctactttgagaaagataaacttctatatcttaaatagaacagcaaaactcagtttagatcaaaatgaaaaattattgtggccctgtttggatattagctaaacaatgcaatgtgaactgaaagtagcattagctttatttttcaggcactggtacatctgttgaaatttgttaggccaagacttaaaggtagctgctaaatgtattaaaatattgtactttggaagtgataggtagagatctgagctttatttgtggctttaccttgttgcacgtaggaccttgaccagctaggcagctagacccatattcag

SEQ ID NO: 46897 - DNA, 282 bp, Oryza sativa
gccaaatatttggtaacattatatatttccacgtgatcaattgttttacccttaggttggttgcatagaacaaaattgaaaaaaaaaacaaatatgtcaggtcaatgattcatgattgtgttgctacaaatgaacaaaatctgtctagtttataataggataataaacggacatgctggaagtagtaggtgaagatagtttctctaccatataaagcaacaattttgatagttaaaggtccctttcaactattattatccatacatacggattctaaacgat

SEQ ID NO: 46898 - DNA, 1501 bp, Oryza sativa
ctggtaccatgaatcgggagtaaaaatctatttttagtcccggtttgtgttattaactgggactaaaagtggagccaggctaggtcctaggtctggttgctttttttattattatttttcattgtttttaacattgaatattgatttcactccatccccaaatcgtgaaatcccaaatcaatcatcacatcacagagcaaaaggatattttccaaatcctcaaatcgatcatctccaaatacatcacaaattcttaaaaaaaattacatcacaagttctaaaaaattcatcacaaatacatcatatattcacgtcacacacaaatcaaatacatcttagatccgaatcacaaattctcaaaaaaaaaaaacaatctcagaggcgctgcccgcctgccgcgcccgcccgccgccgcacccgcagctgccgcgtccgcccgtcactccgccctccacgcccgcctgctgccacgccggccggccaccgccctccacccgctcgctctcgtgctgtccgccgacctcagctcgctcactctcacgctcaattgggaatacgaaggagaggataaggataagaggaggaataggaaagagaggatagggataagagagaggaataggaagatgaggagttcgggggataagtcatagggattatatactgtatattgatttttagtcaatttttattcccggttggtgtgaccgtgtgaccaaccgaaactaaaaatgcctggtcctctgacagcctcggacagaaaatggtcccggttgctaataccaacagggactaaacatcacctagggccgataaaatttgaaaccgggataaaaaaatcatctttaactattgtggtttttgctcaacccaataaagatggtttcttcagcagtggatgaaataaattcactcgagtttaaaccctatttttgatataggtgcttgtatttacgactaattattatctcaatggagaatgatgtatatgtttagagggacgagtgtgtaagtatcgtgaacgtctaccgtctacgttaatttatactgcgtttcacagtgcatttagtggaggatggagcatacacctgtcaccgttcattcatgtgtaacaggctaacagcgaccagaggtccactgacctgtgggcactcgtcattcgagcccactaacattaacgagccacgtttattagagtatttgcattttttttgggcttttaactatttgccacttttagatttggcaaataactatttgtcatccctatctcaatgacatgtgagtctaaatatatctattacatatgggtccagtggtaaaaaattaattgctacatctaaatgtggcaaatggttaaatatctcgcattttttgagtataaaacgttaggccaacgcgaaaaaccaccgcagagccaatcccagtggcgggttcgccttcgtgcccgacgaccacctcgagcagaaggaaacgaaagtgtaggaaggatggtctcctc

SEQ ID NO: 46899 - DNA, 1501 bp, Oryza sativa
tatgtgcatatatcaatacaattaataacttatatgatctatacaagcatttaatatatgagatactactgtatcttacagatatgcaatatatgcatatatcaatgcaattaataacttataagatctatgcaagcatttaatgtatgagatactacttctccctccgtcccaaattagatggcatgtatttttcccctgttgtctcaaaacataaggcacattttcaattgttgcagcttctacccggtaatgccctctcatttacatgcatatgtgaataaatgctgatagagggcgagctgtgcatgcagccggaacgtgggcccgcaccgtgtggccgtttggattgacttatcagcttcgtaacagagcgcttcaatctctatacgagatttgcatgcttagttagttgatttgaatgcccgttcacatggatcctgctaaataggggtaaaaatagataaaactaaactgcatgcaaagtctttggtcttagcaaaataaatttcacaccctctaatttgggacggagggactactagcaaagatggatctgataccaacatgctttacatgatcatgaaagttgaaaggctgcaactttggtactccctctgtcccagattggagggcgagtattttttttccccgttgtctcaaaacataaggcgcattttcaaattttacaccttctacccgataatgccctttcatttacatgcatatgtgattaaatgccgctagagggcgagctggtgcatgtagccggaacgtgggccacaccgtgctgccgtttggattgacttatcaacagagtgcttcaatctatacaagatttgcatgcttggttagttgacttgattgcccgttcgaatggatcctattaaatagaggtaaaaatggataaaaccaaagcatgcaaagtccttggtcttagcaaaataaatttcacgccctctaatttgggacgaagggagtatatcttatagatatagtatatatcaatacaattaataacttctatgcaagcatttaatgtatgagatagtgttatatcttacaggtatgcaatatatgtatatatcaatgcaattaataatttctacacaagaatttaatgtataagatattgttatatcttacagatatacaatataatgtatgagatgcaatatcttacagatatgcaatatatgtatatatcgacgtaattaataacttctacgcaagcatttaatgtataagatattgttatatcttacaaatatgcaatataatgtatgagatgttatatcttacagatatgcaatatatgtatatatcgacgcaattaataacttctacgcaagcatctaatgtataagatactgttatatctaataaatatgcaatataatgtatgagatattattatatgttacatatatgcaatatatgtgtatatatcaatgcaattaatgacctatagatagtagcattcaatttccactatagacct

SEQ ID NO: 46900 - DNA, 401 bp, Oryza sativa
atgtcataaaatccaaacgattagataaatcaatgaaacctttgtcgtaatcggctaaatccaatacgtatgcaatccttgtaagccgatgcaacgtccagataactcatcggctgaaacctcgatgaagcttattggcaatcaagaagcaggctagagattatggttctaagcacgacttagtagatcaaacttaactgatgcaacactaagtatgaaaagaagcataatatctagacaatcaagccgttgactgagttttcagggtggtagatgtctaagctaatctaatctagcaacacgatttagccgataccggcggaaaccctaaaacaagaaatagccgatagaactaaattgatatgctaagactagattaacagagacatatgataaatagg

SEQ ID NO: 46901 - DNA, 1501 bp, Oryza sativa
agaagaggaacatttatataaataagttgaacataaagcgtcaactgtcaacttctggttttagcgagtttaatattaattgctagaattaaaattaattatatgggtatacatttttaaacttgtacacaatttttagttattataatttgcaatagttcaaattggacaagtattatatggccaatgcaacaatacacatctcaaagaacaaacaaagcaaatatcatcaggcattaagtgaaactccatggttgagtaaatcagcaaataatcaggtaattcattgtcagatactacctccgttccaaaatacttgtcactttgagtttttttttaacttttgatcatttctcttattaaaaatatatgaaattattatttattttgtttgtgatttgctttgttatcaataatactctaagtataacttatcaatttttatatttgcactaatttttcaaataaaacgaatagtcaaatgttacaaagaaaaagtcaaagtgacaactaaactaggatggaggtagtacaaaattaagggccattgcctcagcagcaggaggaggaggcagttaggtcattcctaacccaatgactaggatggtgtccatagtattaaataagttgccacatagaataaaaaatgacgtagcaagtgaataaatgaggaaagagaaggaaaccatgtcttgaataagacatggtttatacataacatccaagacatcatgtgagataagtagcattaaatttaagtataaaatagtggcgtttgcattggaagattagtttctagtactagtttcttgatgatatggagtttatggaaactatgcctagcgtcttgggttgagaatgactttagctgtggacattctggttttcctctatccaaggtctcggagaaagtggatttgattacaagttttattgtaggtgcaagtcttttgcgaaggtaagctgcgacttgacgagcatggtgatgcactgagctaatatttgatttattatatccaaaggcatcattccacattgcttgaagtgtatcaacagttgataactccagcccaggggtgtttttaatttcagcgatacgaacaagaaattcaagctggcctatagacaggtaaacatgctacaatttgagcataaaagcattctctagagtctccttgtctatgaacaatagcttaaatataaaaacaaaattaagttgccatcaagtaaccttcttgtagagtttagtgtcggagtacaaaatgttcatcattagaatcccacaaaatgttcaagactaaccagtggtattatccagagtcatttttttgactgggcaaaaacccaaagaaacaccaagcctgtcgaagccatgtgtccagcatagcaggtgcaccaatgaagaagaaattaagaaacacaataagaaattaacaacacaaagctttgttgcaggtgaaagcctttcatgaaggtaactagctgcaatttgacgaaaatg

SEQ ID NO: 46902 - DNA, 863 bp, Oryza sativa
cggcgatactcctggattgtgctcgatgagtccgtggagacgcatgcagtgtgtttggctgcttgcacagtcctgctatgaattaaacaagttaggcctgcatggttgagggggctgctcctaatttcacttgtaatataaatgttgtcctgatcccgtttgtgatgaaattgcaagtgtcaaaattttgccaaaatatttgttctagttcggctccgatttaaattatttcacaaaatctcagttcaaaataattgtaagtttcatatacaaaataggggtaaaagcactactccctccgttccataatataaggcgcaactatttttttcagatgtttcataatataacgcgtgcatgcatgtatgcaattaattagtacctcttctccattaaattattgttttttaaaatccttcaccctaaagatctctaattgtattgggtgcatgcattttatttattaaggtaatacaaattaggaggtgataataattgtttcttggtgtttggattaagggtagttgtgccttatattttggaatgtagggagtagtaagcaagggtatgtatgtattttcatgtccgacttaacaccgttaaactgtccatccaaaccgggggtaaaactttccttcatttcaaaaaagcaggggcaaaaacacaaaccctaaaaaacaagggggtaaaatcacaattgaacttgaaagtagaggtaagaatgcaatagccccttattttattgtgatatgtgaatatatgatgttataagcattttttttctttgttgttgttttcgaattttatgaattttgtgttgtttttggatttttatgataatatgatttagacagaagagatgt

SEQ ID NO: 46903 - DNA, 1501 bp, Oryza sativa
atatagcgttcatgtgagtggccatgtgaagttatagtttggcatcaacttcttcagatgtttaacatgtatcttgtgagcctttcatacatcttcacgataaatcttcaactttgttagttatagaaaatagacaataacagactagctgattattaagcacatgaaggctgttgttaattagcagagttgtaatctgaaatcaactcctagcagtctgaaaaagatgaactgcgtgtcacactactagaaaaagttttttggcagcggccaaaaccgattttttcaggcggaggggaggcccgcctgtagcccaacgattgatgattttcgcagtcggggcaatggcaatggccccgcctgctaaaatgcgttgaaaaagcaaaaaaaaatcgcgggcgctgccgccacgcgccttgttgccgccgccctcccctggccggagccgcgccgggcgtcgtcgtcgtcgccgccgccccacgccgttgtcaccgccaccgcccccggtggcctcctccctccctcctccggccagatctgggagggaggggggaggggagccgccgccaccgcccctgccgacctgcccctccctcctccggccagatctgggagggaggtgggaggggagccgccgcagccgagccgtcgtcgccgccgccgccggtagagggagggaggggagggggcgcccagacgcatgttgaggggaggggaaagtgtttgaggaagagagagagctgagtgagggaaataagtgatggggaggggtggaggagaagataagacttataaatttttggggtaggtaccattttcgcagatgcggtttgagtggtccgcctgcgaaaatgattttcgcaggcgtcgcttaagtggtccgacagcaaacttcatcctgatttatatttttgtaggcggtcatttgactttaagggttatgtctgtctgtggaaatcagacatctacgttgagaaaaatatattttatagtagtgtcaggctgtcagcaacccatgaaatggttaacaaaaggctaagtaatgcgactcgacctaccagaccccaaagtaggttcgtaactcatcagtatactagttagcatctccacgagtatacttgattagcataagataaacaaacctgactgaaatcgagagtcttattaaaaagtactgactgaaatcaacttgtatttttgctcctgctctttataccaacagcgtcacacctcacacgcaaatttacacaaaatttgacaatcgaaggccaattcgaatactcctatctctgaccaaacgcacatcttaaatttggtcacaacagacaactacaactcctttatatatatacaagtccaatgcaaaagatccatgtagttaagctgcgtaagtagagtgctcattccgtctcataatacaagagattgcactgtttaaccactcgttttatttaaaaaattttagaattattatttatttttttacttactttattatcca

SEQ ID NO: 46904 - DNA, 532 bp, Oryza sativa
aacataaacctgcatctcatgcagtaaacattataggataacggactagatatctctttgacgaataagttcttttttctttgggtatttgaaacgtgcatcttaatattttggggcagaaaagtaaacatgtttttttcctcacgtttgagtacaatggttccaatccttatctttttagatcaacttatggtgtagatagtgatttaatgatcttaagattgaaactgctattgtttggagctatcataaacataattgttgtctacctagaatctcatataaacttaactcttcttccccaattctcattggaagcttacttttgattctcctagaagttaggcctgtcgaatctaatagagccatgtgcatatttgcatcttaagaacatggagttttttccactgcaaactccgaacaaaatgttgatggactaccatatctccaatacagaagttgcaatattgggattgatttattgttttgttgatgctctattttgcagctgcttgtatgacatgggatctgg

SEQ ID NO: 46905 - DNA, 452 bp, Oryza sativa
ttctgagataaagaacctccagatgttggatataaactccccatcatgttcagcatttgaggtgatcctgatatcagaaatttaaaaaaaagaagaagaagctgaatgaaaagactcacgggctttcacctcaatagatataagctaatacatgatatacctcttgttaaacagtaaaatattatagatacatgacatcacaaacatataaaatataatgtttctaagtatttactcagcatcatattacttacataaatcatattgtgatgccaaaaaaaataacagttataaaaataagcaatagatattctagcatccgatgcatgcatgccaggaggaggaataccaatatttcctctaactctgacacctatcaaatgatagtactgttggaattttcatttctaatcttaatcctatcaaatgcaaccgactggtgttcttttagg

SEQ ID NO: 46906 - DNA, 1501 bp, Oryza sativa
aggcttgagtattgaagttaaatgctacatctagaaaacctccaattgccccagataccattgcctgaaagtataacatatttaggattaccaaatacttacacaaataggaacctctatatagaatcagtcttacttttagccgtggcatcgtgacggttggaggtgcagctttcgcatgataacctgttgctttgcaaccagctaacagagattgggtgtagggcatggattccaccatttctttgcttggaggttttccaactctccccaatacgaattcagcaggaagcccatctataacctaaattgacacgcataaactcaaaatgccaaacattaaaagggtaagaataaagttgccactgaagcgcctaggattatgctgtgagaagaacaggcacatcaattttgtgcataccatcaacaccaaacgatcatacacaggagggacctcggagagttcctggaattaatcatagcacaagcatgagcatcgcaacactaaaaaaacactgcacagtatgaattaacttaacatttcaaatcttccatctctctatcacaagtaatgcgcagcagcatgagatgaacctaagccggaggaaccgagatgtctcaccctgtacagagatctgagctgatccggcggaagcgccggttgctccccgccaccggcgagaccacacgacggcatccggtagctctccgctccactgcggccaccaaccaagggtcaatcgaagcaagcgccatcgacagccgctgatagagcagagcagaggtagaggcgcgaacctgaacccgggcagcgtgggcttgacggggaagaagccgtagaggaacatggagaggccaaccacctgcagaagcactgcggtcacggtccaaccggcgaccgccgcgcaggaaggggaggcgccaccgccgccggccatggctgattcctcgccggtggccacgagacagttcgaacgggctgaagtgacgaacacttctgggcctaatggcttcaaaatgggccgtgggaagtacactagcgttggcccaaaatcaaaatgggcgttaaattgtatcgattcaattttgcttcgacaaaaatttgtcaaatgtgcaattccatcctaacttacatgtaactacaatgtattaccttcatatattttaaaaccattaggttaactttaaaatttatgtaagttgggaagaaaagaatcatagcacgcacacaggtgagaagattcagtctcacgatctttgtttcacgaaaatagcatattgtaaagaaattattaaaattacatatatattatattgtagttacatgtaaattataataatgtaatcacattataattatatatattatatttatatttgataaattttgagaagaatttttatatagtagcccccattggtttgggcccaaacaagcccacaaaaatattttgtcaccttcgtgcgcgttcgccgtttgggataaagcgtctcctccccc

SEQ ID NO: 46907 - DNA, 1501 bp, Oryza sativa
ttttagaagtaaaaaatataaccaatgataatcatttcgatttttaaaatcccactaacattaaagagcggaggaaacgggtgggcattaaaggagtatatttgagacatttgataggacttctaaaaattataaaaacgaaacccgatgagataatgaactctataaactaaaaggtccaatttttaaatgttataaggagaaggaatataaatcgtggtaggttagggaaacaaataaataaaggagtaagggtagtcactgtgacttttaaaaaactataaaattagagactctaggatgacaagatctcataaagtcataagacaacacgatggctattttacatttttgaagtaaaatcatgtgaataaatagataatttagtggttgctagctgcgcaattgtgcggcccacctagctagaaagtaaaaaatgaattccaacaatagttatgttcgatttttataatcctaatgacaataagagtaggcggcagacgggtcatagaggagaatagtggcagcgtttgacaggatttataaaaattataaaaaaacctaatgagacaatgaactctaaaaactataaagtccaatttttaaaggttcgggcttataaaaagtaaaaaaataaactccaatgatgatcatgtttgattttaaaatctcaatggcaataaagaaggcagcagcgggcgagtcgtagagaagtatagtgacaaagttgctgacgttttggcggaacttctagaaagtaaaaaaaatgaacctaaatgataattatattcaatttttaaaatatcaatgactataaagagaatattcaacggatggctatagaggagtataatgatagcgtttgtcgggacttctagaaattataaaaacaaaaccgaacaggacaataaactctaaaaactataagatccaatttttaaaggtttcaaggagaatgaatagaaaatggtagattaaacaagtaaataaagaaggatatgacagaagtaacgggcagcaactggtgtgacttttaaaaactattaaattagaaatacgaggatggtaaggtttggtctttcaaagtcttaagacaacgagataactatttaataaattttaagtaaaacatatataaaatatataattttatatgggtactagccgtgcaattgcgcgggccaccccagctagttatagattaattaggcttaaaaattgtctcgcgaatttgctctcatttatacgattagtttattattaatctatatttaatatttcgaattagtgtcaaacatccgatataacataaaatttaatccttgatccaaataccacctgagaaggctttatagtctccgatgtgcagtccaatccagcgtgtaccccgcagggtcgcagagaacacaggctgccggtagatctagtaactctatgttggccaaaagatcagcagcacgggcacgcagctagccaaccatggctgtcggcgagggggagc

SEQ ID NO: 46908 - DNA, 258 bp, Oryza sativa
gtcgccgttccgcctcgcgccgcgcgtgcgtcccatcgccatctcgcgccccgcgccgcgccactgccgcctgccgcgcctcgcgccccgcgccgcgccgctgccgcgccgcgcgccgtcgccatcgccgtcgcatcgccgcgtcgctgccctcttccctcttcttctcccccttctcccctcttccctcctccctcctctcccctataaaatcccacctcatcccccatttttccccactccatcccccttcctagc

SEQ ID NO: 46909 - DNA, 1501 bp, Oryza sativa
ggcggcgtcgccagctacgccttcatggtgttccccaacaaccgccatggcatcggctaccagcccacccgcgccaccgaggacttcgagcacaagcactagatcgtcgtcgacgacgacgactaaattattaattaatttgggtgttttaattaattgatttcgaattcatcaaatcttaatttaaacattttatgtgtgtgcgtgcgtgcgtgcgtgcgtgtgttttgcaatgtcagggtttggtcctttggatttggagactcgagtcaaagtgtgaagtggctctgtgtacatgtgtgttcgattgtttttcatgtaatttgatactaggagctaccgctgaacataataaagtctacaattgtactgtttttttttaaaaaaaaattcactgtgcttcaacagaaaatttcgtatttgcttgtaaattgtggcaactcgatcgtgaggtttgcttctactcaacagcctgaaattctaatagctctcatctgtcgccgtcgattcgtgaccactgccgacccatctcgacctaattacgtactctatttagcacacatgactcttgtctttgtgttcatctttctcgctctacttatatatacatatacatatacataaacatatacatattttgttctgcttttgtagttttgtgcatgatattatttcgttcgtgttcgttgctgccacgccacaaccattccgatgtattgccgatacataataacaatcttttcaaaacctgagacatctcaaaaccttaatggcttgtttggcaacttgagggaaggggattgggagtttatacgagggaattgacggtgagattaagatgggaatttgatttttcatcccagtctcttgtttggtagaggtggtggaaattgataggaagtttagttggagattaagtcattaatgaaaacggatggctgagatttgtttagacgaagtaaaggaggaattccctcccaattaccaccccctacccaggtattgaaaaggagggagttcattctcaattccctatccccatcccaccaaaattcacatatctcccaaccaaacaaaacagttaatagcctcatccctctaaactcccaatcccttctaaaaacttcccccaaccaaacgggctgtaaatccttttcacacattcggaatatgacaacccagtttccaattcgaagtttttaaaaaatcttctcaaacaaactcaaacatattgggttgttacgttgggccccggcccacagaaaaagcccagtaggcggggcccagctccagcccacaatacctcgccactaaaccctctttcccctctaaaaccctccttctttctcctcccccttccgccgcgccattcgcctcccgcgaaaaccctagccgccgccgccgccgccgctggccaaaatgtccacgccaccggcgggcggcggcggcttcccggccaccgaccaaggcaagaccaagtcgaagaagaagagcaagaagc

SEQ ID NO: 46910 - DNA, 802 bp, Oryza sativa
agagaaacagattcaactggctgctggtcatacaatcccatcggctgaagaattgagcaagagaaggtattgcaagtggcataattctgggtctcattctaccaatgattgcaaggtcttcaggcagtaggtccaggcagctattgaaggaggcaaaatcaaatttgatgattctaagaggccgatgaaggttgatggtaatccttttcttgtcaatatggtgcatacagctggtcgaacagccgatggaggtcgtgcaagaggttttcaggtgaattcggctaaaattatcaaaaagtatcagaagaagtatgacaaacagcaggaaatgcattatgaagaagacgatggcggttttgatcctcattggggctgtgagttctttagattttgctggaatgaaggtatgaggctaccatctattgaagactgtcctgggtgcagtaatgttgcagaaggttcaagccgatcgtataatagaggcaatcagctaaggcaagcaagagttcctgttcatcaaaggttgggcccggtgaaccaagattgtaaccaagagaacaatgaaggcaggaagactcaatgatgtcatagtatttttacaaagaatcagaagagaagggtcaaaggttgaaaaacagggagcactttcaggaggttgagtaaaaaatcaatcatcggttaaagaagaccaagccgaagcgggagtggcgtgttaagaatcaagctcctgcagccgatgaagcaaatagattggctaaaggaaaaggggttgtgattgcatcggttaacatgggttcacctt

SEQ ID NO: 46911 - DNA, 929 bp, Oryza sativa
gccctgttcactcttctcctcttgtatgttttgagcatttcttggtctgctggattgatgtttctgcttatgctcagcatggtgttcttacgtgtcgtgaatgtcttctttcttgggctgatgttgctgtcgtccagcatcatactctttgcggtattcaagtccatggcgtaataagcactagcaacagcaaatatacctcgttaacagaaatatgggtggaataccgtatactcagggcagggggtgctgtctatgctagcaatgactggattagatgccttgtagcatgcatggagtcttataactagttataaacacacccagcataagaacatccggttatgtataccgaaacggattctactccgtgttcggcccggatcaggcgacgagcgattaaacgtgacgggttatgaggcatgaataaaataggccaagattttttttagagggcaaaagctttgcctcgtatattaatagagatggagaaaaaaaaacaactagtagtagtatattaatagagatagagaaaaaaaaaacagatcacaggggaagcctcaaaagctaaacccatgggaacccgtcaaagaggttaagtaatatctcctaaataagaggttaagtgatatcttccaaaataggccaagtaaagcgaaagaaagtttgtcaccttgggagcactcgaagttaccccggtgcgacgtggcggcggccctgcgccgaagttaaggaagaagaaggacggcggcaggggagttaggggtgagtagagttggcggtgggtaagcctgccaggcttggttaaacaagggccaccgggaatggatgggtgaaggaaccggggataatcttgtaacacccgaacttgggggagcgagaggcggatctgggagaagaggggatttctgaacgaatatactactaga

SEQ ID NO: 46912 - DNA, 352 bp, Oryza sativa
gacctgcaggcatgcaagcttgggatcactagtccctaccaaagcttcaacggtgatgtgcgttatagccaaatctatcatgaatgaagggcttcacccatgagcccaagatttaggataccaaggctgccatagttgactatggcacaaacttttgacctggcaacatggcaatgcccaccctgtgcatttgcccatccagcctagaggaatccatggtagattttgccaattcctttaaggaaccattttggtgcatccacttgaaaccaataaatagattgaaattgagcttaggactcccttcaccttcatgataccgattggcaccattttctccgcttactatagg

SEQ ID NO: 46913 - DNA, 814 bp, Oryza sativa
ataggatgtttgtctttctgactgtcaacgaactaacaaagtaacaatgacactttcctctgcacttgatactgccatttctcgaccatgtgaatggcgtgtgcaaattaccatctgagcacaacacgtgtataataagtgtcagcaaatgggcaaattaccatgtcagcaagtttacttttagagtaattaaaacatttatacttctattctttatggcccaaaagcgaagcctaaaaatagaaaacaataaaataaaaaaaacccaaaattaagtttcaagtttaaattatagtcgtggcttataagccctacccaattccctattttttgtcagaaaccaaaagagatgtgaaaaaacccaattaacatgaaaacaagagatatcttattttattttatgcataggatctaaggctgagttattatctcagtttttctaactcacatatctcgttttccgcacgcacgcttttcaaattgtcaaaaggtgtgtttttttgtaaaaaaattctatacaaaagttgatttaaaaaatcatattaatctatttttttaaaaaaaaatagttaatacttaattaatcgaatacttaaaaaaaatccgttttacgtgccggggaacacaccctaaatctatactacttttgaaatagtagtggtggcagtaccaccccacggtccactatcaactccctacttttgttaaagggttaattggatccatgccactgcaaatgtggcaaatcaaaaaaatgccacacatattcgcgttatcggctggatgccactgcaaatttttaaaataagaacca

SEQ ID NO: 46914 - DNA, 1501 bp, Oryza sativa
gatacaattagccactgcattcaaacctatgaagaggtgaatctcctatgtatatacagttctaatctcaaaaaacacagaaagactaaaagaacaaaaatgaggatgggaatgccacccatgttctgctgttagccttagccacctatatcatcatatgtcataatcaacttccgtgctgtttaccattgctgcacgcttaacaagctgcccttgctcattgtagagatccaaattctcgcatggttttggaaacactgacccgatgacacgcccctcaatgaaggaacactggaaaatatgtttcttcttgtagctgatgccgatagacatgtcctgaaagctgatgtccttgatgggaatgtcactgctgccatgagcacggactggcacccggacacctcgcccatgtatttccttgaatgatatgtttgtgatgtctggaaaggcatcccggtcatacccatcatcagcgtgctcattgtagtcaacctttatcacaataccagcacggacattgtcgaaggttatgttgcgataggagatatcgcggatgtagccccctcttcctatggcagtctttattctcaaacctcgccgtgactcccaaatgcggacatcctccactgtaacatttgcaatcccaccagacatctcactgccaattgaaattccagcactgcacacaccaagacaactgttgtaaaccttacctgtaatactctatattcaattcaaaagaacttaaaagttaatcctaatttaatagtttctttctcataccattttatcttgagcaggatttgaaaaagatatgcaaagaaatattttagatgaagcaatgcagccaaaaatgactcaactgttacctgaccaatgaacgagccattacattgcgtatcacaatgttacgagatgggcgcccatatgcaatcccatattgatcccacccactctttaccgctatggcatcatcaccaactgaaatgtagcaattctcaataagcacatcctgacaagaatctgcatacagctatatgtcagcatcaccaaataaaaaaaatgactgtcattgataacagaaacaaacctagatggtataacaagaagctgaaattatgcaggatgattggaaattactgaagaaaggttcgtatgattacctggatctatgccatctgtgtttggagcactagaaataggagctaagatagtaacattagaaacagttatattcgtgcaatcatatgggtggaagtgccagaaaggtgaattcttcaatgttatatttgcaacaataatgtccttggaccacatcagctgcaaaagaggaggtcttgtattattcagtatccttctgcgatgcttcatccaccaaacttcaccctgtccatttatgctaccgttgtgtcctattcaacagagaaaaaatagggagcatgtgaaagttaaataactatcatccagtgaagaagtgatacagaaacaccaaatgctctat

SEQ ID NO: 46915 - DNA, 296 bp, Oryza sativa
gtatttcttcccaaatctgtgatgcttgtggatgatttgggatatttagggagcaaatcgattgagcaatgaaacaacaacaaaaaaaaaaaaagaatcaaccaggactgctccaccatttttagtcccggttggtaataccaaccgggaataaagatggatttttagtcccggttatttcacccgggactaaagatgggtatttttagtcccggattcgtactcccggttgtataaccgggactataggggggtttctaaccgggagtaaagcccctttctctaccagtgcgagg

SEQ ID NO: 46916 - DNA, 816 bp, Oryza sativa
aaagatggtattagctagttaatcttatagctaggatgtatatattatatgtatactagaagtgtagggatatattcttttctattttcttttcacctagcttagataatttaatatgagaatgagtagccttatgcttgtgtgtcactctaccctttgcttatattatcccctatttagactatggttattacaggtaatatataaattattagtacagttctctctactataatctttccatgggattaaacaaatacgatacacttggaatactctcgggtgaaatgttacaatggtatatccgtgcgcgcttgcggataaaatatgtaactaatctatggtccaaattatctttctcctttttcctctaattaagtcatatcacatcaattgtttttagcctttagatgattaatctacattccaaactatctccctacttttcttcttccataaagtcataccaccttacattttacgtttgaatcaacattctatatactatttaaatttaaattatcataaaccacattaatttacttaatctgatgttatctagctatcttacacgttattttttattgttatcatactaaattcccgcagcaatgcgcggggtttcacctaggtaatcaagaaagaagttaaacatatctctagtctccctcttctctgttcggcctcacctaggctccggtgcttcgaggctacagtagcctcgccctcctgtcgagcacccaatccatctacgcgcataacatatggtatcagacgaccatgatcctgtcatccgccccaccacgccattcacca

SEQ ID NO: 46917 - DNA, 344 bp, Oryza sativa
aaaaaaatctaaaaatgaaaaaaattcaatcaggttgcaagcccacgcagagaagtcctcccctgcgacgacagcgaccacactgggatgggatgcgaaggagacgttgccacgttggacgtgtgcaaaggaaagcagcagatagagaaccgttggatggcagtggacggtggatattacgtattgaaactgcacggccgtgactttagtcaaaagatcctcttccgaccacccgtccacccctcacctccttcccccatctcttctctagttctcttctctttctagggtttcgtctcccccaatggcggcggccaccacgtcgcggcgcggcccgggcgcca

SEQ ID NO: 46918 - DNA, 430 bp, Oryza sativa
ttttagctcctcttcagtttttgagaaacttgtatcttgcaacctaccaggcaaaattaatcatcgtgaagcgaaaaggtatttatgaattatataacactattgccttcaaatcaaacaagataaataccatgcttcatttgcatttccatatagtggatgctgtaatgttacttaaccaaacagctcaaccatgttcgaaactaattgttttctctactttgttgttcaaaagaaaatctataatatagtctacttgtcattatagtatcaaaagttaagaaatcgatccatcacaatactttgtaatttcatatactctcaacatgattgcaagctctgcatcttatgctcagcaatcataaggcaattattacatttaagaagattattagcatggcattaaccacatttgaaaaagattcacatg

SEQ ID NO: 46919 - DNA, 1445 bp, Oryza sativa
cttaattagcgtaggccttgaacgccttcatctcatcggtgaccttcacagcctcaaccgagcgcttctcaccgcgagcaataggcatgtaattaatcaccctggacctgggtggcagtggcaagctcctcggcagtggaatcaccagcctgacacaagagctagcacaatcaagctcaaaaccagatctagaagacaataccttcgataaacatatacaaggagtcagggacaacaaactgcagccataccttgcccttgtttagtccccagaaatttttacatcatattgaatctctggacaatggagtattaaatatagataaaaataaaaactaattgtacatttagggagaaatcgtgagacgaatattttaagtctaattagtccatgattagccataaatgctacagtaacctacatgcgctaatgacgaattagtttaggctcaaaagattcatctcacggttttcatgcaagttattaaattatttttttcattcgtatccgaaaacccattccgatatccgttaaacattgacactcaaaaattttcttttcgtgaactaaacaaggcctatgtcttaaacctctagacattagcctggagccctcaagtgagcggttcttgcggcggtggtccacggaaattccaatggtcggagtatacttcttcgggatgttcgcagcctatgattataggagaacaccatcaacacaaatataaatttacatatgcaaatgtattttttttctacagataagagcaagtttaatagtatagtcaactactagctccaaattatctatagccaatataatagccaattcatacaatagttgcttactatactattaatacatagtcctacttgtcatacacacattaagtcttagagtccgtgctgcagctggctatagatccgtagtccgctgctcttctctctcttcctttatctctttaaaatatgtttataactcgcttatagcatgctattgtacctgctctaatcatggccggaacacactcaaagcattagacaatgaaactagaatcttaatccaaatttaaatggcattcaacacttagagaaggggaagggggtttctaatctactgacaagacaaagttacttatctattatctacaagcaaacagttcagatttaaccaaacagaggccctgatcagatcacacatcaaaatttttcaccctatcatatcgagcgtttaaacaccttcatgaagtattaaatataggctataaaaataactaattgcacatattgtgactaatttgcgagacgttttaagccaattgctccatgatttgacaatgtgttgctacagtaaatatttgctaataacggattaattaggcttaataaattcgtctcgtagagtcgcagtttactgccggattctgtaattagttttttttaca

SEQ ID NO: 46920 - DNA, 488 bp, Oryza sativa
cacatgagatgaatgttctttctcggaaagttgattataagttgagtgctttggtttcttcttcttcttcttctttggatattgatgcttcttcatctaagccttcttttcttgctgtttttaatgccacatccgatgatcaactcgaacaaattgaggaggaggatttggctttggttgctatagaattgctcgagctatgaataatgccaggaacaggaaaagaggtggtccaaatcgttgctttgaatgtggttcaattgatcatcttcgttcgcattgtcctaagcttgggagaggcaaaagagaagacaaagatgatgagaagaacaacaacaacaagccgaagggttcataccaagagaggaagctggagaatctcaggaaggcttttcaacaagtttgcgccgccttcgagccactaagtgatgtagatggtgaaagtggagatgatgataagggaatgaatatctccgatgtttgcttca

SEQ ID NO: 46921 - DNA, 1501 bp, Oryza sativa
  unsure (1)..(1501): unsure at all n locations
aatcacactatggatatgacccttggagtcaaaatgcccttgtttcttgagaggaataagtctatttcgcatccctcatcttttatccttgatcgaatcgcctcctccaaccgcaaaatcgggtataacacatcccccatctttgaaaaccggtgcaaatcaactcattcggtggtgtcgaagtagttttcataggtggggctcacatgacaatgaggtatggcaaaaatatatggccccacctacaaaaaccaatttcgaaaccattaaaggagtcgatttgcactagtttttaaatatgaaggaggtgttatacctggttttgcggtttggggggatgggattgatcaagggtacgagatgagggagttaaaatagacttatttctttttgagaaacatcaacaggagaggaagaattatacttgggccggaaaaagtacatctaaggtccctcatcttgtcatcggattacaaaattatcccccaatcgcaaaaccagatatatgggatccctcaacttataaaaccgggtcactttgggtccctagacggttttgacccggttttatccgacgtggcagctgagtcagcatgggtcccgtatgtcagtgtgtccactttatcactccctctttttcccatctctcttcatcctctcttctctcccttaggtcccgttcttttctccaacaaagagttggatgaagattaagattttcgtggcacgcttttcaaactgctaaattgtgcgtttcgtgtgaaaactttctatatgaaatttgctctaaaatatcatattaatctatttttcaagtttgtaataattaaaactcaatcaatcatacgttaatgccacctcttttgcgtaaaaaacttaatcttcatctattcatcttcgggagaaaagaacaccacctactcggttactctctctctctctctcaatattctttgggcaggccgacccgcgggtgcgaggtggaagagaggaagggcggccgatgctggggcggcgacggccaatgcgggagaaggggagacggtgtctcgtcctaccgccacaacgacgccgtccattccttcctccttgctaaggcctctggctctgatttcgtcttctcccttctccgccgcatcctctcgttctccccacccgccgactccctcttccgccaacgccgtccactcctaccctcctccgccacatcctcataacctcgccagcggatggttgaagatgaagtggctggggtcggatgccccgcggtcatcccgcgcggcggtacctggtaccgcccgagctcctccagcatcgcctccaccgtgaccaacgcacgcgccgcggcaactccgcgagacacatggaggaggtgatgctcgcccacaccaatgcctcctgcgagtttagcatcatcctcgacgcccgtctccctcccctcccccactaccgnncgaaccccacccggacgacgcgcgaccattagaattttcgtggacca

SEQ ID NO: 46922 - DNA, 175 bp, Oryza sativa
gtcaccgacagtagcccccggcgttatgtcagtgtgatcgcccccctcgagggaagcgctcgggcgtgacgccactccttaggcctggtggcaggtggggccgatttctacaggcggacaggaacccagcggtcgcaaatcgcgcgcatcggcaagggaaaccgaccgacaataa

SEQ ID NO: 46923 - DNA, 1501 bp, Oryza sativa
atagtcaattaatcatgcgctgatgactcacctcgttttgcgtattttcctctcttctcaaactcacccctaggccgtgtttagttcacccccaactacctctaactttcaactttccatcacatcacatcatcacatccaaaacttttatacacacgtaaactttcaacttttcccaaacttataactttttcaggaactaaacacagccctattactagagggcgcgtgtcagccagatcagcactgcgaccggaaaccaatcctgacgcgccaccccggcgagcaggtagaggtacacagggcgctcccgcgagtccgccaccgcaaccacctcgcctcgcccagacgctgacgacttcactccactccacgccctccttcccccgatactgctctcttccattccttccaaggaatcctccccaccatcttcatctccactccctctcctctctactcctctacgcggtcgagcaatcaacccgccgccgccgccggaggggccgctctccgtcgagggctcgccatcttatatatgggccggccgcctccggctgcgctccagctgatcggccgccggaaaggtgcggcggggtttcgtttcgctcccatttggatcatgccacgcgggctcaggggctcctcctcgtgttcctcctagatctggcttggaatccatggcggtgccccgttcggctgggctgggtgcggtgggtgggtggttgtgcgtcgttcccgtgcggaaggcctcctttctgtttccgctttagagctgtgggcatgaataactgtgcactctttgcctttgtgcacacctaccttgacaaaattcctttatgttttccatccacttgcgaatttgcgaagaattatatgcttctgttaaaaacaatactactagactgaattggagtacattcttgggcgaagttttctaggggtggtgtgagagtggatgctttggttgtttcacttgctaccgtggtggtaacgctaactaaattcgtggcttttgggagagacgttgtttggtttatgagctgtgagaatggggaagcaggctgcttgctacatttatggttgcaactttttttagtagtagcatttttagaatgggaaaatctctgaccgtttaaggttagttatattagcgaaagtggattgcttgtagctttgtaatttctggacattgtctacctgtattcttgttatctagttgtgatgacctatttttgtcttctttcctttttattcttcccatgctgccaaatagtctatatcactgtgtagtgcatattcttggttcgctgttggaatgttttttcttcagttaaattttagtattcctagaataggaaatggctgttgccaattgccactatgttccagcatttacttactgctggaactgttttccatggcttggataaattatcatctggatatattaccttgtactggtgacattgcacagaatctgcaagaagatgagttcaca

SEQ ID NO: 46924 - DNA, 166 bp, Oryza sativa
ttgaatctataatgctacatgttttgagggactatttttgttttcatttactttaactcgggggtatatttgatgcaacccttgaagtttctttttgcatgtatcttttttttttgggaaaattagaattttcagtttttgaccatgtctaaattttatgtacagc

SEQ ID NO: 46925 - DNA, 1501 bp, Oryza sativa
caaaatcatttgaaataaataattcgagcacacaattgtcgaaacaaggtttcggcaatactaaaagggggtggctatcaagctaggaaagtggatgggtttggagacaaagaattttatacaggttcaggccttcttattcaagaagtaataccctactcctatccggggatgattccgccgagtgtattattgattgtatgatctaggaaaaaaccgcgccccgagaggcatccggacccctccttatgtaggggaaggggtccgctttacaaaatacagtccatatcccaaaggaacatggaattacagataaaatacaatcgtaaccgactaggatcccgggtatttccttgacatacaagtttagaatctaacccgagccctcatgaagatattctatctttattcggtaccctgtacccagctggaatataaccgccatgtagatatggggtatccataatctctacagtagccctcgagaccttcgcagtcgacgaaatagccatctcagaacaaaaaacaataatccgagtgcttcaactcttcctgctttagcctgccgagtactggaaccaaagactgtgaagggcgaaaataaagcatggtgcatcgagtagatgcacctaattaggtgtagccccccgactatgtggttagttaaaaaaactaaacataaagtcaagaactgagtggttttacaaccaaacattatacagcaaaacactcgtagaagtcagtaaaatacccagccgactacttcttagctttaatatatcgagaaaaaaaatgagaagacccgtgtgataaacgctcaaaaggccctcaaatagacttatttgacaggaatccgagtaaaaactccaaagacactccaccaaatatgataaaaagtcatggtaatcaatgagtctaatagcctaagctatgaccctcaccacaaccaaaataagcatataaaatgctaagagaatgactattagcaaactagtcatctcaaatctacccaaacagcttttgcagcctaataaagcttacaaaaatagcataacacctttctgccgggcacctttttatttgcatcataataattccaaagaattattgaaccgcgttaaaaaggattttaatagcatcgggccacatcattgtgagcacaaattgccaaagcaaaacgtgcctaaatccctagggatcacaacgggccacgctgattgtaatattgggttgaagtactgtataggcccaggcccattagtactcccgataccctaaaaacaccgaagtccaagcgtcacttcgtcttccccgccgagactttcaccatttccccactccttgctacagtacagaactgcgccgatgaagctagggttcatcaatccgcttcaatccattcccaaaatcccacgaaacttctccacgcatccaccgctccgattccccattcccctcgagctatatctcagttcaaatcaaaccatttagctcgcatcca

SEQ ID NO: 46926 - DNA, 1501 bp, Oryza sativa
acagaaagaaaagtatactattcccctccgtatatatgaggaggagaagatgatgggtcactgctagtgctgctagcctgagtagtttcgtgtgtctgaggatctcctgatctcctccctccctctctctctctccatccccatccatcctccttttcctcctattcccctgtggaatctcatcttcttcttcattccacttctcttctctctcgtggtcgcatgatctcatcaggagcgcagatgctacggcgtccttgaggtgagtcaagctcgcccttcctcgctttctctctctagtccgggaattatgttgggagaagtagtgaaatatgttcttgctgctgctgtgttcttgcgagcgacgagttgttcttttcgtttcttgtgcggattattaggatcttggcgggccaaaattcgcctccaagttcttgtatcttgtgctctggccgtgcctaaggttgacctgttgagacagttttcacatggatttcttgtgtcccccccccccccggtgcgattctcgcctgaatttctttctcggttcggtcgcctcccctccccttttgttctactgattcgagcgaattttggtcgaaaaccaatctcattcgcatcggagtaacggattttgtttttttgggttcttgttcttgatttcgttctattttttgctgggaatctttcgtctccggttgctcgcgaagaattcaatggatctcagctattccccgaactcatcatcccttcccgcacgaccactgtttctttcttcttgagttctttgattctttcccctccaaatttgacgcgctttgtgtttcttggaatttagacttacatgatttcttgtgtatatatatatatatatatatatatatatatatatatatatatatatatatatatatatatatatatatatatatatatattatccccaaccattgcgttaatttcgagattacatatggggaaaaaagttccaaggttttaatcatgtttttattgggtccaagcaaataaagattcgtcaagtacatctgatcttgttgaacagtgcttttgtcgtcccatatgccccccaaacagtgaatcttacatttcctcgctacagctgctccaatttgcaaagatttcgcgataaaaactgaaaaatcttgcttttcattcatggaaagaactgcaaaatcttcagtgctgtaccgaacagataaagaaaaaacaattaattatttcttttgcgtcaagaactcatcaggcatctgttctgtcgtctcaccattttcagcggtgaatcgaatagataaagaatgtactagtattttcttttgtctcaagaactcgtcaattcatcgcccatcgagcttctgttcttgtcgtctcactcttcaccatttccttccatttggggtgcagaattgcagagaggcaaaagaagaacaagcagagagcaagaacaagcagaagcagaagcaaagaggcgatggacggcgac

SEQ ID NO: 46927 - DNA, 1501 bp, Oryza sativa
atcctcatagtgacgacctcctctagttatgtgcaagttacatctttgccagagaaaagattggatgtggctcgacataaacattagttgtggcggctccaaggcatggtccatgtaggccttctaccactctagattttgacatatttgtatgttcatattatatttttgcaaaaataattactactctcctcaacccaaaatataaacatttttaaaatattgctaagtcaaatatttttaaatttaattattaatagcgaaaaaattaaaaagattgatcacatgagaatggtgttactagatttatcactaaacaaactatcactggtagagaaaccatttttactctcagttgggaaccccctttagtcccgggttttcaactgggagtagcaatcctggttgaaataaccgggactaaagatggatctttagtcccggttggtaacaccaactgggactaaagatagggtatctttagtccaacaccaaccgggactaaagaggatagccaggttttttttccttttttattttctcccgaatctgggtggtatgcatatacttttttattttctcccgaatatgggtggtatgcatatcccaaatcgaagtaagatcccaagtccacatcacaaatcttaaagttctaaaaaattacatcacaaatcaaatacatcacaaatcctaaaaaaaattacacacaaatcaaattacatcagaagtgtcagggttatggataccacatacctaatagtagttgactaaatctcggtaggacccaccacatatgatgtcctatacggaaacaacctgcggatataggaggagttccggataaggaaagacaaccaaagttctacatggaaacgacaaggactactcggattgtatccatattggtttccctagttttacttggacaaggggacacctatgggtataaatacaagacccaccatagaagagacaatgcacacacccaccacaatctacggagcaacagaagccacaacatacatgccaacatacgccaagacaagacaccggatatcgacttcagggataagcacggctagtcccctacgatgtctccggatactgtcaagagagatgaaagcgctgtctctgatctcgtcgggcacgaactcgaggaggaagactaccctgttgtcgactacgagtcagaccttcagaccgccatatcgacaacagttagataggctaccccaaatattgtactggtgtgattatggtgaataagagcaatatcggcttcggccaataggatgtagggttattacctgacaattcaggggtccgaacctgtataaaaatccctgtctccatctcttttatctcagtctcacatataccctagtaccaacgatccccatactatgcaaatactggaatcgcgacatcaaacgtcgacagtggcgcgccaggtaggggatcttttggtgcttcaaggtttcgacaagatgggtttaaggga

SEQ ID NO: 46928 - DNA, 1000 bp, Oryza sativa
tgatgaaaattactcaaagcattccatatctcatgagcagttcgaagatgagcaacacgatcataatccgaacgagaaatcccactcaaaagaatattgcgagctttgcaattttgttcaaactcagtttttaaagcagcagtattaatctcttcaggaatcacataaggataagaaacttttctccaaatatcataatcttcagccataatataagattgcatcttactataccaatgagaaaaatccgttccgtcgaaaacattaggcttagttgaaaacctagtaggagtagccatggcaaaaaaaaactctagatcgataaaaatccaaagaagaaaacaaggctctgataccacctgtaggatcgaaacacaagaactaagccaaccagagggggggtgaatggttggtatacccgaaaaccgaaaactttttgcggaaataaaagttaccctcaatttcgatgagatcggtctaatcggagtagattagccggtctgaccgaagcgtagccgccggtctgaccggtgtggatctaccggtctaaccgccaaaattcgtcgctgcctcatgtcgccgaagccggtctgaccgctgtgtgcccgccggtcggaccaccgcgatgccgccggttagaccaccgaaacctggtgaaacacaaaacgaagaactcttaaactagatgacaactttattgattctctctgtgtttacaaagtgcaccaatagcactccttacaaaaatttcgactaaactcgaaaccctaactcaaaactcaactcaattgctgtcacaccccaatctggtaccgccgtacaacggcacctgactggagcatgtcgtaggaaaaacagcgcgaaccgcttcatacgaaaccgcaatctcagtaccagtcccaggacatagcgctggtacccacagtgacaaatttgaatcattgcaaatccttaacataaatagaggacttatttaccttaacttagcttgcagctcaga

SEQ ID NO: 46929 - DNA, 1501 bp, Oryza sativa
tcgatgagatgacgtgacatgccacggtgacgcttacatgtcagtggtatccacatgtcattcgcataaaaaaataaaatttaaaaagagaggagagagagagaggagaaaaaggatgttttcaattttgaaaaaataaatgaaaaaagagaggagaaaagcaatattcttaattttttctatatatgactgacatatggattctattaacacataagcgccaccatagcatgccacatcagcacacggagtgagttggagcccatttggatctatatgacacccaagacaagttgaggggctcaaaatgcatttgagagttcagggacctaggtgacttgacacacctacacaagtttagggaccgcctgtgcactttactctttaaattttattgtcacaaaatgaatttccatctaactaatatagcataaaaagagaagagataggaaatagaaggggaggtcatataggggaacgcgagtaggtacatacacatgatggtacgggaggtaggcatagcacagcaaaccgggctagaggttgacccgctctggttgttagttcaccggttgaaccaccggatcactggtcgaactgccggtttttttatttattaatattatatttgatttgcattatttgaaatatagaatcatcataaattggtgaaaatatgcataaataaactagtatatctattattatatggccacaacatcaaaaaaaaatgtagtgtggtaacataataaattcataatgctatactggtaggacaaattaaaaccggttcgattcttcaaaaaccactcccaattcaccggttcccataaaaccgcccggttcacaggttttttaccggttcgattgcagggacggtctttttgttgaactgagccatcaaggtcgccggttccggtttttcttgattcaaccgccagctcagtccccccccccttttttactatgcaggtagggcatagtgtctatttttctttaatataaatctaatctaatggtttataatattggacctaccgatttaattgaaaaatcaaatgatgtgttttgtttttcttatcatcttctctaattaattaaaacgccacgtatcagcttgagagtgtttttgaacgctacatgtcaacttaagagcgcttttataaagtttaatggacttttagtatgtaatatgaatatgatatgatacctaaaataactttataatatgatacagaaagagtaacaaacatggcatcaaattcactgtgatgcatcgtagcaacaatggagtgagttttttccccttgtctacggacaacaaacatgtgacttgagtttcctttcggcctaataccagcccaacattgtgcttacacgggccgtaacccactaaattcacctccgagcccattccactcgaaaaagaccttcgggaagcctctttgcctcccgctcctcgccgcccccgccccgccgcctcccccccacttcaagtctc

SEQ ID NO: 46930 - DNA, 433 bp, Oryza sativa
tgtcttcgttggagattttcatgtttcgtgcatgattctcgttggaggcacggatctatgctgcagatttttttcatgccgaatcggcatgacgggagtaacacgatgaggcggcgtacacaatgggttcgtcttatgtcgttagttcttacgtctgacgacagcattcacagatttcctgtatgctatttcttcagaaattttacgatcctaaaagaaagtacatgtagagcggtcttacttatatctgtaaacttagagaatgcatgtttagatccacgatctcgttttaatgtaccatctcaggttcaatccgcgcttgaccaggtctgactgcagtacatttgcattctcccccctcctaaatccctctgtcgcaaacctaaatccccaaaaatccccaaacctaaatgccctctgtccacttcccagg

SEQ ID NO: 46931 - DNA, 1501 bp, Oryza sativa
gcttttttttgtgtgttttctcaatagtttttctttatttcatatgaaaacataagggtgtaaaggatatttaaatattgaatttgcatgcatagatgatgtggcatgtacacatggcatgtttagagggtctaaggaccatattgaatcacacaatgaacttaaggtacttatttggacaacacgaaatgtcagggactaaattgatccttaagcgaaagttcaaggatcacgttgggtattcaccctaaacctttcggcatgttcagattagttccgaaaataaccttaccaaaatttgacaataccaaatttttgacaaattgatagaattgccaaattttgatatgttggaataaatatgttgtgccaaaattttctatgcattaccaatatttggtaacaaactaaatgcaaccatatatttgttaattttaccaaacaacggtatggtttaaaatggcaccaatctaaacagatcctttatcacttaaatccaatgttgattagagaaaaatgattattagaaaaatttaaattattttaataatgttataagtatagtgacatctattacttaaaaaaattaatcgcctagacattgagaaaaataaagagataaatttgagtgcaaaatacagttcatagatttgttctttatatctcgatacgtgagttgattttagagttaagattttgtgatgtggcataaatatgttgtttgaatattgttatttttttaaagaactttctatgaccatttggatagtttttaatatacgaggggatgtctccttaggtatataatactttctctatagtacaactcattttcataaaaagttgattggagcttatactgcagctagttgtaaatctgttgtagctacttttttctttttaacttgacataaatttgatataaaaactcttacaatatgtttatatcactttgttgtacttacactaaaactacgtggtcacttaaggcttggtcagattgtagtcgaaataaaccttaccaaattttggtaaatttatcaaatatgtgcacccatttagtttttttatgaaactctggtaaatacataataaatcctaacaaaacttggccatattgccaaattgccaaaattttgacattgccaaaatttggtaaagtttattttggctacaatataaacatgcccacatgcccttaacatgcactagctaacataggcttcatttggatcatgtagtggtcaatacgtcaatggcggttttacccttcatcatccaggtcttttggattcatttttttctcttctgaagatttattggagtgtttatttgcttgtgatgattaagttttttttctttagggtcttgtgatgtttaagtttaggtgttgaagtggtacgtgttatgtctcactgacgtgtgggtcttaatgactgaagtatccatatttcatctctgcagttcatgggagcagcaagatccgttttctaccaatcga

SEQ ID NO: 46932 - DNA, 1501 bp, Oryza sativa
taaaatatgttaggtgttaaaacaataaccctttttttaagtgcgagaaggacacacactcaaagcttgtgtgtcctaaaaacgctccaaaacataagaccttgcaaaacatggcacacacgtctgattttttccaccaaacaagcacacttgtatataaattttggtagataggcagatttacataaatctaaggatcggatatgtgcgtgaggaataagatgaaggcaatgatgtttctagagcataaatcaattaacaacgatggcacgttagtgaataaatgagtaacggttttgctagctatttgtggattatctaaacgtggtcaaaatacaaaattgtagctttcaaataactttattaacttttagcttgctctcttgggtttagctagctatatgcatgtgtttttatgttgctattgattatagggaaaattgcaaaaaccatctcataagtcaattgaagtttgacattttacccaataaatcactttgttgcaaatacttactcatctatttgttgcaaaaccacatgttttcataaagtgtgagccgtcaatgtattctttaccaaaattaaatattttcatagtatagtcttgacactttttttttgagattccacaaatagaattgctgatgagagcttaaatgttgatgcattgagtttctctatatgaacaaaaaaaagttcaatcaaacatgaaaaataagtgtaatgcaagcacttggagaagattgatttcgctaacttagcatgtggtgactctacatcagcgataatgggccaatttggttaagcacgtgcgcactgggtggtttttgcaataaaactgagtaggtgatgggtattagcaataaaataacttatgggatgaaatgttaaaattcaagtgacttatggggtggtttttgtaattttccctatagtctctttgttttactagcgaaccaaccgttcgttgttacaggaattagaaaaatcgcattggcatattacaaggaagaaatctattttttaattttagaattaaatttgagttttatttatctttttgtgttttagccataaaaatatttctagcggactacgttgacttcctgtcactaaataaatgctcctcccttcaaaacgttgcatcatagataatctatgaattctaccatatatgcgttttgtttgaggaggggcactgatttcacatatgttttggaggttaatggtgggtggtgaaagatgcaccaccgctcccttttataagaatatagatactggtaagtggtaaagaagttgaccattttttttgttagttaatttcaagcattatatgtttcaccctaataaaaagaggtacgtagtaaatatgtgagttgttttgtgttgacacttgatacaatatttcaaccaaaaagaaaggtgattgacaaataagttacccactcagtgaatagatgcatggtccaacaaatgtctagtttatatgagaggaacgtat

SEQ ID NO: 46933 - DNA, 1501 bp, Oryza sativa; identical to SEQ ID NO: 33216

SEQ ID NO: 46934 - DNA, 1501 bp, Oryza sativa
tatttatatgggataataactaattcctaatctcaaaatataactatttctaacgttcaaattttatcctagaatatactatggggtgtttttagtggtgcaaggcctataatacacttcttttccactcatccccagcaccctctcgaaacgaccaccattggtgaagagcattttagtcttttcatcataatccttagtctgttctaaaaattttagaactaagctatattctgagatgaagggtgtgttcggctgcaagtttctaacagctgctgctgctgcactgcgtgtatgcggctgcggcgcacagccaaatagccctagccacagctacagctgcagccaaaaaatagctgccgaacacacccgaaagagtagtatttattacttgcgaatagaaatgatgaaaaagtggcatctgacaaagtatagttagggaagattaacaagtgaggataaggattggcgtggaattagaaagttgaggggaggaatatgatgcttacacccaagagcaagcaaaaccaacattttaggctgggatgaagcaagccatgtgacccttcagtaaaaaaaaaaaagggtgcacgtctagaacctttatttccggacccttccaacattctttcctgctgacatttttttccctctcgaaatgctaagctcacacaagccagtaaaccactgctatctctcgccgacacactgcagtctggtctaacaaccaaaatctgtactatgtacagtacggctgccctagcacccaatcaaccaactaatgggatgtctacttgtggacaaccacaccaacgtaatagaacacctcagccatcgtcataatcttgagaatggttgaggtggatgagagataaggtaatgaacgaaatgtgtcgaccatgacacaaaattttttttaagggtagccaagaatgaacacgatgcgcacaaggacacaacaccatactcacttcacacgaagtgtagggctccaatgtatggaaacacacattcacactgaatacatctacttgaggttaaccccttgggcaaaggcaaagatcatggagctagggaaaaaatttccagtgaggcacataggttcgatccaatccatggatgccaactttttcctccacaacaaactagccaattgagccatgcttggctttcttgtatgcgttgtctttagtgctctcttttattgacaagaggacactaaaagataacctctactcatccttcaaaattgcccttagtgctatcctttttttctctctttttttttcacttttctcactgtagtaacacagtaaaaatgcattagacttggcttgtaaaaaggtgaaacttacattaccccaaaaatataaacagattactacaataagactaggaaaccttcaacacaataccttgttgcaacaaaaacaatcccagctgtgtgtgactgtgagcctagcagcacaccatttttttcccccacactccttccaccaac

SEQ ID NO: 46935 - DNA, 1501 bp, Oryza sativa
acaaacgtatatgacttgtatgtagagagatgaaaaaaaatgagaaatgtggttagacaacaaagggaaccaatttcaatagtttgggggtatgaaacaagatgaaaaattatttaggggtttaagtgcttcgccaaaatagttcaagtgagtaaaatggatttttttatatatttaccaatttaactatttactgttgactgtattatatgctaaagaaatagaaagaaaattaaattttatgtatggccaaaatcataaacggtcacaatggtattacttatacacgaattttcataaaagtttttgtccctacttaaaatacttgatttatctgattattaattcaacagtatactgatgactaatatgttagaaataggactaaaatgaggtttaggggtgtggggcgacacggaccatagttgggccggccgactcaccctgcccaacgggtgtgtccgccactgattgaaatgtccctagcaaaatcacgtgaaattccatctcctaatttcctgtcgatgtgtaggttcagcaagtggttccagcagccgccgtgcacgacgacaacaacggccgcgacgtccacgacacgcccaacaccaaggtagcaggagaggaagaagaaggagcacctcttgcagttgcagaggacgagctgcacaacaatggcggccccaactccaaggaacaggagatcgtcgtgatcaccaaggagcaggaagccgccgccatcaccgtcgtcgttgacgacaccgcagacggcgacggcgacggcgacggcggcggccatgatatcgcgcatgaggtagaagccaagctcgccgtcgagacccctcctgctgctgctgacgcgaaggaggcggagcccgaggaagaaggaggaggaggacgacgccgtgtgcaggcaaagaagacgaccgagaaagcggcgtccaaggcggcgatcgtccccgtcaacgacgacgacgacgatgatcaggctcacgaggatgtcgtcgtcgctgcgccggtggctgctgagcatcaggagacggcggaggcggcggcggcggcggccggcgaggaggaggaagcgccggaggacaaggaggaggatgcgtgtgagaagagcaaggttcatgaggagtagatcgcttgggttttttatcgtatggtgtgcacgcgcgtacgtacgtgtcctttgttatcttagtacttgtcgaaatgctttgcacgcacaatatgcatattatcgttatagtagtagctaagttaattaataaggcagttaatctgctaaagtcattaagtttaagtaattcgatgaagttaactatagtaacgttgatatatacgcgtcttagtgtcaactatgttgtgtactcgtgtttactagtaaaagggatcattagcgttcttgcagtactatctacgaagctatttcaaacaccattatgatgttttacctaatgttacaatcttacttatatactatgtgatgattatcatgggatgc

SEQ ID NO: 46936 - DNA, 371 bp, Oryza sativa
tacggcaagtcctatttttccttgcactttgtgaattcaatttgttcatttgatatatgtatttaatttcacaaagctattgccggatcttgaatgccaccccttgccgataagttactgatactagtataggctacactgcagtatcaaccatcatctgttcctcctcccatagtgcaatcttggggtacagctccaggtcagaatgtacctcttgtgcagcctgggcatcagccgatgtcatcttccgctacaatgccttcagtaaatatcactgatctcttctgaatcagtttatttttctgtattaagtttactactgtgctttatcaaatatgacatccttaccttgcaataattgagtttgcaaa

SEQ ID NO: 46937 - DNA, 1501 bp, Oryza sativa
actcgctgtatggcgtgtgcgccgcccgcgcggccgcctctgctgcctccctcaagcgtgcctctaggtcaccgttggcgaagccattggtgatgacagcggtagcggggttgccgacgagagggctgtcgtgtggtttgaggacgagagggacgtgcttggggaggagatcatggggcccaaagggacgcgggaggagggacgacaccgtgcgccacttggcgtcggaggaggtgacaatgatgcggatcccaccagcgccgcggatctcctggaggaactggcggcagtggccgcagggcatgtgggagatggcgatggcgcaaagcttcgacttccccacggcggcagcgttgacgacgaggaactgctcggcgtggatagaatgggacagcgggaggccccggaactcgaggttgacgctggcgtagatgcagccactcatgccgagacccacggcacccacggggaaccgtgagatcgggacccgcgcgcgccgcatcgcagaagggacaagcaatgtgaagcgttttaacagggtccatcattcagagagtctcatcctgaagcttgcaagtctctgagcagtttcataccaattcccttaacacatctctcgaatgaggaagtaggtagggatttagtgaagatatctaacagattatcataagattttgtcggtaagatgtttatttctccactttgctgaagctcatggggataaaacaacttaggggcaatatgcttggtgatattgctcttgatgtaacctgtttgcatctatgtgatacaagcagcattgtcttcatagataatggtaggtgattctgaggaaccaataccacaagattgttcaatgtggtttatcatcctgcggagccacacgcattcacgtgatgcctcaaacaatgcggtgatttcagaatgatttgtggaggtagccactaatgtttgtttagatgacttccacaatatggccgttcctccatggaggaatacaaaacttgtttgtaatctggcgttgtggggatcagacatgtagccagcatcagtgtacccaaccaagctaggataggtacaagctaggatcaacagttttctgaaagaataagccaagatccttaatgccatttaggtacctgaggatttgttttcctccggtccaatgacgcttagttggagcagcactatatcttgccaatagatttatcgcaattgcaatatctggcctggtactatttgcaaggtatataagtgctccaataacactgagatagggatattctggtcctaatatctcctctccttcctcccgtggtcggaaaatgtcattttctttatcgagagatcaaacatatgttatatatcatatgtatgcaacaatcaggataatgatgataaatcaaataacaaaaaagttatccgaatcgtacatattacgagagatggatttagcagcaccaaaccataataggaacaaatactacacgggaaagagtat

SEQ ID NO: 46938 - DNA, 1501 bp, Oryza sativa
agcagaagcaatgcaagctacacatttgaggaccctaaaaaataccacatacactaaagacacggtccaaattttggttccccataccgcaaatggcctcgtgagaaacttcaatttttcatttcagccctcatatttttctcaaattacaaagaaatccaaattttatagcaaacaccttaaaatggagaaaataatataaatctcaaccccacccaccaccactaggtccacaaccatctccacttcccccacccacccacctagacgagttcaccggtgataccgcagcctccggcctctccccactctccccacctcggcaatgaactctggcaccgccgccagcctcttccttctccccatcgcggcacctctccactcctggacgccgctcgagcccaacccacacggagatgcggcggtggtcgaggaggccgaggcggcggcagagccactaagcaaatcgacgacaaggaggttggcacaagcagggggacgacgggctcatcggctcataagcggagcacgacgttgagctcggcagcacgcaagcgggggacgatgatgagctccgtggcacgtgaccggtgcccctccactcctactctccttagagggcgaggacctcaacgacggtggcacagatttggagtggcgtgggagctcgaccgccattgtcgtcgcctctcccctctcatgagagttgaggacgagccatggcacggcgacagaccccggctctcctctcccctctctggacatcagctccagcatcgcaaatcgggcggcggcgcgatatctcaacatcgggctcctccacttcaccttctccagtgggtgacggtcctctcctcccttctctagttgaggtggcgaggtcgcagggtggcagggcagcggcgcacaagtcggttgcagcatcggttctttctcctgctccacttttgcctagcaccattcctttttccaactgaggagctcggttctttgtttggagccgagaaacatcacaaagccatggccctccaccttctctatcttctaccacaacacctatcctatgtggcacaacgaatccacgcgacacggtggcgcgtggaggcccttctgctacctccaattttattcattttatctgctcattaaaaaaaatcatgtacacaataatatagtatctctgatatacaaatcctaaaactatagaatattttttattagtttgctttcatacaaccccacttctttttgtgcatttcttagagcttatgtagagtgactcgttctttttctccccatttatcttctacatcttatcattcaatcctataagtaaactaggtgattctcagcgctttgctacgaaaattactaagtaacttttaatattttttaataatcgagctaaaagtaaaaattatgttaagagaaaaaaataaatttagtagactctgtatgagattgtagatgaaatatgatatcccacactttgattatatgg

SEQ ID NO: 46939 - DNA, 1501 bp, Oryza sativa
tacttccgttttatattacaagaatctttaacttttatctaactcaaccttttttaaagtttgaataaagtttataaaaaaacttagtaatatttttgacaccagataaatatattaccaaaatatattcaataatagatttaaatgcatttggtgttgtaagagttactatgtttttatataaatttgatcaaccttataaaagtttgattttagaaaagtcaaaatcattttataatacgaaatgggtggagtatttgtgaaatcaaacaaaactgaaatattgttaaaatatttttcaagacatgtcaatggtatgaatgtcaatggtactagagtaactttttccaagacactgccagatgccaatgctgtcgctgtgaatctcatgcaagctagggccatatgatgtagtactaagtccgtcctaaaataagtacagccgtagatatccgtctccaacgtttaaccgtacgtctgtcttatttaaaaattttgtgaaaaatttaaaaatatttagtcacacataaagtattattcatgttttatcatctaatagcaataaaaatactaatcataaaaaaagtttctacgtaaatagtacaaaactgcacttattttaggacagagggagtacgttctcctccatgatagattcatttatgcaagagcaaatgagtgaatgacactttctgttactgaagtttcgcttagagccaacctttacctaatatttttctttggactaaatattttggtctttgttattttaccaccttaatgctaagtgacggctctggaaatttttccttaacagtgcctacttcatgttcgaaattgccatatcactacaaacttaatataaatttacaaaaattgctcaaaatatagtacaaaatagtccctccgtcccaacatctaaggatttttaaaacttcacgacggttttcgaaatgctactttgactaatatcatttatatagataagtttttcaaaataaaaagatttacatactatgatactggtggagaaaccatctctggtcggtcgacccaaatccacaatagtcctggttccattaaaaaccgggactaaaaacgatttttagtcccagtttataagcataacaggactagatgatttttattcctggttggagttaccaaccaggactaaagatctaactttattcccggttggtgttactaaccgggaataaaaatcaacacgtactatataatccctattacttatcctctttttccgtccacacaacgaactctttctctatctcttttttcctctctaagtccttatcctttcttctttcttcttccttagttcttccttcttccttggcgccgcttggatcggagcgagagcggccagccgcttggagcgagagcgggccaggcggcagccggcggctggtgcggcagcgcggagggacgggtggcggtggccggccggcgcggaggggaagctggtgcgacggtgggc

SEQ ID NO: 46940 - DNA, 397 bp, Oryza sativa
acgtgctcggtgctatgctcgtcggagacactcaatcaccagttcgatctttaaaaaggccaacggggtcagaaatgaaaactccggcgccagcgtttggagttgattagtaactccgaaccctttgacctgcacaacctggtcatctccaactttctctgggccgaattctggtgttgggcctagctttctagcccatacagtgaagaaacggcccaaatatggcatcacgaggccacgcggcccactcacaggtgcgcctgaatggtttgtatatgaaataggaaaaagtccacgttgcgcttatgtggcattagaaaaaccgagctagcttgctctgttagctaagcgacgaatcatagcatcacgcacgcgtagataatcacagtcacagatg

SEQ ID NO: 46941 - DNA, 1501 bp, Oryza sativa
ttttaaatttcattctagaaactggtgacttcatttctctaatttatgttataatattgtctctggatttcttttgctaaatatctgcaggttctggcatagcatttatcttagcttgggtattatttctcatcttttggtttgcaacttgtgacaacagtattatcttctgtaaatacaatattaaaccatttgcagaccttttatggatgaacaaacattttttattgacaaattggtcactcttccaacaggagtcgagctggtagaagattcacttctgcttccattaaaacacggcatgctagtggtgaccttgagactgaagatggtatcatcataatgattgcacgtccaccgaacatttctaaaatgcatctgaatggatttcctgacgaggtatttagtttctgtctttatttatcggtccttgatcagtgctggataggggtggggagggagcaggggcttcacctcccccaacagcatacaaattccattcaaatgactgtagctttagaaaattatgtagtagaaattactaatcatttcgtgggcaccccacctaaaaaaaaaaaaggtgtttctagttctgcctctgtcttcaatgaccagtgttttgtaacattatctgctgttaaaacaattgagtgattttgttcttgtttctgctgcataatttagacagttttgcttgacatgccttgtatactctgccaatctaatatctggaagagatcctaaactgatggctcagtgagttcagcatatatgaatatatgatctatctcatcaaattcatgcaggtgtccaaacacttctcacttggctttccggttcaatgggagaatattattaatgcaaacatggcagagatgaacaagcagccgcaatctccactaaaatctactgaatattatatagaaaagtttttgcggggaaacttaaaatattcaatgggacttttctcttgggatggtctcaacatatatcaggggtctagaagtgatgcagacagatttcctagcgagaggctttctaattcttctaatggaagacctactgttgaggatcctactgcaaatacagattgtaatgttaatttcatgggcacattggccacttctgaggagttttgcactggcagaatggacatgcctgaagaacctcgtgcaacccctagtgaaacatgtggtaatgatcaagaaaataaccagcatttatgtatgctcatgaatacatgtgagaatgggaataaagttcagcatggaacatcaagtgtaggaccatctgtagttctgcctataatatgcgaagagtaacgctaaacgggatgctgtattagataatgatagtacaagtcatgtatcctctgtcttaggagattgtgcaacaccaaaatgtggcaaatccttaacacacctgggtactaaggatgcattagaaacaaatgaagggatgaatccacagtttggtgttcctcaaggctcagaaggcagta

SEQ ID NO: 46942 - DNA, 378 bp, Oryza sativa
aacgcattggggtgaggctctataaatcgtacagatggcttttggcatggcgatgattaaaaaaacaattagttgtgcctatgaattatactaaacatgtttatgtaacaagtctattttaattcagttccaaacacaagtataccttgttttgaaacaaacacagaagtaccaactttcatttgcatgtttatctttcaatgacccttatccaattaattatgctgagatatgctatcttcaataaaatatgataagctttctccaagttcatctgatcccaattgagaacttctgttatcgtaatttcaaaaaaccccatctgtcgagccaaaaatattcaatacactccctaactaacagaagttgtctttttac

SEQ ID NO: 46943 - DNA, 1501 bp, Oryza sativa
aataggacgcttcgttttacacttagaaaaattacattactcaagaagaattttcaatttaagacagagtgaagtttcatgaaaattcatatagttgggaatatagatagtccgatgattttaagccaacactcagtccagagacaaagtgactttcggtgaaatttcggattgtctgtcacatcggatagtctgatttaaacaacaggaacacttaaaacaaatgattttgagcactagtattcaaccaattatatgcacgtggtatccctcttaatagtatgacatcctaaacacaattaaacaagatttacaaggaattaccacattcaaaatgacgctaatatttattcaacttcaacaccactttgacccttgcaaccatctcaacaaaaaacaatagaacattcgtatttgtgttgtcattaacaccaaaataaattagaggtcctagatgcatttttagtaacaaatgacaccagacaccatttatatttaaaccttaacatagttttgtagagaaatagtataagggcatgtataatggtaattaataacagggtcttaggtaagtttgttgatatggaagagagaaagatcattgttatgcatgacaatgatttaacattgactcttagcatttcttaaagaaaactttgctgcatgaggatagagaacaggaaagaaagataataaaaaaccgttttggtgtactaattgttagagtcttttgtcgtcccaattgttgtaggaggatagtatctaacattctaactagactaagagcccaaaccagtctctacctttgaacatgcccaaagtgcttaaaaggataccatatgttattaatgtgttagcctcctaaatatatgcattaaactttcgtccattgcaatgtaaccatttcagagttattactagatgaatacgccgttgtgttgctgcggaaaattacattgcataatttgtacaaataagccgcaatatatatttttttaaaaaaaaatgacttcctatgttctatgtataatttacagatggtcaaaaatatagtgcaaggtgaatatattttatgtaatttttacttatgaattttgaacctagaataactgaaattgcatgattttatgagagaagatagaagagatattttgtaccatagatctatcatccaaatgctaaaaataattggaatgatatggcttcacgagagaattgagaaataacataaactatacttaggccccgttctttccctcctcttcaaacttcaacttcctcatttttcgttagcactttttcaaactgttaaatggtgtgttttgaaaataattttgaatagagaagttgttttaaaaagaaataaatccatttattaaatttataatagttaatacttaattaatagtgtactaatgagttttctcatttcacgtgcgccaaaaatccagtatgaaaggaacaaacgaagccttagtggggagttaatttggaatgaact

SEQ ID NO: 46944 - DNA, 1501 bp, Oryza sativa
caacaaggtattgtgttgaaggtttcctagtcttattgtagtaatctgtttatatttttggggtaatgtaagtttcacctttttacaagccaagtctaatgcatttttactgtgttactacagtgagaaaagtgaaaaaaaaagagagaaaaaaaggatagcactaagggcaattttgaaggatgagtagaggttatcttttagtgtcctcttgtcaataaaagagagcactaaagacaacgcatacaagaaagccaagcatggctcaattggctagtttgttgtggaggaaaaagttggcatccatggattggatcgaacctatgtgcctcactggaaattttttccctagctccatgatctttgcctttgcccaaggggttaacctcaagtagatgtattcagtgtgaatgtgtgtttccatacattggagccctacacttcgtgtgaagtgagtatggtgttgtgtccttgtgcgcatcgtgttcattcttggctacccttaaaaaaaattttgtgtcatggtcgacacatttcgttcattaccttatctctcatccacctcaaccattctcaagattatgacgatggctgaggtgttctattacgttggtgtggttgtccacaagtagacatcccattagttggttgattgggtgctagggcagccgtactgtacatagtacagattttggttgttagaccagactgcagtgtgtcggcgagagatagcagtggtttactggcttgtgtgagcttagcatttcgagagggaaaaaaatgtcagcaggaaagaatgttggaagggtccggaaataaaggttctagacgtgcacccttttttttttttactgaagggtcacatggcttgcttcatcccagcctaaaatgttggttttgcttgctcttgggtgtaagcatcatattcctcccctcaactttctaattccacgccaatccttatcctcacttgttaatcttccctaactatactttgtcagatgccactttttcatcatttctattcgcaagtaataaatactactctttcgggtgtgttcggcagctattttttggctgcagctgtagctgtggctagggctatttggctgtgcgccgcagccgcatacacgcagtgcagcagcagcagctgttagaaacttgcagccgaacacacccttcatctcagaatatagcttagttctaaaatttttagaacagactaaggattatgatgaaaagactaaaatgctcttcaccaatggtggtcgtttcgagagggtgctggggatgagtggaaaagaagtgtattataggccttgcaccactaaaaacaccccatagtatattctaggataaaatttgaacgttagaaatagttatattttgagattaggaattagttattatcccatataaataacaccccatagtatattctaggacaaaatttgaacgttagaaatagttatattttaggatggaagaattagttattatc

SEQ ID NO: 46945 - DNA, 1501 bp, Oryza sativa
aaaaaatccaaacagaaaagaaaaaaccggagaaaaaaacaaaacaaacataaacgaaaaaaaagggaaaaaacaaaaaaaaacgaaaaactcgctcgcggcgcgtcgccgccccctctccgcgcgcgacacgtgtccagtcgcgtggggagggaggcgcgcgactgatcgcccaatagcaatctcgccatggccagtgcggcagtgcgtctagcggcgcaagggttaggagcaacaggggtaagagtggagtaacaaaggactggatggataaggtaaagttgggccttatgagtgtatgttgggccatgggttcacaggagaaaacaaatgagtacttgtctgctcggttttggtgtgtacggttttcggccttcggtttttgaccttaaaaaaaagagaaaatcaaaggccgaaaaaaccgataatttggtgtggttcggccttcaattttaggtattttttcccacccctattccccacaacacgtgtgaggcgagctcctcacaaagcactgccacctccgcctccccgatcgagcgctccacctgtggtcccactaacactgctaaggctttcacaaaataaaccttttgtctttttatgatgtctacttgtggcaagaacttcaccaaaaccattagatttagatcatgccaagtattcttttgaaaaaacttcagagctctttcgaattatcgaattcgaaatggatgaacaagaaaaacatataaatagattgccacattttttttagataatgaatagattaccacatgctatggctatgcatgtactacatgattttaaaacaaagaaatacaagaaataatgtttgaatgattcaccggcctgtggaaacagagagaagaaatctagggaattgaacgttggacttatagcaaagaaaagtaaaataagaggcatgagctcacgctagaattattgtagaatgaggatacaggaaagcaattattaggcctgttcctttattcgaaaggatgtcatacggtttttgcagaagattttagtccttcgaaaatcctatgtttttcctctgttctaaagagccctcaaaatgtggcaaattaatgtgaaaaatctttggcagttatgatcaccatcagacagcattgctgtgtttctacctgcctgacaaagtgaccaccatcatggtgtgttaactaactgctagcccctgctagaagttggcagtgtgtgagacaatctagccatgaaagaaggttaaaaacccataaaaacttggggatcatggcaagagcagtagcctaacaaacactagtattcaatcacccagttccaagaatgcgttacagggaaggccatcataatgcatgacaagttcctcaccggccttgcaaatatatattactagctgttagctagattagccctgttaattagatgctcatataaatatggtgaaacctgcatgcagaaacctttgcttctcagttttgacacacaaacagtatgacac

SEQ ID NO: 46946 - DNA, 1501 bp, Oryza sativa
aaatgtgtaaacttcaaaaaaatcataactaatttattttaattcctttttgagtgaacaaaattttgtcagaaccagtgaaaaatgctatttgtattaaaaatactgttggaaaactgcatgtttcatacttttattgaaaatttatttgtgatggtaatggctaaaattgcatgtgatgaaaaaaaaatcaattttcatatgttgtatccagtagctataagtagtgaaatacttatttattggttgtatatcaactctcaaggacaaatgcgtctttttactatgaagttaacggtcaactgatagtgaagtgacgacaatggcataaaagggaggataaacttgaactggtggcatataagggagaagccaatttaaagtgacatataagggaaccggttaatttagagtggtatataagggattctctcttgaaaaatagccaagacgtatcatctcgtccatatctcaatcggatcaggattacattgcagttgacctatagttagatattataaaatttttatatgtataaatctaatttggtcatgcatgctaaaaagtaatatatgtatcatatccatcccgttgaattgttatataatttttcatgactttggaaggatgtcttcaactttatggtacaattggcatttagccaaaattaatacaggaggatctcatgcctttggtctatgcaatctcgaagaagaaaggaaagtccctgcttcaagtaaaggaaaacgatgcttggatcgacaacttataccttgaagccaacccctcaatctcagtggaccttattggtcagctagtcgccttatggactactgtgcgggacatccaactaaactaggagaagcctaatcaaattatctggaagttcacaaaccatgggcaatattcaacgtcgtcggtttatcaggcacaataccttagggcaccaaacactatatgtgattcgctcatttggagagcttgggcgtcaggaaaatgcaaattccacgcatggctaatgattcaaaatagggtctggatctctgaccgactcgcgacctgaggatggaaaaataatgggctttgccccctctgccatagagaagacgaaacagctctatgtctccttgccagctgtagatacacaaaaaaaaatatggagcctggtagccacctggtggcttaccagcagcttgatcttggataatgggaggccacccagaccgtaaaagcatagtggaaagctctagcaaacataatagggattcccaaaaggggattgcgcactctcatcctccttatcgtttggtcttcgtacacattttatatacgaattttatctatacaaagtttaaatacactaatagaaagtttctatatactaatgaaaagtttatacacctatatgtatatacatatgtatctacccgtatgtgtgtgtctatatatatatatatatgtatatatacatatgtatatatgtatatatgtatatatacat

SEQ ID NO: 46947 - DNA, 1501 bp, Oryza sativa
atcgtgtttaagagacagatcgaggtttggagagcatatggatgtatccgcgtgtgttccttgattttgatcttccaagttaatgtccatatcctttctttctgtaaaattaagacccaaagctgcctcctcgattcgccacgtcatcaacattatatcagccgttagattctctgtaggtctctggattgacggttcggtaatattaggccatcgcattctactcatgcgcctctcataaatccttccttctgttggcccaagcccatagcaatagtctatgatcaaagcgatcatcgctccttctccgtatttattgccgcttcagcttggcctcctttcaccaacggaggaattacgagtaataaaaagaattataagctaccaaaggaggaattacgagcaataaaagagatagtacatgaagggtcatcccaaatgatttatactactccctcttaagtttcatccgcgatttaaccataatcggtcacaacccatggtctttcatctcgtcggacagcgtaatgcaagaagcacaccagccatggatgatgggggtgaaaacggagcggatattatccgatccgatccgctccgaatccgatcggagtaaggatacggtaagagtttttagatatccgtcggatacggatgcggatgtggtatcatcgatatccgacggatgcggattatccgattttttaattggattatccgatagacgattggcggataatctgcatatttcaggccacacaactacacaattgagcctattttacatcggccggcctatctagcccatttctgttaacctaaaccctcaatcttctgatctcttcacctcctatccagctatccctatccctttgattaatcccttcggctctcccactcacgtgcgccggcgccgccacaggcccgtccactgtcgatcgactaccatccaccgtcactattgttttgccatcatgttcagatgttgttttgccatcgtattgctgcttattgtattgttgtcctcttgttgtatggattgaatacaaacttaacatctgataattttgttccgtttccgaaccgaatccaacgttcgaaataatccgcttcgtatccgcatctgcacgtcatccgcacctgctcggcatccactttgaaaaaatggtatatgatatggtatgaccactatccatccgaatccgctccgttttcaccctaatggatgatcttataatttttcaggtttggagttttgtaatcattttcttcagtgcctctaagaaacacaggtctgctccccattcatatgctgcatgatcttcttctttcctgattttttatttcaaatactctttcccgtgtagtatttgttcctattatggtttggtgctgctaaatccatctctcgtaatatgtacgattcggataacttttttgttatttgatttatcatcattatcctgattgttgcatacatatgatatataacatatgtttg

SEQ ID NO: 46948 - DNA, 418 bp, Oryza sativa
tcatatatatgtatgaatatagataatgctagaaaatcttataatctgaaaacggaggtagtagctatgagtacaacgacgaggattcttttcatgcgtgatttggcacggtagagactgcagaatcagagcacgggccaacacacccatgtgtccatttgcatctgccatggaaccatacagtttcccacaaaaaaaagaaaaaaaaagaaaatgcagtattccagtccaaacatcacattgattcaccttcctaatacacgcctgtgatggaaaacaccttactataacattatagaagcaccttactactagtaaagaccattgaaaaaccgcttactactattagtagaggtcatcataaaacatctcgttatttgtagatattgttgtaaaagtatttgttttcttgaaaaga

SEQ ID NO: 46949 - DNA, 1501 bp, Oryza sativa
aaaaggaaaaccacatcaagaactctgctccaaggtcggcggcggcgctctccctagctagccgctccttctcctctgtcgccggcggcgcctccgaccaccgcagggctccgtcccgccgcctcccaggtacttgctgcggccttcaggccgtaggcgcgggttagcagttgctgcgaccttctgtttggtagatcgctgggggctcttggcgtttgatgaatgatttcttcgccgtcgctgcagggtagtcatggcgagattgatgtcgtccgccctcatcaggggtctcgtgagatcgagctgctcgccgaccgtagctgtaaggctctcttgccgtccctctccttgatagttttgttcattttatccgccttcgcttgtcatcgaagtgaagttttgttcattttatccgcctttgcttgtcatcaaagtgattctgttacgaaatattcgatagattttgtgcccaccatttttttttcctttatgagaaccctctatctaggcctagggtttgaaatatggattactgtgacctgaccttttgtgcgtcattagctttatttagtaactgtattctgtatatgtggatggcttctactccctccgtttcacaatgtaagtcattctagcatttctcacattcatattgatgttaatgaatctagacatgtatgtgtgcctagattcattaacatctatatgaatgtggacaatgctagaatgacttatactgtgcacggaggaagtatctaataaacacgatacttgcaaaactactaacttctgtttagtttccacatagtacctgtgctattcttcccacggtttctccttttaatgtttaaatttggtgcaatgcttatgatgcttctgcatatgttgctctcttgtgaattaatgcttaaatttggtgcagcgcttatggcgctcttgcctatgttgttaaccttctatccttgggttatgcaagtatcaggttttcttacacttccaatgtattagagaagtgaccaatcttgcactgctaaagttttgtaagcaaattgtatagctttacctgttatgcaattatctgatacggggtcataatttttcccatacaagcgtttattgttagccatgttctatcagtcttatattatgctcaggtaatatatccctgttgatctcatgtttctgcggcatacttgttttccatgataaccgggagataggctgtggcccaaccaactatccatcagtttaggaactactcatcaggacttggtggcgattctactgcaactggggactcaagttcaacacgagttgctgctgatcctgatacacatcaagatttccagcctacaaccaaaagttccaacatgtcttttgatgacattgtttctcaggtattaacatttctaaatgagctttttggacatttaaattgaagaacttattttgtggcaaagctaggcatgtcttaaagtttcatgatgtatttctgccattt

SEQ ID NO: 46950 - DNA, 1501 bp, Oryza sativa
cttcattaatttgtaaaatggctgaaggtcccgtccactgctaaaacagaaggatttgatggtggtcagctacagctgcacggctggtaccaagctggcatggatattgtcgttgctgctcatcctggtcgcggcgacacaagtccatggcgtgtctcctggtggtaattatcagagctgtttctttgcgagcctgcttctttgtaatccatgctccatctgtacagttcagattacttcattatatgcagctctagaaatctgtgcatagtagtacttgatagctaaacacttactatcatatactccctccgtcccataaaaaaccaacctggtaccgaatgggacggagggagtacttcctctcaagaataaatatgtttttttaataaagaaagcttttattaatctcaaacgattacatcaaattgatatagaaccatactatgaaaacttcaggccgtttattatttctgatcatcaagttaatataatcatagcaagaacaatcaagttgatatttattgagtgttgtgaaagacggaatatggttgacggacggagagggtaccgccaaacgattaatcggaatacggacgatttatcggaatttgacggatatttaacgttatgtaaatatatgtatgtagtttataatagtttgcctttttaagatgtaaatgcatacaacaacttatgtttgaccatattcctataatattttttaaataggacatccataacgttcataacgcataggtgtacacctactaaaagaacttcaagcgtgcacatctgtttaagatttaaacaaaagattaaaataagatcaataatacataagaaatttttagatttgaaagagaattaaagggaaagaaaagaaaacaaacatataggctgcacaactagctatatactactaagttcagaatatagttaatgggccggatagttgttctgtgtactgggtcttgtgatcacagtagattatgcggccgattagtcagaaacggttgattaatcgggcaatgatggtaattagacgttctcaaacgactaatgaaaaccgttttgtaaaaatgtgacagacaactcatcgtctccgattgaacggccgtttatacggccgtatcaaccgttttccacaacactgttttattcctctcaagaataaatacgtaaacactccccatatacttagcgaccaaatatctagttgcatgatcgaactaaggagttgttaagattgtaactaaaataaatcttaccaaaatttagtaatttggcaatattttcaaaattatgacatgatttcttatgtatttatcgaagtgtggtaaaaaaaataaatggatacatatatttggtaactctaaaaaaaagatggtttgatttaaaacggtttcaatctgaacaagcccgaactcgcatgaaccttaacttgaagcacacgacatgaataaacactcgtagtaccaattttcttctccaccaagca

SEQ ID NO: 46951 - DNA, 1501 bp, Oryza sativa
tcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcagttgaagtcagaatgaggccgttcaagtctcataattcatctaaaattataatctacatgtttgtttactttttatgtattgtttatttggtttttattagtcttttccttgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttctactagatattagatataattgcttagccatgcttagaaacattagcacactattgggataacttatgactcactgttatttaatgatggcttaatggtagctcacgatggttaatcgtgttatgataattaattggtaattaaaatatgattaatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactaagaagtggcggagataagcccacgggggtcgctggggagtccatgcctctggtttttgagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgttgttcagtgttgattaaaatttctgattaactactccactattttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagt

SEQ ID NO: 46952 - DNA, 1501 bp, Oryza sativa
tcaatcagcccgttacagtagacaacgagagcaaacttttaccactgcaagtacatggaaaattctctctctctcatttttaccccctagcttggtagctactgcacgttcctcggcccagtccagagccaaagcctaaactcaagccgatggttcctgcaaatagggttctctctgcctgctgctgctgctggtcctctcccaactcgaccctgctgcctgcttccagcagcatcctagcttgtacatgtagctctctctgcatggtaatcgagacccagatcgatcgatggtgacctgcagcttgtgtcaagctagagagaattgcaacccggcagctagtagctagcagcactagcagcagcggcagcagcacggcatcgcatatgaacactaccatgcatgccatgccatcgccttgggtctcgcgagaattgctgatcgaaagcctgccattgcatggccgctatctccgtggcgtttccccctcgcctccgagatgcccgctgcgcctaaacgcatctaatttacaatcaatcatgtgtagactctggtaaactcagtttctagtttattttctggattaattttgtaactacatctacttattatctcgataaatccatggagctagatcgttatttggtaggcaaaattggttatatagcatcgaaagttcacgtttttggttttatagcaccgaaagttaccggttcactataatagcacccaaagttcaccatgttcccatttttaacacttccgtcaattctcgatagttttccgtccgtcttgatccagccacacacacgatatgacgtttctacccctcacaagtacaagtataatgcatgtcaatgaggggtagaaatgtcatatcatgtgtgtggctggatcaataacgattaagacggacggaaaaattgacggaagtgctaaaaatgggaacagggtgaactttggatgctattaaagtgaaccggtaactttcggtgctataaaaccaaaaacgtgaactttcgatactatataatcaattttgcctatttggtagggctagttttaaattttaggataaactatgtctgtcagaagctcctcccaaacattgaaacataccatatgtatcttctcggggatcgatcgatcactcgtcgctctcacgtaccacgcgacgacgaaagcgacgacggcgtccagcaggaggagggccatggccatctctatcgatcaatgtcgatggatcgatcgatcgatcgccatggccgtttcttggttgctctcatggaatgtgagcgtgaaccgtgaagggcatgtactacgtagtacgtttggatgcagggtccagcctatctatgcgtgtataagtgcgtatgtagctatatagctaagctagctggtgcattcagctgtggtcaggtcaggttttattgtcctcctagctagctgagatctcgggattcaacatttcttttttccttttcgtttcttttcttggtct

SEQ ID NO: 46953 - DNA, 1501 bp, Oryza sativa
gattttggggacgggatgggatgaaatcaatatatattaaaaacaatgaagaaaagaaaataataaagagcaatcggatctagtctttttagtcctggttgtatctttagtcccggttggtaacaccaaccgggactaaaaatggatttttactcccggttttttcacccgggactaaagatagcgatctttagtcccggattcgtagtcccggttggaaaaccaggactacatgggggttacgaaccgggagtaaaaaccctttctccaccagtgtatatatgctactataggatatgtaaatccaacttatgtaaactctgggataattctacaacattacaccaagagacataggcctttactaatcggtcgactaaggtattacatatatatcatatctctatagctcccgatatacatgtgatgcaaaagtcccacctattaattaggcaaaattttgatacagggcacctaaatgctacgtaatttgttaatagatatcgtaaaaatgtgtcatggttaacaccatcaaaaatcggtaattgctaaaggaaacttttggtccaattgaagggagagcttcttcgaatagacaagaatgtccctagagccacaagcttctaacatgatgttgcagtgaagattttgaaatatgcaactctagatctaccatcggtccaaatacattgctaggatgcatcatattccttctccattctagcactatagattagaaacatttggacctaggggcattcttgtcttttgcaaaaatttctctttttaattgggctaaaaatgtcctctagtcaattataagttttttgggtatcctgcaaccgtgacatgtttttaccatgtccaccagcaattacacaaactttgagtgtactctaaaaatttgcctattaattatgtatattaaagtaaagaagcaacctcccttatgtattaatccaagactactcacatgcattacaaattaaaacaatacataggaacatcataatttagctatattactattcggtcgacatgatatatgtatggcccacaagtttgagttttgcacatttaatttccatgtttttgtctgtattaacctggtcaacccctcataaaaattactccctccataccaaaataagcgcaaccatgagttttgtgtctaactttgatcgtccgttttattttaaattttttatgattaatatttttattgttattagattataaaacacaaatagtactttatgtgtgacttatgttctttagttttttcaaaaaaaattaaataaaacggatgattaaagttggacacggaaattcatggctatgcttattttgggacggaattcttgtagctttgggtgtggattgatcgggacatgttatacagtagtggcacaaatgtttgttctcgaactgagatcttacttgaaacctgtttgacttgcttgtacttttggtgatcatcacgattcatgtgcactacagt

SEQ ID NO: 46954 - DNA, 1501 bp, Oryza sativa
gacggtcgacttcatgagatcgagtacttcctctatatcagtgggtgcgcacacttccgttgggcaaatcttttcttactttattttattgctttacgtgttgagtggtaacgatttatgcttatttatgtgtttcctggtatgtgcagaaagtatgcatcagtgtcactcttcttcacatgtgtaagtatttatgagtattcacgtataagaaaatttcatgaccacctaatgccgagtagttgcacacttgcaaacagttgagagcatgaagatcaatggtaggccgtgtttggaaaaaaaaaaggacgccctgaatcgatagtccctttggtttgcaagctagctaatttacatgttaattacttcgtgaataaaaaacttattatgggcctccaagatgccaaaggagactgcagactccattcattcttcacatctcattctcttcgatcctaatcattccccagccctgtcttctcctttccatttattcaagattgtgctctagctagcttaccacgctctgcggaacaataactagttttgtcatgaatatatatatgttgccatccatcttgatttaattaatttatatttatacatgggaaatgaaaaactgtaagcgtgaagcatcgccaatttgaagatcgctcgattggtcagtttggggctttttgctggcttgggctttggagggaggagatgcgcggcccaggaggctgctgtatttctagcatcgtccgatcgtcagcttttaagaacattcatcttcaatcgtttctcttctctgcatctaaacacactactatagagacgattttcctgaacgctggccccttttggttccagacaggccaaaagcggctccgcctggtaccaggcgaatgccggcgccgggctgtgggctgcacgggataatcgattatcccgtgtggcccacgtaaggcgaccgcttgcgatggtcggtgggcatataatccccagcccgaccgttggcataaaattccggcggtttctctctcataaacattcacaaaattagggggaaggttttcgacctcaaatctttgattgggttccatataaaaggtgtagagcttgttctcctccttcatttgcttacatttttgtcagttttcatcggtgaaatacgatgaaacttgcacttttataaatggaatagtgtaggcacttttttgtttttttattttttttagcaaacacataatgattccattacatgtttataaaagtatttagtacttaaattgaaaagttgggtttgcctctattaaatttattttcattaggatgaaaggacgattttttttttcaattttttagaaatggacaatattttattaatgcttaaaattgttatgcagctgtttaaatagtccgtaaaactttaaattactatgtgattagttccctctaatttaaatacatcagtgtttgaatcgggcatggatgtattaattacaagctttattgtagg

SEQ ID NO: 46955 - DNA, 367 bp, Oryza sativa
tccttttcattttgaaatgattgtgcttataacactaaaaatgaagcattttgtgcttataacactgctctgtgctttgttttatagctggttgtggtcctgttgcatttagaaagtaatgcttataattagtgaaatgttcatcacaccaactgcatttaattgttgccgtcaatttgaaaactgaaaactgattatcagcttggcatcttgtttgtgttctcatatggtctgacaagcaaagtacgctatgctcaaattgaaaatgctatagctaaaccaagttcaacgtcatccgtcaccaccacagattgcttgtcttggatagtatgagcaattttttgatcaagtgtcttgtgtttgcagt

SEQ ID NO: 46956 - DNA, 1501 bp, Oryza sativa
cccattaactatattctgaacttagtagtatatagctagttgtgcagcctatatgtttgttttcttttctttccctttaattctctttcaaatctaaaaatttcttatgtattattgatcttattttaatcttttgtttaaatcttaaacagatgtgcacgcttgaagttcttttagtaggtgtacacctatgcgttatgaacgttatggatgtcctatttaaaaaatattataggaatatggtcaaacataagttgttgtatgcatttacatcttaaaaaggcaaactattataaactacatacatatatttacataacgttaaatatccgtcaaattccgataaatcgtccgtattccgattaatcgtttggcggtaccctctccgtccgtcaaccatattccgtctttcacaacactcaataaatatcaacttgattgttcttgctatgattatattaacttgatgatcagaaataataaacggcctgaagttttcatagtatggttctatatcaatttgatgtaatcgtttgagattaataaaagctttctttattaaaaaaacatatttattcttgagaggaagtactccctccgtcccattcggtaccaggttggttttttatgggacggagggagtatatgatagtaagtgtttagctatcaagtactactatgcacagatttctagagctgcatataatgaagtaatctgaactgtacagatggagcatggattacaaagaagcaggctcgcaaagaaacagctctgataattaccaccaggagacacgccatggacttgtgtcgccgcgaccaggatgagcagcaacgacaatatccatgccagcttggtaccagccgtgcagctgtagctgaccaccatcaaatccttctgttttagcagtggacgggaccttcagccattttacaaattaatgaagagtgttctacagtatgcctgtatctgctagatgactttatagctagcactgcaaagcagaaacaggtttagttatatgtatattgacttggccttgactttcatagttaatcagctcgggccctgcagccacccgcaagaagaatctgtaacacaatcttaaaacaaatgcaacttgctgtggaagtgtggaatttgcatgtcaatgatctcgctctataatttacggttgcaactagagtgtaatcctaaccgcagtgatgacgaaattgcaatcggcgaaatacatgatccaggtcacctttttctggttatcgatcgcgcgagtacttttgagtacagcaaatagtatagatcactgctagtctactaaatttttactaacaattatcttaaccgtttcatttagatacatataagttataaaaaatctaaatatggtcatagcatgacacatcagtgatagtaagaaaaagttagtacgtatagctttttctaatattatattagcacaatgctgaaatgcatgccgatgtttctctgaataagtatgat

SEQ ID NO: 46957 - DNA, 1501 bp, Oryza sativa
gtagtttggaaaaaaaaagttaggagtttatgtgaataggaaagttttagatgtgatgtgatgtgatggaaatttaggagtttgagagaagtttggtgtgaaataaacatgaccatatactccagtttggaaagcaagtggagaacgacggcaatgtttgcttgcacgaccagttcgatccgatgcgtttcgtcccggtcgcaatcagagtcaagtgtgaatgccaatcatagctcgatcggattggattcgaggaagccttcgacggtcgcgtctgcgagcgatcacgtatgcacgcgcttggcccataacagtaggtaccacggacttcggtacggttttttgctatttttttcatgtgttcgcatcaccgctcttgagtcttgactttctctgccacgagagctcatcggttggtgcagcggtaaccagctctcggataggtcgggtagtcgtccgggcaccgtcatagacgtcttcaccgtagataaaatcgattttttagttttcagtttttctcttttttatcattttaaatcaaacaaccacgtaaatgtcacatcgatgtcacgtggaaataatatctagttaaaggagccacgtaggtgttatatgtcagctacttcgtttgcacttttttctaaagttggggaatgtgatccggacatccggtttgacgttcagcgacaaatttgagggaccgaaagagaacttattccccgtgtagcgcgcgtgtagtgggctcttgcatggtgggccgcgctccgtgatggtagctttgagcccgactcgtttatgggctcgtggaccaaatcgcatcgcgccgcttttgctcctccgtctctctctcggcttggaccgtaagaaaaagcaaaaaaaggaaaaaaatagggagtgaaaaaaaaaaaccccaaaagaaagaaatctccttctctctctcgatcccgtctcgtctcgtcagtctgcacccggttgcctccccgccgctctcctctccggtctactcctccgccgtcgccgtcggcaccgccgccggagctcctccctgctccctctactgggttggcggggagtggatcggggatctgcacgcaggggccgatttcttctcttcgtaaggtatgccctagctcttccctgggatcgatttcgctcctgatctagttcgttctggtctccgctgtgaatttcaggaaatctgttccaaatataggtgtttctaggggaattattccgtccaattagtgtacatgccctgcccatggtttaggcgtggagccccgtagatgaagaaccccctcttgactattttgtaggatgtttttttagttaagaatttagttcatttgatgcgcagtaagatcttctttcatgcattgctgagcgcagtatggggtgatcttctgttttgattgattgtgtggatgtggattatagacagctaatccttagggttttttcgtgttttcttcaggagtagataacacagaatagttgaaga

SEQ ID NO: 46958 - DNA, 1119 bp, Oryza sativa
aacgtgttcacgtgctagtcttttcgcccaatgggataatctttatattcggatgagatgggtctagaatgatgtgaataacctagcatagtcttcgtagatttgtgtggtatggttctctgaaaaatttttaacatcagcgccgtcccttttaactctgcttaattacacggacaaacttttgaaaagattggcccacgttggcggaaggaaaggggaaaaaagagtaaaaaggtgaaagaatagttcactttgtgctcacgttgctttggtagtttctgtaaaataaatgttttggtactgcaagaacttgtttggtgggtacaaattagtacacgaaattataaaacgctcgttttgatagatggagttctcatagtacatgctaaccaaaaccgaaatagcatggcaaggctaattttatcaacttggataatgattaggacgtgccgtgcacacttgcttgatattttatgtcttcttttctttgcaattattatacccttattctatcgtttactccttccatgcagaaatatagccacatttacttatctcaactaatcgcaatcatcattatttagtttctccacttattttctcatttcaactaattataaccgttcatcacttcacctacctattttcttaatatccgtgcatagcactgaagttaggacgaatggaatattaaatatactagataatgccctgtactttgctatggaatatttgatgaatatatgtaaaatattgtacaaaagatggatggatttgggttgaaatattgcgaaaataatatgaaaatgatgatttaatatgcttatatgtttagttttagatttacttgctatgtttgcatgttgaactttaaatgcttagcggattgatgtggtatgcttgtatattaggctttaggatatactaataattaaggcatgtttggtagagttccaactcctaaatttatctctaggagttaggtcttgagtggagttgtggagtagcctaaacacaactccacctctctaattcattttgtgagagtgctttacccagctccgctcctattttaggtggagctgaaactgtttagccaggctccagctccaggagaga

SEQ ID NO: 46959 - DNA, 1501 bp, Oryza sativa
acatgttgtttcaatgattggttgttcacccaacccaagtacccagcacttactatgtgaactagatttcgaaaatattgtgaaaacacatactatatagcaagcttttgatttttttaaaatacataggtgatccagatcataaaatgctttattacttctttagaaatgtgatgcataatctggatatagaatgtcgtgaaaacgttttattaacccagtaggctaataattctttagaaatattgcacgcgaactggatttagaatatagtggaaacattttattgcttacctagttacctgacatgctattgattcttcataaatacgataaaccatgtggatctagaatgttgtaaaattaatttattacttacctataatgctttacgccaattagatttagaatttcgtggatctctagaaatactttacgcaaaatagatttagaatatcgtgaagacattctattacttatttgacaggctattgaaaaacataatatgtggtttggattagaatatcgtgaaaacgttctattgctttccaatagatgctactactaattctttaggaatgaaattaattccaacaaaaaaatatgcaaaatttcttcaaagcattcctttccactcctgcggatggaaacgaggagggattttaattttgaataaaaaaaccgagaaaaaaaataaagaatgaccagaatgccctcttgatgttctctcctctcctccattgaccattgccttcttttctctctctcgctcgcttcctcggttgctcactctgtgtgtgttccctccttgtgctgagccgcggccgcggccggccttccgcctcctcctcgcctcctcgcgcgcgccgctggcgagcggcctcggagtgcgcggcgtgtgcaagtgctcctactctccttcgcgatcccactctcctcctccgcacctcagctttgctctcgcgcagggccagcgagctggttcggagagggcggtgtggctggcctccccttccactgacctccgtctcgtctcttctcgaatcgaatcgaacgaactgaaggtattcattcttctctctacctcctcttccgcgatgattcgtggggcggcgtaggtagggtatccatcctgacctgggattgatttctttccctccacttaacacacacagagtttttattttattttattttggggtgggaggggttctttgatgcatgttgcagtactgatctctattcgtttccgaaagaaataaaaatgaaaactttggggtttgagctgaacccccatgccccgtgttagtgttggcccctgcatctgtcaagtgtcaaagttgtctctcttttttttttttttgaagtgaattgtgcgaatagaggttagagaagtcgcatgcagatgctaaaggttgttcctttttttgttcattttggcaaacagtgatgtgccgggattaacctgtgatttgttaatgcagatagtcagctgatacta

SEQ ID NO: 46960 - DNA, 217 bp, Oryza sativa
cggcagccgggtgaaaggggattgatgcggctggggcaggggcggcatgacgatcctcgacggtggcaaggataaggtggtcggcggggacagcgagcgcctgaagagagcacgataagccgctggcgacgtcgtgccaccacctcgccgagctccgcataaagcacgcgcactccgcggtcgccttctccacgcgctgcgccgcacccggcggcga

SEQ ID NO: 46961 - DNA, 1501 bp, Oryza sativa
tccgcaccgattctgcgcaccttctacgtacctacgctttccccttcgtactactctgatgagtgtctctgccctcccaattcaagccatcatttctaaacgacatatttacaaataaaaaataatttatcaataaaattttatatacatgtttttagcgatctaaaaaacaaagactagaaaataaactttgatagaaaaacattaaaatcaatcctaaatttaaaggtgaaaatttaaattttggcagatagacccatgtcagggcatgaactgatctgatcatcagcttgagatcaagccaaccccggcccggccacggatcaggagcggagcaaccgagcaatccgtggtaaaagtagccggatctacgaggaaaatactccgtagaagtagccgcatatttgtccggttgcttccgcatgctcgcgtagtcgcgtactccgcacccggggcggcatcgcgtgcggtgcgccccggttttttgatcggctaaaacacgcaacgacgcgcgcgaagccctcgtgacgaggcgagaaacgcacagtgggtcgcgcgcgcgcgcgcgcgcggccgcttgctggttcgggacgacgggtttgcacgtggtggtggacgggtgatcgtccccgtgcgcctcggcctcccgctacgagaggaaactgcacatgcgttgctcggtcgctacgcctgccgaatcacactaacgcgcagatccaaagtttggtttcaaacttcagtcctcttccatcacatcaacctatcatacacacacaacttttcagtcacatcatcttcaatttcaactaaaatttaaactttgcgctgaactaaacatgaccatttagcctgctcaagacaattttggtggtgtccgatgggtttactataattctgcacaaacaaacggagtcaactataatatatactcccttcatcctaaaaaaacaaatcttttcacgaatatagcatttcctaatacatttaatttagacatatttctatcaaattcactatagtattaaaaaatattatactcgtgcattggttttttttatttttttttacgaagggagtaccaagagagtctgcagaagagggcactgaaagtctgaaatgacactgcttctcaggctgcaaggctacaacttcatatcctttcggccaaaagaatgcaattccaagtgcgtggggggtaggatatcagatttctgctgttcctctaccctaaactccataggttaattgctccgaacacttttctagtgcacgcacggatggcttgtttttctcttataattgttgtttgattttagtgccatacgttctctaagcacttttaccgatctactagtactatataattcctactggatgtaagtgcctgcttttttacatacgtaagtactggacgtctggatgtaagtgctgcttttacatatacgtgcgtatgaagttggtactaagatcaaggctaataatacagtcgaccagtctctta

SEQ ID NO: 46962 - DNA, 1501 bp, Oryza sativa
tccggggtgtccgagggggtcgccggcacgccgtgattgctgcctgcgtctttgcttcccacgtccagattaccgcgattattactgctctctccatccgataatataagaaattttagtatttatttagatttattatactataatgtattatattcatctaaaatctcctatattaatatggaggagtagtattattattgcatgtggtctcaccattcatccaaaatctcctatattataagatggaggaggagtattattactgcacgtggtctcaccgtgagaattttttactgccacgacggagagttatattgttgatcattactagggtcatgttctcttctctaacaagagttgaataaatattaagatttttatggcacgcttttcaaactgttaaacgacgcgtttcctgtgaaaacttgaaagtatttttcaagtttgtaataattaaaactcattcaattatatgttaataccatcttattttatgtaaaaaaaattaatttttatctttacatacagaagaaaagaacaccacctagtactccctccgccttaaaaaaaaaacggacgacctatctctgtactagtttcatgcgtaaattgctgcagtagttccccttgaactttgttgacgataaatttatgagttatcaaaaataaaaagtttacctgttgcagtatcacaactcctatctctgtatggcctgacacctggccgatccttgcgtcatcgctgccgctggtgacactgttcaagcgttcatggacgacccaacatccataattccagatccagcgagcagcgtaaagcacccaaccactaataccacatcttcttctgcacgctgtgagtgtgtgtgtgtgtatgtgtgtgtcagctgcgtgtgctagctggttgagggtccatctccatgcaatgcaaccgcagagagaagaaataaaggtaatccaatctaaaacctctcgatcgatcgccggccgaaccgaaccgtgcgtgcgtgatgcgtcgacgtcgtgcgcgtcgtggctttggcctccccatggcgaagtcatggcatgcacgcacatcgcgtgagttgctatcttctcggtggtcacgcgtcgcacgcatacatgtgtgctgatataactagtatacatatacttctgctctctgtttttttttctccctgctttgagccagaaaagcagcttgtatcttgctcctttcattctaaactaaacaaatctaatataaaatgtgacacatttatttaagattcgtagtattaaaatgtatcacatctcatattatttttatctactttgggatgaagaaagtgtatagaatagaactatatgctgatggttcctttgaaatgcaataattttataggattattctaagaatcaatgcaatttctcaaaataaaaataaaatactccgttccattgtttcaaaggaggtctgagagaagaaaccattttttgacaaattgcaagttggcag

SEQ ID NO: 46963 - DNA, 629 bp, Oryza sativa
ctaattgttaatgtttatattgctatatctgtctataaatttaatcaaacttaaagcagtttgattttaagtcaaaaaaaaaacatcatgtaactagggagtacgtcgctacatgagcatctatcaaatgttaccgctattgaataactgaaatgttttattcctttcgccccgttgaggcgttgacgttgttggagcatcactgtcaggagctcccgctcatttcattagttaccagggggcgctcgccaatcagagtcgtgattaactttgctaatcataattaaactgcagcgcgatggagagagcgtcgtcgtctccatcggccgtctccccgtaacccgcatttattagtaattttttttggcttggtgcccaagcctgtgactcacaaaccaagcaaccaaccgtactttcttttttatacacgctgccggccgctgcaacgtaatcatatatcgcgtgtagagattctccattctctccacgcgcacatggcgaacgaattgacctgagagaggtgaccgatctatcgatcagagagctagctatggcggcggcggcggcgcgagaggcggcggacggcggcgacattaatgggggtggaggaggaggaggagagaggtcgt

SEQ ID NO: 46964 - DNA, 342 bp, Oryza sativa
ggcgggcggaggggccgcggccggcgggtccgcggcaggcggggccgcgctcggcggtcgtggcgagcggcggcagcagcggcattggttttttttaaaaaaatttgtgatgattcactgagatgtatttgactgagaagttataaatttgtgattcattgtttggatctgtgatgtatttgagtaatttcttaggatattgtgatgtatttgatttgtgtgtataagtaattttatgatttgtgatgtgggtttggtgatgtgaatttgggatgttattttgatttggggatttgcctacttgattcgggagaaaataaaaagggaaaaagaaaaagaaaa

SEQ ID NO: 46965 - DNA, 1501 bp, Oryza sativa
agagtatgaggggaagagaggatgaggggtagaatagaagagaggatggggaagataaatgtaaatgtaaaaatgtccctctctctcccccatcgagacatccatctcctctcctctcaactcctaccggccggcgacgacagaaccagcgagggaaacaccgacgaagcaccatcgacgctcctcctcctcctcctcctcctcctcctttctcccacttccccctcctctttctccctccctcctactcccatccggcctccttgggcttgggctggatggtaggcgagggcagctcaggcgatggcgacggcggcagaggtgacagactcaggaggcaaatctgacaatgctggcctcgagaaggacggatccgccactctgggccctggaaaggcgacgatgactagggtgtcggcgctggcgaacttgagggcagcagatccggcagcgctgccctcggccctgggagaggtgatggcgatggcgggcggcggtgagctcgagaaagatgggaataggagttagggttttgggtttcttttttggaatttttttgcctaattttgattttgcagatgggcggcttaatgttccttatgcgaaaatcctgtttcgcacgtgaaaaaattgtttctctattagtgccaaactataattaaaccagacatgtgatgggagaattgacaagtggcccacagaactttcatgttatttaatcagaaatgaatatcttaatgagcacggtgtccatgagcgaatttctatatttacataatgtttcccacaataagtcacttcgtatggtgtcttataggcttagagatggcaatggccccccgttcatcgttttcttgcggtgaattcacatattaggtgacggggatgattaatatatatccatcattgtgaatgaaatggttaatatgtattcaccactagtaatatgcccgtgctaaacgctacggtgcaattctacttgtcttcaataatttttaaaatttcatgttagcaaaaaaaaattgatatgatttgtacatttgagctttaataacctccggcaaggccaggtctgttttgtgctttgtccgtgaacattatagctattcacttgacattttccccgtatcgttttactgctgattaatcacgttataataaaccatcttttcttgattcacatagagccataactgagcattgcaatgctataatcatttatgtaggtgaaaatgctaagtacattaaagcgatatgatggataagtcatgacaatgcgtgtagagtcaaatatagatctgaaagacacaatcgtatgcaactgtaaaaaaaattggtttaaacgcaattatgaatatctcaagatatatggccctgcaatgttatgcggttcgtgtcaatgcccagagcatatatagggaacaataatcaccaatcgatcaacaatgcatagtgttatggattgaacaacccatgtcacgtacagttgcatgagctatct

SEQ ID NO: 46966 - DNA, 1501 bp, Oryza sativa
aaatatgaagactgtggagggctgaaaaataaagtcaggtgcatcgactagatgcacctaataggtgtagcccccgactatgtggttaattgaacaaaccaagcatatagtcaacgaataaataatccaaccaaccgagtggttttaataattatagtcaaccaagcgacctgatattaatatgtagcatatgcggtgtgaatccctgaataacatgatccgagtgatataccgaccgctttgtaaaatatgatgagtgtaacctaaagttggttacatcattgaaaattcacataacaaaacagctataaagaagcttgtatgttgtgaataaataaatttccaaagtattgggcatacgccatgcgcacactgctttaacagacgtgctttagtccctaaaagacacatggtttcaccacacctggaaatatatggcatatgtggtgtaaaatccgagtgaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagccaaaagtgcctaagtccctaaaagaacgtgacaggccacacctgaaaatatgggctgcagacatattaggcctaggccaaaaaatatgccttcgacaccctttaaaggatgacgcatgtaacatgcttccgagtaataaatcttccgggtaatatagaccaagtgtagctcatatgaatagcttctgatctgaatgattatcccttatgggatactccaaaataggtgtaacaattgaatcccgactggcgcaagtattcggttgatagcccttacggggaatataattggtccagtctttgagcatagaaaatagactcatgactatgaatccatgtggaatgtatccggaacaagtccaaattggagatataatcctcacgcttgagttgatgagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagccatggaggcgaagaaaccagtcggcggcagacagatcaactaacaatgaagatgaaggaacccagcgataaaattgtgtagccatggcagcaaaataatcagtcggtgacagacgaggtagatcaaaggtgatgacaaaatccaccaatca

SEQ ID NO: 46967 - DNA, 1501 bp, Oryza sativa
attcaactatgtgccgctgcagaaatagctattttgtgcataggtgaaaaaaatatgatcatgatattgtggatggtgatagtccagaagaacatgaaggagatgtagtgcaattcaactttgtgtgctgccacgcaaatggctattttctgagaaaggataccatccagtactattttgtacagattcaactgatgaaactggatggcatgtagtatcagtttaagtactatcagtcaattcggttctttcatcttacgatggtttgcctgttctctgcagttcagcttggtagatcagtttagcgttgagaagcaagctgtgaaaacatccacttaatgcagaagaggtcataagctccactcctgaaaattccacattttttagatatcctcacattattcaccctatatatgttttcagttgttcctgtatatttggtacactattctcgtttaagttgtttaaagatgattcaaggtctcaaagacgttattatcatcgaaatgaaggctggaggtactttttatagctgaactacaacatactgaaactctgcatgctaatcaattggctcaatgtttttcagctctgaaaataccacggttgtacattaacgttttccatctcatcacaactttgagtgcaggtaagaggagagctctgatacctcctcaagtagtctacactgatgagagcgtgcggcccataccagaggaggtatatcctaacaaacttttccttgttttttccctattcatcttaggtgtttcttttacctgtatgtcagttcaaatagaatctggagcgatgctaacttatggtgccagcttcgaaatttgattgctcatggagacaggggacagattattattttctctaaacatttctgaaaatataattctgaaactatggtgaaatgaaacactctcatttctgaaaaattcagctgctgtatgggttgctactagcctacggaatacatggttcagttttaacctggcaatgttttcttcgggttctggtcattatggtgtcataagaaatagtcaggccactccattcaaaaaatgggaaagacaataaagctttttcattcaacaagggacaataaaggactatttttgcatgtgctcttttgcttggagtattgtgtgattatatagctgattgagctatgtttagaaaactgaacttcccagaactagaattgaatagtctatggcatgacctaatcattaatcagttctctatttgtgagactgatagttgcaattttatagaggatggtctatcataacaaactaaattacttctatgatttttttcttaaatcaaagttgatacatttgtgactgttcattgtttcaggctgaagggggactcattatttaaaaaatgaaatgaaaactgctatccatgttgactccatcgattcattgatcagatcagggggtttgaatgaataaggatatctatgctgttcatgaagtgcataatg

SEQ ID NO: 46968 - DNA, 828 bp, Oryza sativa
acagctgtgctcacttatcccatatatgtcgcgcagccttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcggttgcgtctgcctcaagcctctggtcatgatactcccggtcccatatcaccgacagtagcccccggcgttatgccagagcaatttcccttcccaagggaagcggtcaggtgtgacgccaccctgtgacaggtgggaccggtttccgtagttgggcaaaatacccaacggtctcaattcacgcacattggtattggtaactttggttgtccataatgggcggtctattcaagactgccacaccacttgagcagcgcgcgaatctgggtgagcagatttgtctcgcccggagatacggtaacgccgcttcggttggcgagcgtaattaacgcgcgcacgatacaatccgtttcgattgccacaactgcacatccacttcaagcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctgccacgccctactttcgccacacgcgctcgttcccaatcatctcttcctccaccgcca

SEQ ID NO: 46969 - DNA, 896 bp, Oryza sativa
ccccctttactttatagccgaaagttctttcatttcatatcttctaggggctaaatattcattacaagttctcatatctactttagaaaaaaaatattgttttttcttcaaacgaccttaggtggagatatgttctacactaaaattatagacctcgacgaaatctacaactgtatagttgaaattttttatatttgagattgtttaagtgcctaaatatttttggtatattttacaaggtgttctttagaaatttaaagctttcaaattttcagaaagttcatattaagattgaggtaaataaaagttatattcttacactatttttaaaatatgacctagttaatttttatttaattttgaaatatcttagttagataacatatcaactctcatatagagactacaagacatgagtagacaatcatatttaaagaagtattatcaaggaaatatggcaggcatattaaacaaaatattgtaaatattataaagattatagaaaactcactactggagagaactgatctttgttgggttggctgaaaatcacaatggtcccggttccaaaaagaaccaggactaaaaatcatctttagccccagttgaaaagcctacagccattttatggtaaaccgggactaaatatcatttttagtcccggtagaaaaagtgtccgccccccactctttttattcccggttggactaaaaatcagcgtatagtatataatccctcgcacttatcctctagcaaccacctcttcccttatcctcctcctctcttttcttatcctctccctttcctctctctattctatcctctcacgcatgcagcagagtgagccgggctggcttgcggctgacgcggggaggcacggcgggtggtggccggca

SEQ ID NO: 46970 - DNA, 155 bp, Oryza sativa
acacccccctcccacctcctatccatccccacctcccctccttcctgcgccccctccctctctcccatcgctccccccagcactccctctcccatcgctcctctctcccgcgtccccctccttttttttctctcactccttctctcttttttaga

SEQ ID NO: 46971 - DNA, 1501 bp, Oryza sativa
cttgtggctctcgtggcacggggctatgggagcacggccaccgactcgtaatcatccacagagtggacctgaaccgaaccactaagtagtagtacgtgtgagggtgagtaaggtattcgtttctgtgcacgcacggtatgcttggtgaaatggacgcatggtggaaaagcttatataaaaactaaaaaaacatcgatgcgcacgtcgtcgtaagatgatccaaactccaaaggcttcattaggctatctctaacaataaaacccaaaatacaagacccatttcacatttacatagcgctacagtcaagtcaaatagttcaatatctatttttggtcttctctaataataaaacctaaaaaagaactcttactgcaaatagctcttcaggagagaggatactcaaatttaggttatgcctcttatagcacgcaaaatgggtcttccgtataggtactctgttggagactgaaatagtactatcggagacctattttgagtttaggtgtccttatgggtcacttgttagagacagtcttactgcgtttttttttctccaagcgttattgtaaccacaagttgtgccaaacaaaaatgaaattaaaattggccacacacacaaaaaaggaacaaccagaagagtaaccaatccgagacttgccgaccagccggcgtgcaaagccgcccaaaacgcacgcgcaagtcgcggaccgggtcgctgctcggtggggcccacctctcgagcctatccctccccgagacgccgttaccgagtccgggagacggccgttacctccgtgggaagggcgtatattaaagcggcgtcgagctgagctgctggtggagtggtggtagcggcacgcttctcgctacgctatagaaaccgcctctcgagtagtcgagtctcgaagcacaaattcccctcgagccgagacgcctccttgctcccctctaaaccctccccctcgcgcggattcgcttccccgtgtctcccagaggggagttggtggtgttcctggagcttcttgggggtggtttttccaagctgcggcgggctcgccggagttggatccggcggaagagaggatttctgggaagggtgccgcgaagctgctcgacggcaggctcgtggtggccttgaggtactttcttggattactttggtttttttatgctgtggagctgtaatccctgttgcagttgagctcttctggtcgcccagaagcattattattatcaattttaagcatttggtatggggaattgtctgttcagcacgttggctgccatcgattttgtgtgattcatgttgatttattcagttcatcatggtaattccctgcggaattttgtgtccgtaccttactgttgcgtttgtttcaggaaatcgcttcaatttcgaacgggctgttcagttggctggacgattcatttcaagagcagaagtgtttacaccaagccgtagcagaagagggaatccttgatttgtcgtgggaataaaga

SEQ ID NO: 46972 - DNA, 238 bp, Oryza sativa
gtgtgtgtgtgaaaatgcagatttgcactcaggttcacatgtacctacaatctgcaccgttgatgtgtttcaagattcgtgctgcaaaatgtacctaaccttaaccaaatgaatgattactgtagggagaaaagattaggattaggttggttcacaatatgtataacatgtatgttgtattttttaccaaataatttttttcaataataattatatatatgacatttatatatctagt

SEQ ID NO: 46973 - DNA, 1501 bp, Oryza sativa
aaaccaaataaaagcttaggttttccaccgtcttcttaacgggagccatgggatcgtcggcgacggcgtcggtggcggcggcggcgggaatgggaaacctacagcgtcaacaagggttcgaacagaggggggagtatataacgtgagagatgggccttgcgttattgggctacattattgcgtatcgacggcctcaagcccagattcttactgggccaactttgcgtatcaagccagcccagttggtaatttcttctgcaaatcccgcagtccaaacttcccggatttttggactgtttaaaaatcactgaacagtgaacgcaaggagtgcttcttttttgttgaggagaaattttggaatacacgtggaattcatatgccccaaattcattaacaaataggagtagatcgtgacggtagagaactagtactacagactatgctttaggttggagaggaccggatacggacaaatgtatattcggtcagtgcaatagttctcaaaaaaaagttcagtgcaatgattcattgattcctaacgccttaacatatgtgccttatcatacaagtgcctgcctttttacaaaagctacgataattggcaagtaggctcatcaaataggtcatttttatctttttatggttgtgtgggaataaagatcactgtagcataatggaacaggatatttgcagccaagtttgcaggcataaggatggcgcatcttctcccgtaggattcatggtccatgttcactttgtttgcatatctgtatctgaacaaaagaaacagtacagggctcaatatgcatttccaaaccaacctctttcaatggacctgacgggctgataaagttgagtgtgactgaaaaagatgcaaacaaatggaaatagggaaacaaaatctctttttctgtctagctttatatactagtataaaacaatgatgaatcgaatggtttcagttaaaagaacggcatacaaaaatccctctatacagccttcagtctacaaagacttcacatcagtctccaaccggagtcataatctgcacttgctaattgactaattctgaatcgggttggccttgcttggcgtctccttcttcaggctctcggtcgcctcgacgtcaggctgcttcttgctcttgttatctactagtaatgctgcttcaaggaacacctgtggattctctgaacttgtgatcagcacattctgcaggagcttccttgactgaaacctctcttccgatgcccaatcatcacgaggcaatcttgctgtctgcaggcttaggaagcaatgcagaagtagcaaggcagagatgatcaggaagtagacagaaatgctgacagatctcattgctgtgtgtttagctgaggagagaagctactgaactgtctgaacaatgatgagaactgagaagtgattagtgaggatgttattcgatcaagtccattgttatatatatacacagcgtccatgtgagacaatcaggcaaataggc

SEQ ID NO: 46974 - DNA, 1501 bp, Oryza sativa
tgttcaaaattgtgcgagtacgaaaattcaagtccgtgcatacaaagtctcagcacattccatatctggacttgaacatgcaaaccacacttcgaatccagtccataaaaagggaatgctctgctacatcaatcctaatgaaaatctacacagctgcacacaattttttttttacaattttcgtttataagcataaatataaacgaaactacggagttaaatgtgatatcaaaacgatgtaggcaagtaggcagatggacaatctagaaaaaagctatacgtactcattttttattactaaattctttcttactaggatatgtcatatcatgagtgtatctagattttttataacttatatctagctaaattaaatggtgaagattattgtagtacatgtaacaatgcttgacacgctacatttatgtacattactttgcgagttgcggtaaagcgccgaccctgacgttgtcagttgccaagcccgagcccacccaatgaaacggctaaaccgcccccgcgcgcgccagcaaccagtcgctcttggctcgtcccctcggcctctcttttggatcgcctaaatgatgcgacactgcgacgcggtgatcgtttacacgacatgaatgttaggtaatgacctaatattaaatacttcctctgttttataatgtaagtcattctagcatttcccacatttatattgatgttaataaatctagatagatatatatgtctagactcattaatatcaaaatgaacgtgggaaatactagaatgacttacattgtgaaacgaaaggagtaattagaagggtgaggctccaaaccaggttatctagcacaccattttatggagctagccagaagacctccggacctttctcgtttacacaactgcgtgctctgaaacagatagatcatagatgttttttggaatacgcaaccagtgcatcattgtattacaagtgaagtcttagaccctgtttagatgggactaaaacttttaaattcctatcacatcggatgtttggacactaattataaatattaaacgtagactattaataaaacacatccataatcttggactaattcgcaagacgaatctattgagcctaattaatctatgattagcctatgtgatgctacagtaaacaatctctaattatgaattaattaggcttaaaaaatttgtcacgcaaattagcttttatttatgtaattagttttgtaagtagtctatggcccagtttggggagcttgtcccagctgcagcttttcccaaaagcggcttctgctagaagctgccccaaataatccacagcttctgttctgaaaagtgaactaagaaggcagaagctagagaagctgggtttcagagcttttccagattctcagaaactggctatcaaacagctgcttctcagtatctaaagctccccaaacaggctctatatttaatactctaaattagtgtctaaatacatagactaaagttaagt

SEQ ID NO: 46975 - DNA, 1501 bp, Oryza sativa
aaaaatcatatcaaattttggtgttaaaacaaactaatcacatgcactgattgtacaattgtttgttgataatgctaattacagtagttagtcttcacatggaatcggcaacttaattagcacataaagtgacaagtaattatttttttttcagttactagactaatctcatgtactagtattggagtattgtttagattcattaatcgttgagtagaatcagcaaacaaatactagcattaatggccaggaagcagcatccgcagggacgtcctccgttggatgagttgaacggtggagatggtctgaaagtcacaccgtgactttaccatgtaaagtcagaggatccgcatccctatcctgcggccctgtcgtttcaccagattttatgccagttcctttcttctacgaggaccatggtcatgtgcagtttcaccacacatgtttcgtattggcacatgcaccggttgcccccctggatcgccttgataatctgcacaagttccaactctaaataagaaaagaaaaaggtgtaacacaagtggctagatcattgcttgtgtacctagaaaaaaaagcaggaaggatcaaaatacatactacaaaaccaaaagggagagatttctgatcaaaatagagctcgactgtccaagcttctgcaacttgcctcaatcatacatcagtgctgatgtaacataccctgccaattggcacgaaacaaagggcaggaccacgttgtttaactgaaccaacaattttcagtttgctcgagttacctaatgtaattttttcttactttattcaatgaattgaatgctgtcaggtgctaatcgttaaaattggagtttaggatgtgttcacgtcaaaattaaaagtttggttgaaattgaaacgatatgacggaaaagttgaaagtttgtgtgtgtagaaaagtttttgatgtgatagaaaagtcgaaagtttaaagaaaaaaattgaactaaacttgcctaatctgaaggccgaaacggtgcgagcagcagcagcaggaggctgacaggtgacagccacagcgccggatacgtggctaggtgaggagagcgtgaggctggctagcgatcataacaatggaaatcttccactaaactatgactaaaatacatattctccaccaagaaggaatcgatgaaatggaagcaggccggccggtgcgatctttggctacatgtgctgcccacaaatacatcggcatggtcgcaacgacagatccaatttggtgcctcatagactaacatatctcgcaactcacatgctttcatacactactgtcttcaactctcgagtacagatctctttgtatcgattgcctatttgcctgattgtctcacatggacgctgtgtatatatataacaatggacttgatcgaataacatcctcactaatcacttctcagttctcatcattgttcagacagttcagtagcttctctcctcagctaaacacacagcaatgagatctgtc

SEQ ID NO: 46976 - DNA, 1501 bp, Oryza sativa
aaaatatatgagggatagatagggttgtgaaagaacccatgggcattgacccattatcacccccgtgcatcaaggggtgaagttgagctgcgccatcaacatcacggcgaggtgactccacaaactcctagtctccgacggctgcattgacacttgtggcatgttcaatagtggcacctactactataggagacaagcttgatccaatcggatctaggggagcttctcccagcggcgggaaaggtgggatggcgggggggagctagcaccaatggggcactgactagagtataccagcaatgtggccgcccacaatgaactaagggtcaacttggaggcataggctaaggcctaaggggcctaaggggactcagggtcaaagaactcagcgtcacaatagcatccgaggatggcaacaacccaacccacaagatgccatttgcttcacttgtgtatccccttgcactgttgtaaaaccaacaatcaattgccgatgaaaccacaaggcatggtaaccgccaagtaggacgatagcgagcctgttggaaagaagaagagagaggatagagtagtatagttgaaggaagaaataaaggtggtcaattccacatgggtccttgtcaatttccacatgggtcattgtggatgccacatagtatagtagtatggtataaaatcaggttgcaaaattgttgagatccaatttacaatggttttagggcctatttggtagacctctggctctagctccacctcttctgaagctggagcccatccaaacagtttcagctccatccaaaatagaagtggagctagctgaagtgttatcacaaaataaactagggaggtggagctgcgttttggctgcttcacaacacctaacttttgaaattaagagttctactccctctgtcccattttaagtgcaaccataattttccatgcccaactttaatcatccgtcttatttaaaaaaaattaaaaacataagtcacgcataaagtattattcatgttaattagaaaaaaatttaaataagatgaacgattaaaattggatatagaaacttatggttacacttaaaatgggacggatggagtaccaaataaccaaacagccaaacaggctcttactgtcgagggaataaatcagacccggccatagttgagggaatcaaaatatactctctcttttttttctctacaacagattgtaaagacatccaaagagggcagaagtcttcctccggcccaaacccactgactttctgagatgaagcccactcggcccaaataaagccccaaccagacaatccttcttcgagacggcgttgcgtcccaagcccaagagcggaagaaagaaaaagtcagccgcttttgactcgtttcctccgggtccgccgctactcctccgctccgctgcctgcctagcctagccttcgccgtcgccgccgccgccgccgccctcgccgttgattccgccgcccgccgcgtgatggacg

SEQ ID NO: 46977 - DNA, 1501 bp, Oryza sativa
gatctgaacaccccctaagttttctttttactggataaacaccccctaagttgatgattaatttattatccatatgcatgttaccacatatagataggtcagcacaactggccttaattaaccttttttatttgttgttgtcgacacaagcagtcccctacatatataatttggccattagatttctacttatatttttatgaaaactaagaaaacatgcagtaaccttcttttatttgaaagcatttcacatgataaatcaaaaatatttttaactacgcctacacgcgtttggcattctagctaaaactatatccatttgtcggtgatatgggaccgggagtatcatgaccagaggcttgaggcagacgcaaccgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgcgacatatatgggataagtgagcacagctgtgctcacctaacagcatttattgcagtctggtcaagcgtgtcacgctgcatgcagcgcagtatggcgcgttcctttatccggtctgtgaccagtcacagaccggtcagatcacgggttaggtggcgactggcggtctgacgcacgccttgccccgtcccgtcaagacgaaagcctctaggcactcgtctcaagccggagttaagcgcgttatctattagagatgacacgttagccccggacgatatatgccaggcttcatcctaaccattacaggcgagatgttgagtgaagaagggcaaacatgcacgttgccaagattacacgcggtggacaagaatgaccgatttgtgaccggtctgacactgatcatatcgtcagcgcacagccatgctcccacgacgcgctcacccccggcggaagtggaggtaggcgtgggctgtcccatcggagcgtcattcggacagcaaccgtgctgatctccgcccgttcaagagaaaaagaacagtccagtttggaaagagaagggtgcatgtggtatccccttgaagtataaaaggaggaccttgcccatagagaaggggctttttgattcttttccagattgtgagcttagaacgggggagaagtcagctcacacttgtagcccattcatacacagatccaccaaaacacaggagtagggtattacgcttctcagcggcccgaacctgtatagatcgccggtgtctcgtgtttctggctggcagacgatctttccacatacagagagagagcgagagcttgagatttcaccctaagcccccggccgaactggcaaaggggggcctgcgcggtctcccggtgaggagccaccagctccgtcatctggcgcgccaggtagggggctcagcgtgtgctttttgagctctcagactcttccgtgtgccccaagtttttcttgttcagcctaa

SEQ ID NO: 46978 - DNA, 675 bp, Oryza sativa
atatatatatatacatatatatatatatatatgtgtatatgtgtatatgtatatatatgtatatgtgtatatgtgtatgtatatatgtatatgtgtgtatatatatatatatatatatatatatatatatatatatatatatatatatatatatatatatatatatatatatatagaaaaatcatgagctatagttagaagtccgatcatctagttagcatgcgagttttttttgacagatatattatataattccttctgtattactaaaaattgaaggatcttaaaaaccgacccaaatacgaatgtgtatttccaaaagcaaacgaacttagaaaccgactcatacacggatgacgtaccaaaatatcggcaaaaacaacttcaatttttctaatagtagagataggatgcacatatatggatacgtcggtgtcggtcaaaattagatggcagaaggaaaaagttatagtaaggctaaccatgaaaatacacgaaccatttgatcattgtacatggagataattaaggtgctaagttgctaacagtggcaagtaatcattactcactccaaaaatacattaattaggctatgtgactaatataccaaaaaatttgcaatgttttgacttttcatggtttgagatgtgactttgaggttgacttttttgtcga

SEQ ID NO: 46979 - DNA, 160 bp, Oryza sativa
agcgggatagacgaacgcgccacgccgcatttaatgcggcgcagcgcatgcttatccggtccgtgaccagtcgcggtatgtgactggtcacagaccggtcagatcgcgggttaggtggcaacaggcggcctgtcgcacgcctcgccccgtcccgtcggaa

SEQ ID NO: 46980 - DNA, 190 bp, Oryza sativa
agtcagatgcagtcaacgatgaacgtcaaggctgaccaggttgatacatgtaaagccgatgacgtacatgcatcattaagagttgggtgacaaacacaaatcaggtttatcgttctaaattttcttatataaattagaattaattcacatgtcactaattattatttaatctattattttatacatgtac

SEQ ID NO: 46981 - DNA, 1501 bp, Oryza sativa
gttggggagagtggaagcgggaagtctacggtgatttcactgcttgagaggttctatgaacctgatgctggcaggatcctttttgacggtgtggagcttgagactctcaaagttagctggcttcgtctacagattggccttgtggcgcaggaaccggtattgttcaacgacaccatccgtgcgaacatagcttatgggaagcaaggtgatgcatctgaagaagagatcattgctgctgctgaagcagccaatgcgcaccagttcatctccgggctgcctgatgggtacaacaccattgttggcgaaagagggatccaattgtcaggtgggcagaagcagcgtgtcgccatagcgagagccgttataaaggaccccaaggtgctgctgctggatgaggcaacaagtgctctggattcagaatcagagcgcgtggttcaggaggcgctggaccgggaggtggttggtaggactaccgtggtggtggcgcatcgcctgtcgacaataaaaggagcggatatcatcggtgtcctcgaaaacgggacgatagtggagaaaggcaggcatgaagaactgatgcagataaagggtggaatatattcttcacttgttgagcttagctcaagctcaatgtaacctttctgaaagccagaaaaccactcttcttcaattggacactgatttagtccctgatatggattgttggtttgcattccaaagttttatatatgtatgtttgtactaggaaagggttgttccttatgctgtctgttaatgcgcaactaccatggaagacatgcccagtttgtagtttgtaatatttaaattttgtacaatgtgtaccatcaactcagtatatatgaatgttcaggctgtagcctatgagcctatttggttgtgaatgctttttttaaaaaacaaaataggtccatgcagcttttatttctgacgtaggttgaatcaaacgatctattatgggttatttccggactgtgtatcaactacctgtgccaattcatggaattaagaaaaaatggcacagcccgccttccatgcttaacccataaagaagttgaaaactgagaaagattcatgatatatattgagttgagcagattacggagttgaaattgaaccaaatttggatttggtatgaccgtattggttaaagtaattccctatatctacaaatattcaaaacaactaacttaattaggactaacatctggtataagtaagactactaactcaataaagatgacttctcaataaaatttcttttaaaatttgtaaacttcattgtactgattcttccatatagtaccacatacgagtcatatgacacgtgagtttgatggtgaatgctttctatcggtagcgcgagggaagagaaaatggaaggcaacttaaccactatatgctatacaactacttttttttatctatgtatttatttatccatatatgtgtgcacatggttgtcttcttaatatttttcttctca

SEQ ID NO: 46982 - DNA, 1501 bp, Oryza sativa
tggccaaaggattggtgagcaggctagtgcctcatctagtgttgatgttgattcagtggtgtgcaagaactgcaaacgctatatatccaaccgaacttcactacttcatgaagcatactgtgtgagacacaatgttgtttgcatgcatgatgggtgtggtgttgttcttcgaaaggaggaagcaacagatcacgtgcattgcaacaagtgtgggcaagctttccagcagagagaaatggagaagcacatgaaagttttccatgagccactacaatgcccttgtggggtggtccttgaaaaggaagatatggtatgtattttgccttcgctacttatattctttgaacattcttcctaacttctgaagttcttttttactcgttgaatcccgccaatgatttgagtacacccagtttaccaagcgtaatattgtctttacttctaaacaaaatgattgcaatacctttttagatgtaataattttatttgcatgatatatttttattgccaatggttagttttacgagtattgttcctcactcaatacaaacagtagagaaactgcctaccagcttttgtttcaaacagttactgtaatttactggtaatgtaatattggaagtcacatgactaatttattctgttcttaaatctcaggttcaacaccaatcctcaacctgccctttgcgcttgattgtgtgccgattttgtggtgacactgttcaagctggtggagaaccacttgatgctcgggatcggcttcgcaacatgtgtgagcacgagagtatctgtggatccaggactgcaccatgtgattcttgtggacggtcagtcatgctgaaggacatggacattcatgtgattgctgtgcatcagaagagctaactattgtaaagcattggctctgagaaagatggcctgtcctttatcctgctgggctttaaccaccaaggccatgaagtttcagcactgctggaccaaatgttatttccttttgtgttacatatatcttgtgtcattggttaaattgtaacactgcgtatgggagcatggaacactggggcggtgtatgggagtatggaacacagtggcggtgtctccttatgtatacacaaaccatctataatatttgatttgagctttctcatattcaggagctttattagaaactttcatttccgtgtctatacttccactgttttatcattagggcttttttttttttggctccgatggataatgataatttcgttgcgtagtgtttgcacacacgatgcatttgaatggaaaaaaaaagttgacaactgaacaaattttcgctgaatcaaaaaagtaactaaattttggccagagacatgtcctttggctatggggacccatcgactcatcgagcatcgatagaccaaaatttgagaattttggcctaaaattctctctatattttatattataagctggtctaacttctttttagttaaactatttttttttgtttgatcaa

SEQ ID NO: 46983 - DNA, 172 bp, Oryza sativa
gaagtccgaacccttctattcagacttctcttcaaaatcctcacccgcatatctcgtcaagtagtcaaactcaaactcccaagttacactctctttctctaaattatccatctccctttgactcgtctccgaatattgttctcttccttgactcctttctattctcccaaga

SEQ ID NO: 46984 - DNA, 1501 bp, Oryza sativa
gccatcactcactgttctaatggccccaatggtttgttcgaccacgattccagcatcaccatattttgcttgcatgcggatggtcagttttaccatcaaccttgacataattgcaccagccacagcaactggaggaatgcttgaaagcataacaagtgccaacagccatcctctcacaaacgcaataatgaagcctccaaagaaagtagaaagcagttggatgcacttgccagcctaatagacaacgcatgtataacaaaatttacatgttattatatgctaatagagaattagtacatgtacatatttctcattgaagcaggataatgaaatataatgcagtacttggcaagttaaacatatgcatttcccattgactgaacccaactgcatttatggtctggaaaatccatcaactgggattttttttttaaaaaaagaaagattcattgaacttataatgctgatacatataatatgtctttttgtctccacttgcatacaggcaaagattatgcatcttgactattttttactcctacatagaacatatatgatgcatgaccaaagagttacttgagtcaagcacaaactcatattatgtagttagaacaatgtatgtgcgattcacacagttgactgtgacacatgaaaccaagttatttctctgaactcctagattctttttagggctctgtaaactcctaaatagaccatgtatgatgcatgcaattgggtatgggctacagaaaattgactacataaatttcaattaaaagggattcgttgggtcttctttcttcagttactaaatatttgtacaaaaccaaatcaattgtataggaaatattgtaactgaacttctcaaaagaactacttttggttaatcaattagattacacactgaaaacaagcctaccttttctccaatggcatcttgaatgaggaatgcatctcctgacatcctctcaactagttgcccagtgttcatttccttgtcaaaaaaggcaatatcctgcctcagtattgctttgagatacaacgccctaatccgtgctgcctgtctctctccagtgattgtccagcatgatacttctaccaaattgtcataatgaatcaagtaagcattgtttctaataatatttccaataaaaagctcctgacaaaagaactgcaagtactagtagcacgttgtacatttttattctccaatttctatatcaaaagataaaataaatttctatgcaaacatagatgtttaagatagcctattttcttgcataagatagacacttacgaagtgctgaaacaagtcctgctccaacaccaagatagataaaattcatgatcacctgaaaattaaaaaaaaagagtgatttaattagcgattaagaaatttaaaaatcaatgaaaaaacaagcacagataattttacccctgtcatacaggctactgctctacatgaagacgtattcttctgaaagaatagttgccacttagt

SEQ ID NO: 46985 - DNA, 437 bp, Oryza sativa
gatggagggcttggtggcgaaccctttggtctttgtcgctggcttcgcccaagcacttcaccctatggcttcgctaagaggcaggtgtctgtgaaatttcatttttgctttcctgggcagctgccttaagaggccagcggtggtaacacaactttcgcaggctaagatgccatgtataaaaatcggtttatatgcacatgcaactcagtaagggttgtacctccctggtgcaaaacacaattgctgcactatttgtagaaaacgataagaaacaaaagaataaattagcggtgatgctctaccaatttgggaagacgtttttttttttcaaaatgaagatctgaagaggaattgtatcctgatgcattaatataaattttaaaatatggaatgtttaatgcctctaacacacgttcacatcattgtcatgtgccata

SEQ ID NO: 46986 - DNA, 1247 bp, Oryza sativa
gacttaatattgatgagatatatatacatcatcgagtgatgcaagtcaactagtgtctattcgcttaattggtgactcatcagagcctgttcataacgggtactcccccgttctaaaatatagtaacatatgacttattcaagaactacgaatttagacatgctcggagtaataatagttattagtatcggtgcactgtacaatctacagtaaatggagaaagatatatcagggagaaagatatattgtcgttccaaaagctgacaccggtacttgctccgtattaattagtgtcagatcaagaaaaacgacactctactatactccctacgtttcataataaacgaatctatgaccatacgtgacatatttgatatattctagttctataagtctagagatatatacgttcagattcataatactaggatatgtcatatctgatactagttagttttcatagactgagggagtactggatgtgacacattatagtactgtctagattcgttgtactatgatatgttagatcaaattttaggttcattatttttttttgacggagacagtagattcttcccatgaacccatgaactggaatcaatatcaagtgcagttagttagtgactgcaagttaagcagtcatatccatttacagccgttggatcaaagttgatgaacggcagagagatatgccacgtcacaacctggctggcagagctaagtacatgccacagtgcgcaacaggactttatgtgcgtgctacagtaccctggccgaatctgagctgttcttatttgatctaacggtgaggcaacgactgctaaagttgcagtccctattacaactgcaggggatcctgatccgtaagaataaatctgaatataatgcacgtctagatacatcccttgggttaaactttatttttggcacaaagagtatcacttatgcacattgccactacaatcattgtccgtccgataagaaattaatggttccttttggcagatgtgtgggttctctgccataacactagatactgtatcattgattttcctcgacgtcacctcattttgttttcatgcggtccgtacgttgaaccgcatgaaaaaaatggagggaccagagccgggtcgtcgcccgcacaggaaaatcaattttcgtgtgcaggtcatttaacaggccgctcgaccttctcccctcctgacgctcgcgcgaggcggccgggagcggcagcgccctcccca

SEQ ID NO: 46987 - DNA, 403 bp, Oryza sativa
tgaaaatatcttgaatagccgaatatgacatcttctaaaagtcaagccaaggatggaaacaaaaaatttcactggtgctactatggactatcactcaggaattccagtttaggtggtggttacacatacactttatggctttcccctatttttaaagggttaattggatatatgatgttgcaaatttgcctattcagaaaaataccactacaattcgtctattcgtagcagtgccattaaaattttacaaaattagaaccgtgccactaccgttacattttccatccaactcctcccttttccatcttattccttctttctcccgtcttctttcctcctccgatgccggccaagcccttctcgcttcttcttccttctttccgtcctcgccgccccgcgtagc

SEQ ID NO: 46988 - DNA, 1501 bp, Oryza sativa
aaatttttattcatttttttctttctagtatatgtaaattaagggtaaaatggacatttgctaatacaaatgatgattaggatcggccgtgtggtacatcaagtgggttcaatgataattgtaagtcaaaatagggcctttggtaaaacttttgggattatattggctattcaccaattgttttaacaaactaaaaaaattagggtgcattctaaatagagattggaaagggttgattagcctcacgcataatgagaaacatgattagcatatgattaattaagtattaattattaaaataaatacaaaatggtttcatttgatttttttaaagcaacttctatatatatatttatttatttatttataaaacacaccatctggtagttaaaaaaaaagtagccaagctgacctctactttagaacatggcctcagcaaacgattatttaacctaggggtgggaacaaatttagccctgtgaaagcatacttagggggtgttgatccataggtgtaaagttttggcgtgtcacatcggttattatgtcgcatggggtgttcgagcactaataaaaaactaattatagaatcaatcagtaaaccgcaagaagaatttattaagcctaattaatccgtcattagcaaatgtttattgtagcaccacattgtcaaatcatggaacaattagggccctgtttagttccaaagtttttttttcaaacttccaactttccatcacatcaaacttttcatacacaaataatttttctatcacatcgtaccaatttcaaccaaacttccaaacttcagcgtgaactaaacacagtctaggtttaaaagatttgtctcataaattagtcgcaatctgtgtaattagttatttttagtctatatttaatacttaatgcaggtgttcaaacgttcgatgtgacaaggtgaaaaattttgaggtgggatctaaatagggcactaaggtggtgttcttttctcctgaagatgaagattattatttttatgcataacgaggtggtattaatgtataattgattgtgttttaatcactacaaacttgaaaaatagattaatatgatattttagagcaacttttatatataaattttttacacaaaacacatcgtttagcagtttgaaaaacgtacaacgaaaatttaattcttcctccaatttttattggagaaaagaacgggtgccactaatataatgccgatgcacatgtcaattcgaggagcacgaacgggtatgcacactttttagcacatgcacacaaaatctttgacatgtcaacgagccggccgcacgttgtctcaagtactgtatataatcctcccgacatgtgctagtactattactatatgcacgccctacacaatgcgccggtaaaattaactgaagtcaacatgtcgaagcagctagtactccgtagtagaacgtacacctacagaacagaatccaggtgaagtacagacagactccagaacca

SEQ ID NO: 46989 - DNA, 188 bp, Oryza sativa
atgtgaggtatctattttcacaggtgggctagaaaaattcacaggtggtttaatctgacatgtaaaaattgattttctagatggccactaaaaaggtctgcctataaaaataggccatgtgaagccaccatttgtgtaatacaattttcacagacctatacaaactgtgtgttgacttccccaatagg

SEQ ID NO: 46990 - DNA, 177 bp, Oryza sativa
ttcttactttcttttttttctgcaaaaacaactcaaggacctcaatgcacgattacagggactcaaatataaataaaaaaattacaggaagtcaaatggaaaagttccaaaccgaaaattaaaattatacaaaaaatggaatgctaaatttatactggttccgtttttccaaacaga

SEQ ID NO: 46991 - DNA, 463 bp, Oryza sativa
ggcattttttcagtatatttaaatatattaaatgttgaattgaaaactaaagtatatggtatgatatatgttgtatggccgccaagtgacaggtagcgaagaatccaactaagttgagtattatccttgcatgttaccgcttcctaacctttttttacatccaaacataaccttttttttgcttgttgttatcaatacccgttacttatatattttgttagatttttcttcttatatgtttaggagaactagtaaaactatatatggttcaataccatttcttcatatgaaaaaaatattaatatcattttcacatgatagatcataatatttttattatttacaccattatacgctcattctagagttatgtctagtaagaaccgttttttttgacaaattgacccttttcaaaaacttatttcgaaactaacccctgccaaaaacttcaaccaaaactagg

SEQ ID NO: 46992 - DNA, 1501 bp, Oryza sativa
tagttccgtaccagtgctttggagtgacatgcatgtcattgccacatgacttgccagcgttcgatcagtacgtagttgccggaacgtacgcatccatgcactgatgcacacaactggagaaggctagctgtatcgtacctttgcaccactgtcactactagagaaacaattttttcatttatacggtcaaaaccgattttcacgagcacttggatggtctgtctgtacccaagtgtcttctaaaatcagtacttctacatgtgggtagaacaaacgcatgcgaaacttcatgtgggtgcttaagccgtctgactgcaaaaaaaaattcccacaaaaaataatccaaaatcctagcagctcccgtgccggtggctgtcaccgctctcgtgctcagggtttgtcctcgctgtcgcaaatgccctcccccactcccatcgccgcctctgatccatgcgtatgggagggggagagcccatcggatccacctccactgagctccgcatcaccggatccactgctgatgtgcttcccatcggggctcgttggtggtgagctctggtttgatgtgttggatgtatactccaggcctcagctcattttgcacgtgagccagcttaagctagcttgttatttcgaacaagctaaaacaccagctcggcttgttagaaaaacgcaacgagccaagtcgagcctagtcgagttggtcacgagtcaagccaagtcaagttggtcacgagtcgagtgagctaacaagccacgagtttttcgtccacccctacccaccgttggatccaccgcggcagccgccgctccctactgccggatccgttgccgctgtgctccccaccactggatcccccatctccgagcaaccttttgtcagatcctccgccaccaagctcatgccccttcctgttcctgcctactgtcagatgaagtggtcatcggctgctcccgtccactgccggatccctccagcattgatcgcactcgcgtgccaccggcggagaggaggaggagaggagaggtggagagtaagtggaggatggagagaatgaggagagagaggggagacttgataatttaaggatgggcttgatcttgtgggccggtggcatatggacctcttactaagaagtcatcttaagagacctacaatgcaattcttgaaccgcgttcgggaaagtgatttttcaagtgagagcaattttggcttgcctacaccttaaaggggtcttgtctgagaattttgattttgtagtagtgtgctataagtacatgtgtctagctttttcgttccaaaataaataaacttagtatggatatatcacatctaatttttttaaaaacggatgaagtagtctgtactctgtactctgtacacctacttctatcagctgatcagagtcgatcagagagacaacgcaaccaaaattccaacttgtcatccatgcatgcatcctccacgtagctagccctatactctaccttaaactctcca

SEQ ID NO: 46993 - DNA, 1501 bp, Oryza sativa
ccataaggaaaagagcaagtgcaggaaattagagtagtagcaacagcatggccatataatagcagcaataagagcagtagcagggccatataacagcagtaggggtatatatgccacaggggcagcaacagcaaggggagattcacataaacagcaacagtagggtggaaattcacataaacagcaacagcagggtggaaattcacataaacagcaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagagagtgcacaaaatctgttcttatgcataaaaaaagaacaagtgtagaggtatataaccactgaatcaatcatgaaaatttaaaaaacagcagcagcaagggtacagaatttgcatgattgacataaaacagcagcaggaggagtataaatgcaagtccacaaaattcaataggtctagcaacatatatagcagtacacactccatgaatggttatatgtccaaatggcacttaaaaccacattcaagttgcacttaactaacagttgcaaccataggcagcagcatgggcaaacatagacagcaagggcaaacatagacagcagcagttgcacttaaatccacattcaagattcactgcaccaaaatcatgtaatacggggtatactatgaaagatatggcctcagttttgctcagaaatatgcatcaattatattcatttgcatgaagggataaaaagaggaaatcataacatcaaaagagcaaatctgttcttatgcataaaaaaagaacaagtgtagatactctgttcttatccataaagaacaagtgtagaggtatataaccactgagtcaatcatgcaaatttaaaaaacagcccacaataagggtacagataaactattcttattgagcaattcattacttattgagccacaacaggggcaaaaagaagaatagataaaaaaatgaacaagtgtagataatctgttcttattgagcaattcatcactggccatttatcaatccagaagaaaagagcaagtgcagaaaatctgttcttatgcataaaaaaagagcaagtgcacaaaatctgttcttatgcataaaaaaagaacaagtgtagaggtatataaccactctacactggccatttaataaggaacaagtgaacaagtgtaggggcagtagcaggggtgtagataaaaaaggagacagtactactaacttcatgtaaacagcaattcatccattcaattcaagcaagtctagataataaaacagcccacaatcattgtggcagcagcagcaagggtatataaat

SEQ ID NO: 46994 - DNA, 1501 bp, Oryza sativa
tcgagagttacaccaccgaagaggccatcgaattttgcgtggactacatgtcagaaacatcttcaattggattaccacgatctcatcacgaagggaggcttgacggtgttggtactgttggaagaaagactattaggttggatcgtaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaagctttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccatggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctaatatgttcggaatgatcaatagtatattgcttatgaaatagtcaaataaaataattaagtgaaacacccactagaagtgaaataaaataattaagcaagtattagcattggaaataatataattaaagtagtataataatgaagtgcaattactactgttaatgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgctgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgc

SEQ ID NO: 46995 - DNA, 1501 bp, Oryza sativa
tttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtccactcatagaatcatccattagctgtcacgaactgtcggagaggtgtagtaggaaggaagaattgattgaggaagacgtggaggggggcgagggagtaaatgatatggcggatgtggaggtcagggaagagaatgacccggtaaaggaggaagtacatgcagaggagaatgtgccgttaagggaagaagtacatgcagaggacaatgtgccgttaagggaggaagttaatgtggaggagaatgtgccggtaagagaggaaggagatgttaaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaagatgtcagagcatgaaaggactgtgtttgcgaaactggtgggtagaaacccggaaataacataattcgaggatcttaccagatctgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactgtggcttgtctcgatcgccattgcaaatggcagattaatgcaaggaaaagtggaggaaataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcag

SEQ ID NO: 46996 - DNA, 1501 bp, Oryza sativa
gggaaaaatcttgtcgcttgtttaagtgagattttttcaaaacaagtcagtttagggttttagtaaaattattgggatttattcgtcagtcagttggggtttgatgggtgaaatgcattaggtcctagctctataacatgggttgcaaggtatttatgctttgtttgttattattaaatatgtatctaatttcccattattttgtcgttatgtgagtatgtcttatttattcgctctcatgcaaaatgatctatgcataaaattccgctcttattcgattctcttatttgagtctttaattgctttatttaaatttggatttgagcatgcattgatcctactcctttgtcttctctagatggccggtcacccacccaaccaccgcggagaaggcatgatcgactttgtggcagagctggcacgcatgacactggtggtgggctaccccaacgcgccggagtacacgaccattccgccgctcagtggcgagcttcctcaccgtgtccgcttggaggtccatggctacgtggggacttgccttgctaacatggcggttgaggcgtcagggggcacagcagatcacgcttgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccacctttggtcacatgtgtgctgtgatgaggggattggacaggatgcactcggacctgcacaaggcgaccaaggccttgaacgatgggaagctcatgaggatcgtcgctctgaaggacgagatagcgcgcctgaagaaggagaacgctcagctaaagggtcttccagcgccaggaggagtccggatccgcaccacgccccgcaagacgacgactgcacctgtgcgcatccagcttgcgcccaggaacccacctccaccagcagctcccgcagcaccttcagttccgcccgcagttcctgcagctccagttccagctcccgcgttcactctctccttcgctccagcatcagccgccagaggttcagccagtggtaccggaggttggctgtctgctactcccagtggcagcggcgagactgatctgtcaggctccaggagtcgctcagagggaccgggtgacgagcaggaggacgctttcgactccaccgaccgcaggagccgttccgagcattaggctcgtttttcccactagtttatcgatggtctagcttctggttgttagtttgcgtgtttaggctgcttgtttggggtcagttgacggttgatatcatgtgcctatgatatggctgtcttaataaggatgtttgcttgctcttttaagtgtttttaattcagatcagaacaattgcagttttaattcctttgtaataaagcttagttcttgagcatctgtttttcttcttttcccccatctgcttttccctccaga

SEQ ID NO: 46997 - DNA, 1501 bp, Oryza sativa
gaatcttttttgttttgtttttgcaaacaaaatagggaaattttgctgtatgccactcggaaaagctctcccctttgggactctgctgcaaagtagtaggagtagagttcttttattttctgatatgacaaagtagagtactattaccgcaactaatctaagattattgtctttcttgtttaactgttcatgtgctaaatcccaactgttagcacaaaatagtactactaccagatgaactggctttggcttccaccgcaattttcttttgctttttcgctgtcaatttcacaaattaaataatggtagaagatatggctttggctaccattatactactagtagtaatgatcttatgatttttttcgtccagttggcaaattaaagttagtaagaaacctgcctgcttaatgctacctttaaatgcctgccgtttttaaatttaaattacttttctaggctggcgtttcaagattttgtttttaggaaagctttaggcttcaagcggacgttttttcaattcaatgaatttatacccaagttgtgatcttttggcctgtcccgatcacacggctgatattctgcacctaaaaccaaattttgttttcttactcgcacatgtgctacaataatactaattataaggactgttggattatatctaaccatccataattccagtcctgttgcagctcatatagttcttttttaaaaaaaatgctggaggtccaaagttcgtatcagcctaatccattgagcatcgcagagctgatatgatgggaatattagtggtttctcttctggttgtcaaatataattttaggaataaaatcaacatttacttcctttctgtagctgtcagtcagataggattgctgcacctatgctcgagttaatgtacgttataccatgcgaaactctgaaagtatcttatcaatgtcttgcgatcctcttgacaatattaacccctgaatcagtatttttaaatgggcattttcatctgttagatctgcttgttgtctttgtgctaaaaaaaatcaatttggtctgccgttattgatgcgatactggaattcacacaaaacatacctttgtgctgaagaaaacaattgaggcagtcaccattgatataggataatggattcaaacaaaacatatcttggaattacatacctattttacatgatcttggtgctaaaagggttgaacataattgtggagttaaacctcgattcaagcctgtgcttatatgggaatcatactatgaatcaaactagaacttaatgtatgatatgaaatttccaagattggtggctatacccctctttacattgtgtggttgtgttccccactcaacatgtcacattgttttgctattttgttcactaattttatagtttgtttaacataaaagtttgttccctgtaaccgtagtattgttttcttacatctttcagctagcatctgtagtaattctcgcaagttatttgaaggacaaata

SEQ ID NO: 46998 - DNA, 1501 bp, Oryza sativa
ttatacagtttatagtatgaaagttaaaatttacttccacttaaacagatgaccagatttactaacatttttgacaaggaaattcctacagacatcaagaattaatatcaattgcacgaaatgcatgatccccccccccccctcgaagatccctaatacacgtcccttcccgaaatctgaatctggatgagaaaacatttcgcaatgaggaaacatttcacgaagccagcgggaagatttcgacagccacagagacaacatctatacagttgctcgtccaaaaaacatgctatacacagttgtattctacagtttcgctgtccatcagcatattatcctcatcggccctactgcagccaaccagccactgcatggccaaaactagtgctcttgccatgaaggtgtccaaggaccggccggtgatctgtatttctggtccctttcgttcccatgacctggaaaagaatgtactggattaggagcagctaaggtgtctactgtataatgtactatcccggccctatgctaactcacaacccctaagttgtcttgatccatattttttctgctggcattagaaattaaaagaagctacaggttgaatttccattgattgaacaaagaaaaaaaacacgaatattagaaaatggtctaatatcaaataaatagaaattgtgaggcttctaacccaggcgggccaacccaccgccctataaagctagtcggaagaccctgatgattttcttactgatttaagaaagaaccaggcctgatcgagatgtgcctactgtctattgatcagcagcgatatttctcgtgctaccttgtggactagtcaggagtgttcatcagtagtaactgttggattgtaatcttgagcatttatattctgttttgttttgttgcatgtagagttcggttggagtctgaattctggccggtagaatagcattttctgttttagcatatttgcttcattctttagctgcgatgactcggctcggatcgtgggatggcgcggtgagtagttgatccgagattgtcgtgattctgttatgcatgcaacaaactccgtgtggagatgaataaatagaagagaaaaccggaaaagctgcacggcattacgcagcgaaaactctgttcgtcagttgttctgttctgctctgttttactgaaaaattgttcagttaactgtagctgcacctgcaagcgtcagtgtgtgtgttctgtgagattgagagccagttcgcatgagttttctgacatttggtatcagagctttgctgagacgatccggtgatgtcatacacaccgcctggccgccgtggtggtggcggcggcgggggaagcggcaacggccgcggcagcgcgagcggcagcggcgtggggaattgcgcagacggcgcatcactcccgctagtgcctcaggggagagatgctgggcacactgcccgtctcccgatcctgtcgaggacaaattatccggactgggcactgttga

SEQ ID NO: 46999 - DNA, 1501 bp, Oryza sativa
  unsure (1)..(1501): unsure at all n locations
cttcgtcggcgaggggggtgtagaaccaatcgctcttccagtcgtcccactttttacggaggacgcagggaatgtagcggttcagcacctgcccccgcggctggaagtagcagccaccgactaccgtcggcggcgacaccggctgtacggtgaagaaccaccggaacagccggagagatggacgcaccccgataaacatctcgcacaggtgtgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcaccggaaacgaagagttagagcacaagtggcgaaggcaaggaaaagagtggcgagaggaaagaaacgaatccctccctcggcgtctttacacccttgccaacgctatgcccggctcctcgattcccgcgcccactacctcgccccctcgtttctcgcgcccacgcctccactaaccccgctcgcccgtttgcggcgcacgcggcagatgtgcggccgtggcagtcgagatggggcagatcgtgcgcgcattaactacgcccgccaaccgtgaaatgcgccgtcatcatgtctccaggcgaaacaaaccggctcgtcccgattcgcgcgctgctcgagtaatgtagcggtcttaaagaggccgctcattattgtcggtcggttttcccttgccgatgctcgcgatttgcgaccgctgggtttctgcccgcctgtagggaccggccccacctgtcaccgggcctaaggagtggcatcatgcccgagcgcttccctcgaggggggcgatcgccctggcgtaacgccgggggctactgtcggtgacatggggccgggggtatcgtgactagaggcttgggtagccgcggtcacccacgttgcctgacccctcgggggggtcgggcccgaaggtgacgtggccacccctccctctgtctgcccgaggggtcgggccgctcccgttcctgccccgagggctggggcgccccgaccccctgtggttttggcgccacgtgtgtgggttaggtgagcccacngggctcacctaaccgcatttatggcaggttggacgagcgcgccacgccacatttaatgcggcgcagcgcacgcttatccggtccgtgaccggtcgcggtgagtgaccggtcacagaccggtcagatcgcgggttaggtggcaacaggcggcctgtcacacgcctcgccccgtcccgtcggaa

SEQ ID NO: 47000 - DNA, 1501 bp, Oryza sativa
aaatcattgattggatattttaaatttacatttgtgtaaatttgaagattattatattttatccttaaattgttttttaggggtattatccctaaattgtagaaaaatcttttttaaagacttccgattgttttactttatcataagtacttttttttcccttccgtcagacgatatgtaagcattattgttttctttcaatcatctctatgtacggagtactttttccggtcaacagttatatatttttcatgtatccgtatataggagaattgtattatttgtcaataataaatctaatctaatggtgtaaaatgaaacaactaaattgtgttgttttcagttttacaaatattgatttaaattagcgttgtatattcgtcaagtgatatttgacaaaaaaatatcatagcattaattattatatacattagtcttgtatgttaagatagaacgaataaagatcattgatgggatatttcatatttataatataaatttagtttaactacgtatatttacataaatttgtagagcaatatatttatctttaaatagtagataatactatttcaaaagaccatcgatctttttccaatgatacatatttttttattgtttttatagtaagtgattttgaaaatactatttcagaaaaccaccgtgagtagatattgaaggacagtaggtaaacttcttttcttttcccaggtcatatgcacgtactgactacttatatttcccgtatacatacacagagttatatggtgtttttaaaataaaatacatctaatctaatggtctaaaaatattgggttaccagatttaagtgaaaatcgacggtgatatttgcttaaatttatagagtaatagattttatatttaaatagtagaaaactccattttaaaagataattgatttttttaatggtactatgtatgtatattttttttagctttattgttttctatagctgtgcgtagttttttttaataaacaataggtaagattgattgttttttagtcttatgtatgtacgtacctatatggagtatatacttttgtttttgttttctttttctggtgaacagtaaggtattagtttatttttaaataaaatacatctaatctaatcgaatggtctaaattattaggtccacttatttaagtgaaaacgacgatgagattatgtgttttctttctttttctagcctaacagttatatatttctcccgtttatgtacacagagtaataaggtattagtttttaaaataatatacatctaatttaatggtttaaaatattagattcacccatttaagtcaaaatctatagctatatttgcttaaatttatagagtaataggttttatctttaaatagtcgaaaaaaatctatcttaaaaataatcaatttttattggtagtacgtacgtacgtttttttttttggctctattgtttttttatagtaagtctgtgtgtattttttttccttacaa

SEQ ID NO: 47001 - DNA, 1068 bp, Oryza sativa
tttttttaaaaaaaataccaaaattacccttagagacatacatggttaacaattaatttatcttgttagaagttaaaaaaaatatgaatttttttatatggcatccttacacaacagagaagtatgtacataagttcaatttttttttggtatttcttttagaaaaaatatttttgtgtggtatatcagagagaaatagcttacacaaaatataatagcaaaaaatatcttatgtttcatttgaaagataatttacattaaaaacaacaacacaaaaaatattttatatggcatataacaaataagttatatttaaaaaatagaaatgaaaaaaattcaaacttttatattgtgtaaggaggctacataaaagttttcttctttttttaaacttctaatgatataaatcaactgttaaccttatatctccataagggtattttaggttttattgaaaaataagccaaacccaatgacgtaatctagaaaaagaaaaaaatcagtggtaaattgttgagctatgataaactcagtgatatagaatagattctctctcaaatatataagaaataaactcagttaaaagtctaccccaataaacataaccttaataaagaggaccataggcttatatatggcgctccaaggtggaaactggatctcgatcagatcatcttgcatttacactaatgatttattttgccattcaccacgctttctacttcctagcatatatccaagcatgttaacacggtgctataattcgattgggtcataggtgattctttcatgtaggattaaccttagactattcacttatagaacagtctatgatcttttcctcacaaaattacctttcatcatagtgtatatccattgatgaaaataacttgcacaaattctcgaagcctaccaagccacaaactatattaattgttggttaactaacgatgaacacattgccagccaagcgatgaagaagggactcgttacaaatctaggagacgccccatgtagcttagctgagtgcttacgcacgaacacatgcatttgctcattgctgcaaca

SEQ ID NO: 47002 - DNA, 1501 bp, Oryza sativa
  unsure (1)..(1501): unsure at all n locations
ggccggcgccgggcttagggccgcacaggataatgcattatcccgtgcagcccacgtaaaccgaccgcttgcgatggtcgggaggctacagaagcccccagcccgaccattgtcatgataatccgacggttttctctctcctaaacatacacaaattaggggagaaaggttttagatctgaaatctttgattgggttacatataaaaggtgtagagcttgttctcctccttcatttgcttcttttttgtcagttttcatcagtgcaatgcaaagaaacttgcacttttataaatggaatagtgtaggcagttgacggagcgtggggctcctcaccgggagaccgcgcaggcccccctttgccggttcggccgggggcgctaagtgaggttcttcgccctcgatctgaggaacgtcagcgagaaaggaaatgcgcaagacacgggcgacgtagacaggttcgggccgctgagaagcgtaacaccctactcctgtgttctggtggatctgtgtgtgaaggaatccagagggcggagagcgagagagagttcaggctctaggaaccattcgccagagtcccaactccccctcctttctttcccccccccttctcttttcttaggcctgggcctcctttttatctggtcaggcgtcaccacatgggcctctagctgcctaagaagggaaacatgctttttacaatcagggctaatctacagccggaaatgacttctgacaagcagagcgcacgtctcctgccccgctcgcccgcttttcccggtggacgcccatttcaaccttcatttaatggccagcgacttccttgccatacttgcgctgaagcctggaacgaatctgaccgggactgacataccaactcctggagttggcacgccggctctggctagggacgagagccaggaagctctcatcattccgacgggacggggcgaggcgtgtgacaggccgcctgttgccacctaacccgcgatctgaccggtctgtgaccggtcactcaccgcgaccggtcacggaccggataagcgtgcgctgcgccgcattaaatgtggcgtggcgcgctcgtccaacctgccataaatgcggttaggtgagcccngtgggctcacctaacccacacacgtggcgccaaaaccacagggggtcggggcgccccagccctcggggcaggaacgggagcggcccgacccctcgggcagacagagggaggggtggccacgtcaccttcgggcccgacccccccgaggggtcaggcaacgtgggtgaccgcggctacccaagcctctagtcacgatacccccggccccatgtcaccgacagtagcccccggcgttacgccagggcgatcgcccccctcgagggaagcgctcgggcatgatgccactccttaggcccggtgacaggtggggccggtccctacaggcgggcagaaacccagcggtcgcaaatcgcgagcatcggcaagggaaaaccgaccgacaataa

SEQ ID NO: 47003 - DNA, 864 bp, Oryza sativa
ttatgataataatttcacatcacattttagtgtaagaaaccacttgacgaatatataatgctaatttaagtgtacatatgtcttatccaaattactaaaggtgtctcatgtgattagaacaataggggctgaaaacaaaacagacactgaactaacatgcactaccctatagatatttgtcaaagtatgataccgtactttggattatcgtgatagtattttaaaaaaatcactttctctcagttacatataaattcttctattattttggaataaaagttaactccttccatttatgtgacggtggtaatataagtaatataagtctatgtttgattagatgaagtagtatcattagctatatttttaatagtaaatatctttcattaatatatagtaaaattaaaatgttacttaaagtcatctataacatacacaataaaaaaagttatataaagttgggaaactctagaaattttaaaaaaagaatcacacataacacaaatagatatgaactaattctattattgtgacatattttttctaataaatttgaggatatacattttcaagtaatacgcccaaaccaattattaacgaacatacgttttaaatagagtcaaaaaaatatttcaaaaatatgatccacacataaagattcgtaataaaagttcaaacaatattaaacaacatgcccgcgcattgcgcgggctaccttctaccttctggttcaacaaaaaagacagcgtgtgttaagaacttcctgtaaaaagagatacatgaaggctgcagattcagcgattattatgcttgcatatgaccctacacggctagcgcagtcttcgttctttgcttgcggctagc

SEQ ID NO: 47004 - DNA, 604 bp, Oryza sativa
agatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattaaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagagatttagttcatttgctaaacaaggttttataaaatagttgagaaggaaaactctagtgaaagttaatcttaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttgactcatgtaga

SEQ ID NO: 47005 - DNA, 163 bp, Oryza sativa
ctcagtagttggaaagtcgagctcgtgcatccagtaagcctcaatgaccgtccggacctctaccttggcgtagtcatccggaatgtcttggcaatgaaacctgcggcctagtatgaacctcccagttgcaatgagtattttctttcccaccctaccgaccaga

SEQ ID NO: 47006 - DNA, 261 bp, Oryza sativa
acagtagtccatcaatcctttaacaactcaaggagttctgtaaaactctggtccgaccagccattactagccttaagcttcatgagttccaacacgcataacaacttgctgtgcttcgacttgcatccatcatacaacggcatctggcaatcttccaccaacttactaaacttctcataatctctgcgttgtcctctgcgtcttcaatgtcatgcaacattgtagatagacattgagtgtccaaatctatggtctctccac

SEQ ID NO: 47007 - DNA, 271 bp, Oryza sativa
ttttctacgggatactgtgtatggagattgtctgactgtgcgaggtcgtgacgtacacaggaagggtcgaaaaggactagacatgcccatcaaaaaaagaaagtaaagtgaaagtgtgcgagacgaaacggagcaacaagaagccaccaccaccacgcctgctgtctcgtgggaaccggacacacaagcagccgatattttctcccccaccccgaccctgactccgaccgatgcgttcgcgacccaacccaccaacccattcgtctcgaga

SEQ ID NO: 47008 - DNA, 708 bp, Oryza sativa
gcacgtcggcggtgcgcctctgaagaagtgcttagcatggagtgcctatcgtcgccgtcgccgtcgccgtcgccggcgtactacgccgcggtcgccgtcgccgcctccaactcgtcgccgaccgtgtcgtcgtcgtcgtcgctggtgtcggtggaggaggccggcgagaagatggccaacgggtacctctccgatggcctcatggcgagagctaggaggaagaagggtgagttcttgagagacatatggtttgtgcatgcttcactaatttgttgtggtttagcactaattacagccacctgacagtgatctaatcatcattaagactgaatttatttttgttgatgagaagttatttgacttcttttgttatgtccccttctccaatttttccaccagttgctgtctgccatacaagcccatttttatgcttccaacttgtacaggaatatatgcatgactgacataaatttcctaagaatcagatttctgtctctcaagttgcaacctgaaactctcatccttatcacaaacaaagacctgatttatcctagttgtctcgtcctaatcatttgcatctagattcttgaactccaaacactagattgtttttgcagatatcaacagataaaaaaaaatcctctaaattgctgtgttttctacacctgaaattctgaacatgtcaaactcatcagttaactgtcatca

SEQ ID NO: 47009 - DNA, 446 bp, Oryza sativa
  unsure (1)..(446): unsure at all n locations
cactgtctgtattgctaacttcctcctttactgaaaggtcagtcagggagaaagagagagagagtgagcaatcaatcattgggcaaaaagaatcatcaagcttagagtagatgttggtcaagctcgagctccaattctttaatcctctgaaagctaaaaaagtccggtcatctctcaacagtgaaccctcctatatgcatacagctatgagcagcctctgacatctcaatcacatgatcatgagtggttttcacataggtatatatacttccatttgccatatataccccttccacacttggaaccttggatcatctcatctcacacacccaaaaacctaaattgcttgattgctcttgtactgcagtngtgcttcctacactgccattgcatataaattntgcactgcaagaataantcagtctgagagaccagagagaacatca

SEQ ID NO: 47010 - DNA, 191 bp, Oryza sativa
aatatgtgacctgtaaaatttttcctctcctctcctctctctccgaactagtgcaaaggagagatgtgcaacttttttatttttattttattttctgatatttttttcacacttagaaactcacaggaatcaaccatgtaaaaaataaactcaaacggacgaaatatgtggcatgtggaattttccaaagt

SEQ ID NO: 47011 - DNA, 572 bp, Oryza sativa
tgctaactagctaaatcaatcgtcatgtgtcgagttttttttataaaaatgttcatcttcatctccaactcgatgtcagtgctattatatgttgcattgctatatatactagagcgggttcgcgcgctgcgccgcgcggtttataaccgattcgtgttatttgatcagtaccgatgtaacaattgatggaaaacggctttttaagttggctgtttaggtcgtatttagttggctatttaggtcgtgcagcagtaagcattggatctctctgttgttatcgtgggctgatcgggctaacatatcaaggagctataggcttttgtgcttatgtttgacgttgggctcttaaaggtgtgcaagagtataaatagtgggctgctggtgggcttcaggatgcaaggccttttttagctaaggatggatgtcctagggcaacgtgttgtgctgtcattgcatatgttttgttggggctggtatatatgtaggagtgctggctgtttttttaacgctgaatcgatgcggcggcggcgctgctgatcttagcggtttagccaaaggacatttagctagca

SEQ ID NO: 47012 - DNA, 353 bp, Oryza sativa
aaatcatgtggacatgacaaatttgtactctgtttggacaacaaattggaattgtgcctgtattgtatgaataatgtcaataggaaaaaattacctttctcgcgaaatttcctcttccacttggtgcaatgatgcgaacacactcgcgagggtggccgatcttcatggcagtaggttcaaggcaaaagagcgccggcgtaatccgaacaaaagagggtaactagcgcgagcagcaagaggataactaccagatgcgaccaagtagtgagggtgagaacgatccgaagcctcatgaattccgacccgttgttgatatttcttaacgacattactagaaatataatttccagcaa

SEQ ID NO: 47013 - DNA, 1501 bp, Oryza sativa
cctttccttggtggtggatttatctggccggtcatatcgattccccatcctctgaacggccatggcttaattattgggttcatagctgacgcaggtgctctctaaattgctcaaaacctttggcaatcttgacatcccttataatatatgaaacaatccttcagcatggtcgactaaaaatacccaactctcctaatcaaccacttcattctgtgagcgattgatgagttccacaaattccttcgtgcacttcacacataaccactttaagtaaaactccatcaatcgtcggataataaagatcatcatcaaatacaacatatttaagagccttatatttcaatatccttgatgccgattgagaatgatttttcaaatactcaaaaaattcatacctctaatcatcggcttgtatagcaacaatctctatctctgtctattatcgtctctctcagttccaacccattgaccacttcgttcctatccaccgagcaacataacaggtagcctggctcatttgcctaatccatgttgggttgtttggttgctggactacattcagattgactgatttaagatgtttagttggccggatatgaatgaaaagagattttatttgcttggtcatagttagtgagttgagctacctcctcgttatttgagtggttaagttatccatttaacaatatcgcgcacacaaaagaatactactttggtttataataaaattaacatattactatctaagtcaaagaaaaacaattctgtttccaacaaaatgacgagtaaaaaaaataagaagaaaaaagaacgatagagatttccatataacctagaagttgcagccatactattagaagtataatcttgttgttttagtttcaacatgtttatttgtatggtagtagctgagtagaagtcacatgtatgtgttatctagctaattagttagccatgcatgcaaatgtggcgaagggatcagcacacgtccaggagcaggaagcggtcgaacgctgcatgcacgtagcggcgattgaccaggagaattctgttagacgtgggtgagtttgttatctaggattcttgcatttctttaggcttaagcaggtcatgtgcatctttaaatagagatcaatgtaatcagtttcattgtgagagaaaaacagaaaaagagtgctacgcacttgcaaacaactctctgtgttctgagtccttgtgtttgtgtgtgcttgtgttcttgtgagattcagtgagtgaatagctttgatttccaacaattggtatcagagctgaggtgagtgtctactgtcatgtctggcgatggagtgtacacgccgcccggccgccgcagtagcagtagcggcaatggcaccgaccggcagcggcaccgatggcaggaacgatagtcgtgagcttgttgtgcagcaagtaaaggaggccggggtgacattgcgctatcccgtgctcacaagcagcaactacatcgagtggtcactcttga

SEQ ID NO: 47014 - DNA, 1304 bp, Oryza sativa
accaaaatatcctcgtcttctacattcatcccttcttccttctctctcctctcttccggccaacaaactccgatgtgctgccgcccgtcccgctggaagaacttggcgagggacctgctcgattggagcaggcagggcagcgacctccgtgctcagaggacacaacattcagggcagcggacggccacgcggtcttgagcacagaccggaaggatgctgcatcaggggacaagaggaacatgagattagttagcacttagtacgacccatttcctccatcaatgaaagaaccaaactgattaagcatgcctgaattcagattaatcaacataaatgttattcatatgacaagataagccttttctattcctaaaattcacagtatcaatcagttggcagtagcaacactagtataaaataaacttgccaaccaacgcaacattccagaaatcactaactacgcaagaaagtaaaaacacaaaatttcttcaaacattgagacccctcagatctgtcaacacaatcgcaacccccaaaaaagagaactttttcatcaccatccacaagcactagcaaaccgcataagccgcactatttactactcctcgacggcggcagcggcaagcattggagctctctctcccccgcggttgccgtaaatggaggcagggacctgctgcagcatgatgcgggtggctgctcgttggagttcattgcctgcaaaagaggagagaaggggaaggaagaagacgggggtattttcgtctaaaagaattgataattgaagtgaaggggtatttagtagcatatctcttatacttatgaaattgtaatggtatacttttaaatagcaaaatagtaatggtgttttttaaaaccgtgaaatttttaatggcatgaatccaattaaccctttttttttggcgatgccccattttacaaggcgtgatgatttttctgctgattttctctcgggagtacccttcgcacacatgcaaatgaccccttgatacctgcgtttaataactaatccattaactatttgccacttttagatttagctaattatttgtaaacccactgaattactcgctgaattcagtgggttggcactgaactgaactgggccagaagagatgagagaaatcgtttccactaaaagttgaaaagggtgtttagtacgtgttagttttttgaagaatggaaaggttgtttccctagctaattcgtttcccagtaacacgagttgcttgttaaaacttggtttttaattttctttacaacgaaacatcagctggttctat

SEQ ID NO: 47015 - DNA, 1501 bp, Oryza sativa
ttgctaatcatttccgaacccagttcatcttcgtatcctttttcattttttattcttccttcacccctgctatcctagagaagtattcctgtcaacacttctcgactatggagcaacctctgtttgagctgtctgctcctcggggcgaattctatgagccacctccttcatcggagcccatttatacaactggctatgaaattcgtcctaagctaattagtatggtcagggaaaatcctttttctagctttgatttagaaaatccctaccatcatctgcgagactttgaacaagtttgctcatgccttaagattcgtggcatgagacaagaaattgtgctgtggaaattgttcccgttctctcttcaagagagagcaaagcaatggtacacctctaccgttggatgtgtaaacggtagctgggaaaagctgcgagacagattctgtcttgccttcttcccagttacccgtattactactcttcgagtagaaattctcagtttcaagcagatcgaaaacgaatcaatcggtgcagcttggtccagattcactaatttagtgcagtccggaccaaccctgtctttacccgagtatgtgcttctccaacatttccatacgggtttggataaggaatctgcattctatatggacataaccgctggaggatcattcatgcacaagacaccgtcagaaggaaaaacgattttggatcgcatcctagaaaacacttccttcatgacgcagtccaatgaaccccagccggaggcatccatgtccaagatagaggaacctctaaccatcgagccacttgctgaaccatctacttctgctagctcgattgatgagaaggttcctgagcagccgtccgtcgagaatgaagaaattcagacttttgattgtgccgcaattatgtttagggaaggttttgacgaagactacggcaataccctaaactactttagtaagaggaaaccacccgttcctttgtcacctcccgatcctatggaacttgggttcctacgagaaactgtccgggagctgacatccataatgagcgacgaatggctaagggaggcagagcgttcatccgaagtaattcggataaataccgctccccgaatcattccttgacatctggaagggaacgatgtcggcattcgcttatttgagtgataaggcagtgaccctgataaacaaattcttcaagcatccgaacggaaatatcatcgaaggatttgggattgtacaaggcgtgactgtctgctttgaagatagggaggcgatcttagatttccacgtctttgaaatccaagactttgatatcctaatcgggctgcccattgagcaacttctcatcaacacaccccgattaggtagcctcaaaataacactgggagagaatgaattctctattccattcttgcgggcaaggatcaccttgaccgaccctctcccaaggcccttctagaagatgaggtccccgacttcatcaaggaagaagc

SEQ ID NO: 47016 - DNA, 1501 bp, Oryza sativa
cataattccacaaaatattttacttttccattttccacctttatttaagacccttgatctaggagtatgactgattatcttcttgagtccatatttttggctttgcaatatatatgatgcaggtatgtcacaatttatccctaccaagccccacatatcagccttagaatagggatgaattctggcacatttttgccttggagaggatccaaaaagaaaatatacatctttgagagacaagagagaaagtcaatatgaggaaaagagctagtttgcgaaaattcatgaaaatcccatgagtctgacagagaagtaagaaggactggaatcaagatcgttccatttatcaattactcaacatggtaagatagccactgaaaaagttcacaggtgcaggtatggttgtgaatgatttatatgcttgattcatcttttgaagaaattcattcacaggtgcaggtatggttgtgtgggtggtttttttggcgggtgttaaatgtcgattctataccgccaacatctgcataaagatcagataataaaacatccaacatagagataggcacttaatctcacatattcgataggtgttggtgtatatttgtatgtagatgataaaccctgaagttgggaggaaaatcagactaaagtgagaagaattttgtatccatgcaaggatgggttgtgaacttcatcgaaacatccgtaaatcagcccaaaataccaagaaatggatagaggaggaccaggggaggacttgggccaaaggccaggccagatgggcccagcccaggttcggccgaaccacaatctcagccatccaggctggggtttggcgtggacgtcccagatgcatccctgatggcagttggagggcacttcggacatttccccttcgccaaccgtcatacctacccctatataaggacatcatctcactcacttcaacacacacttccaaccttgagttgaattataagaggctctattgtactatattgtatactagaataggaagagagtagagtagaaggagtcggaagaattccggagttgtcggtaatcttctcctatttcttttattctgtttattactctgaattcaatataatattctttttgagtaatttagatttatcttgtgagaattatctcttggttagttcctaatcagcatacgggattgttgttcactataatcaactaaaatatagtgattgctttggtgagttataaacactaaagtagatactaattgcttagacgtggtgtttaggtaattattatctaataattgctgcgtatcccatagtacgttgaggtgggtgtagaggtggtgacagcccttgagatcactgaagtcctccctgtccgggtacgtagtagagcgacatctgggaacagcgggttgccagtgcctgaagtattgcgttaggattaaaattaagctttccctagacactgtttctcactagtaaatcctctctatcctggcctatta

SEQ ID NO: 47017 - DNA, 1501 bp, Oryza sativa
cgatcttctccgccccttcgacctcgacgccgtcgccgtccgttgatcttccgccgccgttttggtcaccggtgagttcgccgcgtcgtcctctacccgttggtgccctccgttcgcgccttcgcgccgtcgttcgccgacgagcaagtgctcccgagccgccgagccgccgccggtgctgacgtcatcgctgacgtcatcgctgacgtcattgtcgctgttcccgtagactcgccgtggacccgattgatctcggccgtccgttttggataggatcgatctcggccgtccgttcccgtgaaccgccgccgtgcgcccggtctaccgcaaaccctagccgctgacgcaataaatctctttttccttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatattaaaaatatccacatgtactgttcatgcttgtttatgtgctgttttggtgtttttgctcttttctgtttagattccgacgtttccggagagtccgttttcgcaggagaagattttgaagagttccaaggccagcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggttattataacttgactagttgagctctatatattggttcagctagatattagatgtgattgcttagccatgcttagaaacattagcacactattgggataacatatgactcactattatttaatgatggcttaatgatagttcacgatggtcaatcgtgatttgttaattaattacttgccaactaaaacttgataatggtgggttgtgagcacatagttttgatggtcgtgctcatgacaattaaggaccggttcacgagtttcggttgtgaaacattatgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacacgagtgaggacaaagtgtgcagaaaagacatgtgttggtctgtgagggcagtctatgacctatgaaagctatcatatgtaagcgggcccggcctgggggaaggcgggacgttacaaaatggtatcagagccgactacatgcgctggcactggacacatggacgtggccaagagaggacgttcctagcctagggttgatcgacgggggcgtcgatctctcttaaggggtgagg

SEQ ID NO: 47018 - DNA, 1501 bp, Oryza sativa
tagacggacggacaactcggggtccattcctgccaagaacttttcttgcttctcctcatcttcccgcacatcctccggggcgtaacgggccagattgttgaactcatgcaaatactccatcacggagcggttgccttgcttcaactctcggaattcccttttcttaagggccacgactccggcgggcacatgggttctccgaaaagcggcggtgaagcgggcccaagtgataggttgcccctctggctgcgtagcctggaagtggtcccaccagagagatgcgggtccctgcagttggtgggcggcgaagatgactttctcctcatcgctgcactgcacagtgtctaacttttttcccacggcatgcaaccaatccaacgcatccacggggttgttggagctagagaaggtaggtgggcggatgcggaggaactcagcgagtttagagtgttgtgggggtggtggtggagcattatgttgtggcggattttggaggtggtggaggaaagcagtcatcatgttggcttgctgggcgaggatttgggtgagaatggcgttggtgtctggtggtggtggtggaggcggaggtggaggtggaggtgggttgccctggtggttgtggttgctgccttcgggttggttgccatcaccggtaacagcatttctcctggtcgtcaccatctgaaaaccccacacagaaccagcaacagagagagctgacaattaaaactaaccacccacgactactataattcttgaatttattactgctattaaatgggttcattaatgttcaagttgcttaggcaaataaaataagacaggctccgacatagttatgccacacaccggcataaaccatgccccacacaactcaaaaagacaaacgagaaagaacacacgcgcaaacctactaactgctcgtctaccgctgcgacgggccaggacggaaggtgagcaacagcgcaccctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagacctctccctgggcgatcttgagctgatgcagctgcgcctccaccgcgtccaggtccttcttgagctgcaggttctcctgacgcagctccaggatcttcatgttgttctcgaccatcccacggcgcaccatctgatggaagtcgatacgagccgcgtcgtacgcctccaccatgcgcgccaggtgcacgatggtagcgtcatcctccgagctagcatcccggaaggtggcgtagtcgcgggctcctccgcggcgggggtggtagcggtagggcgagtgctgcaactcgtccgggtagcgctggtggagagtgccgatggcgaggagagcggcgctctggcaagcggcggg

SEQ ID NO: 47019 - DNA, 263 bp, Oryza sativa
ttcctttttctttattattactaccgcctatatactagtactatcttccacccacgactttaaatgtaacctcattgctgcttgcaaattccgtaatctgagttaccaaatttgatatgtttatccattataaattttaggcattacacgcacaagcctccttactatttcattcctctccgaaaatgtcatattactgtatttctttcttgtcggcaaatttcatataaccgtcattgatctcaacatgattttcttttagg

SEQ ID NO: 47020 - DNA, 198 bp, Oryza sativa
gatcaaaatatataaaaaaaatacagatttaaaatattatattttaaaattatcacaaaactatatatgtagggcctcatatatttagatgcagtatcaggagatcggtcccttgtgcatcttccccgtcttgacttgctccggttcaattcaaatcacctcgctcgccgtccgtcttcgtggagctttcgaatacga

SEQ ID NO: 47021 - DNA, 290 bp, Oryza sativa
cgatcctatattattctttaaatgatgatgcatgccatatatattattctgtaaatgataatgtcctgatgtttcatatctagatacctcatttgctgcacattactctctttattcagtaggcttagatacctgatttgctgcatattactctctttattcagcaagttgctcatatctagatatctcatttgcagcacatcaatttgatttcatatggtcatgtaaatttcatctgccttgagccatccttgttcagaactaatgttttgattatgttttattgcaga

SEQ ID NO: 47022 - DNA, 305 bp, Oryza sativa
tggactaattcgcgagacgaatctattgagcataattaatccatgattagcccgcgtgatgctacagtaaacattatctaattataaattaattaggcttaaaaaatttgtctcacgaattaactttcatttatgtaattagatttgtaagaagactatatttaatactctaaattagtattaaatataaagttaagtccctggatcctcagttctctgaagttgctgagccatcagaaaacagctaggactgcagcgaagttatacctcaaatgtgatccagccgagcgacagggccacggcga

SEQ ID NO: 47023 - DNA, 663 bp, Oryza sativa
ccgctattacggtttaaagatacaaattaggttaagacactagttaagggagtcaaagtagacatattccattttcaattgggtgttgtttcaaattaggtccaattggagggggaaaatggttttgtttgctaggctattgctttctcccctatgttttgaacttcagtttccattttaaaatgcatgtaaaaacaaggtcaaaattcatgtcaagcttgaacttgaccttttttttttgaaattgaacatttgaaaaatcacgtaaaaaacagaggcaaatagttgggctgtttgaattaagccccgttgaaggcgaaaagtttttttcctttttgaaacttttcccattttcgttcggtcattgaacatcggtttatatagttatatgggaaaatcctccatttttaaaataaaattacagtaaataatgacaacagggtaatcaacagtaaaatatggttatttgtcgacacccttcaccatgtcatctgttagatcgatacttaaatacccttatataatacttctattttagaccgttgatttttttttatttttgaaataaaaacaccagtaaaacttctcctaattataatactcacgcttatttataactactccaattgatctcttgtcactcgatcggatgcgtaaaggtca

SEQ ID NO: 47024 - DNA, 1397 bp, Oryza sativa
acatggggcagttgaggcgctgtgaggattaaaggaagttcagcctggggcccctcctcgcttgctccccccgccaaacggcggctgggcgagggcctcggggcaaagcagtgcaagggcccgaggggcatgacgtggcaccccgaggccccgacaccccggccgctcctgcggttcgtggaatgcggggacaggaccatgctgtagggacacgtggtaggatggaaaggtagattcccctcacttcgcatacccccgggcccatatctccgacagtttagggcttagggtttaatagttggagagtcgagatatccggtactgcgattcaagcatacgaatcagattcggcccaataatccagatgccaataggacggcccatcaatccagatgcaatacgacggcccatcagatcccgtccccgagaaggaatccccctcaccgttggatccgatccgacggctgagaccagccacacaaaccctcaatatatattcgctcgccccccgctgcgtctcgccgctcctacaccgcgccgtcgccagcagccgccgccgctgcctctcctcctcctcccctcgccgccgatccaatccggtaagcctcgccgccgcaagctccccctcgtccctcccccggatagttcgtcgcctcgtcaggcatctcgccgatttggcgccgttctgttgttctgtttggtggagccgtgcgcgagatttccggtgtttgttgacctgtttagctctgatggattcaccttgtgttagttagttttccgtcgaatggtgtggcgattaggtttggggggattggttcgtctgtgattttgtagctagattttttgaaatctagggtagtgtgagtggggaagctgctggccttagtggatacatgctgttcgtggtctcctggttcttgaaatcatgatgagttagtgctgtttgaaccttgaagcaaagttttaagttattggagttcctgtgcttagatttgtatactattagtgaagagatgcatagctgtactgctgtagtggatataggagtgttgtttttgatttgctggtgctcttccatagcatccggatgcggtgttcaattgtgtagttgtttatgtagttcaatgcactagaagcttttatttctgaatgcctagttattagttgggtatgaagtccaatgtgtgaaatgctgtcatgtttcaacttttagttaagatatgaaacttgagaaacaaatgaaaggtttagattcagtactgatgtacaacttaagtaacatctatggttgtaaattgtaccatgcattggttattgtgaattagctcttttggttgattgaaacaattctctatgtgccaacaggtcactttcagtcttttttcttgagggggaga

SEQ ID NO: 47025 - DNA, 340 bp, Oryza sativa
tattcgtatcaaaatagtacacttaatttaaaaccaatatgatatagatgagtatacttattttaaaatggaggaagtagtttcattctctctcttcgatctctctcatataccttagcgaaaattaaacatgtcttgttttatttacaacactcacatcccattcacatcccattgtacatgtgtaataaaaattatacaacgtattattggctgtcccggtgaaaaacaaactatatactccctctattttcttctgataatcagtatttttgttttgagttctgacaacaagataaaaaaaaaagaggcataaccccgtaacccattttactccagg

SEQ ID NO: 47026 - DNA, 207 bp, Oryza sativa
atcggtagtcacttctttaagtagttatgagctcactagttcctgtgataatctgactttccaagacttctcaaatttttctttttttgtgagcatatgttagttgcagatgtaactgaaatctggctcgagaactgtttactgtttcaaaactgcaatagctaaatatatgttcagatttgtctgatttatgttcattcctatagg

SEQ ID NO: 47027 - DNA, 563 bp, Oryza sativa
cctgcttcacctagtaaccttcactctttccattaattctttgtcagtctaccctggaaatcctcgactagtgtctactaggcactagctagtcaactgctagttcccagagggatacagcaatatctgagtgattcaccgcagatatgtcacccatcagaagttgaccatcatcagttactaagagcacccgcaatggtaaagtaaggtgctatctataaaacatgtacatctcagcaatagactcgattaatagtaaaccaccttaatagtatgtctacattggtatctatagctctctcatgcattgtctcgtttttctctatagactatctctaagttagtagatagctttgctctctctcttcatttaatacattccaagtaggaaaatatgctgacatgaatctcttatagagagcctatagataaccattgtgggtgccctaacaccatagattagtagtagataatctataggactgcatgcaatgcgatgatatctaagctcggtgtagattcagaaaccgcatgttcagatatatatgcatttcttttctagc

SEQ ID NO: 47028 - DNA, 1501 bp, Oryza sativa
tatatatatatatatatatatatatatatatccattatcataaacgtaaaaaacaagcccactctcttagagatgcttacagaagtaagatatgtgtattgtatgattttattatagggctaagtgttcacacgtatatattagcttgtgcgtttatactctatttcgagaaaagggttttctatatgtttaaacttttcttaatatgactataagaataaaccctcttttggaaacttatgtttacatattcaccttatttctcattttgatttacttttatcttactttttattactattaaacttatggttgtgtgtcttatgacaaaagccaaaagatgtaatccatttccattatctaaaagaaaatgtttacatatgaactttttagctaccctgtttctgtggcaggacaacgttgtcacattggtacaaaaggtgttcttatctgtattcaatacactagtctaattaagtacaccaaattaatttgcaagtaatggtacaccagctaaccaacttgaagagattgtgtcacccggccgtatgtacaaaactctaacatgtcaaaaatataaaacacaaattgactagatatcgtgccccagtacgtccataaaaacataaagttctttatagcaaacaccacagaaatgctgggcttcctttacgaggttaaaagctcgcttgagactggaatatatagtacgtgccagggctgataggacggcttaactattttgataacctctcaaagttccaatgtttctttatttttttctgtaaaggaaaaaggtgcgcaaccaaataataataataataatagcttgactacaaataataaaattaattaaagcacctgtgatggagaccaagagcatgacttgggtatatgccaaaccgtcttgtaagttaagcctgttggttccatattcttttttaattggggacacaaatgagccgctcgttttctgcatatcttaggctttccatggctttgcatatcttcaactagacaatataatgtactatccataaagcaaaaattggatcattacagcctcgtctcttatttgcatggaccattcatcttatctagttagtgtgtggggtgtgcgctcctttcttgcttgctttctctagggccagcgtacaattttcatgaaccatttccattgttaggttcctgtcagaaccttacatggtataggaaagaaaaagtatggagaaaaggaaaaaaaatacagggttgttttcttcctctttggttctgagctatccaaacatattagcacgttttaaggtaataaaatggcagtgcccaatatctgttagtgaaaggaactgatcataagccatcatatattcagctatgcaacccgttttgcaattgcataccatgaattagatgacaagatcaaaagacaatcttcaccataaccattgtacctgtaatcaaaggcataccccaataaagaaaaactagaacacaaatcata

SEQ ID NO: 47029 - DNA, 298 bp, Oryza sativa
ccgccgacaccgcgctccccccgctcccgcttgacgatgccatcaatcaatcgatcgcaaagatttcgggagaagaagaacaacaagcaccactagattgctacaagcttagcagcagcagcagcagtgaagaacaagaagtgcatatactaaactgaaaccaaaatccaaaacgaacacgacgacgacgaagaacacacacagagatcgacaagaacgacgacgacgaacacgagatcgattattgtagaaggaagctagagagagaggaggagagggaaatggatggcgagtagct

SEQ ID NO: 47030 - DNA, 295 bp, Oryza sativa
caaaaggaattcagctagcacattctcatccatgatcagctgtattttaattatacccgattcagagatttcatttttctttcttttaaaaaattatcccgtcatagttatttgatgtttatgacaagattcgattaaacttttaaaattatgatcaaaacttataatatttatagttgtagtattattctgcatattgataacccgtcgatttattcaatgcctttaaaatcctgcacatggggacaagaagtccatgtaacaagctatgcaccacaaatgtataatccctgca

SEQ ID NO: 47031 - DNA, 473 bp, Oryza sativa
aatgaaagatagggatccaaggatgatacttgagagcaattatcgatgcaataatgtcacacagaaaaggttctgtgggtccagcaatgcaagaatgctagacacactggtccagccaccactaccatgtgcctcatgtaccagttggcattttggcacctaatgctaagtttccatgttcactgatcaaccatttcagcgataaattctaccacttaatctagattatggctaagcaaagcgctaaccgccaatcaagagcagtgtcagtctgccattgctttcctaaccgctgctcagcaatagaaaatatatcgacagaagaaaggctggtataaagaccgccatcttttcaagcacccacaagactttctagggaagaagcctctctttctttctttcgttctttcttttgttttcactttcttttcttcttcccatcctgatcttcttcccgtcctgatctggagcaa

SEQ ID NO: 47032 - DNA, 1501 bp, Oryza sativa
cttgtgaagctagcgggaagaccctgtacgtttttcacaacttctaaggtctaaaatactttatacttgtattggtggactgagagatagtatctctcatggtaaggatatagctgagcatcaatgttcagaaaagtgcaagaggacaagccattcattgtgcaatcacgctcgtcgtcttgcccaactgctctatgctctctatccccaggtcccctgtcaaattctaaaacagtcatccgatctcgccaaaacgccatcattatacctacctaatgctaattctagcttgcatcacgtaagagctttgccaattatataagataaactagtagaagaaagtttgtcaaatgctagctaggatcatgtgcatgggcctcctctgatctgcatggtcggtctcctttagcaattagcactagcttggctaaggttttagcaggttgatgttgtggagaggagaataataagtggtgcccttgtgatcttatctggtttttcagcatattccaaatcctggccggcaagcttgctggttctgataaatgtccgagaaactactttatttgcccccttagggtgtgtttaatataggccgagcttagatctaaacttttttttctaacttacaacttttcaatcacatcaaaacttttctacacacaaactttcaacttttccgttacatcgttccaattttaatcaaatttttaattttagcgtgaactaaacacacccataatgatggataaatctgcactttctgatcttctaaacagtatgattttcattaaaaaaaacttttatgtaaattacctagaaaatggagttttctaggtaattatttatgataaaatggagtaaatgaaattaaactcgaaaaaatatatatatattcccaaatttattagtaaatgatttttttatgatgaccaaaatggggttaaggaaatattgtgaagtaaatattgcatctgtaaccaaaacattccttgtggtacaagatgcatttttttgggttgagtagcccagttttccaggtaagtactacagtactagtagaatataaaaagaagaacagagccaatactttttctgtcatcttcttcagtttcttcagacagctgttgagattgctggagtcaccactcaccagtcaccacaatttgggtgtgaacagatttgaaaagccaaactgtttcttcatgagcttggaactgaaggacaaaaaaaaactaataaagcaaactgttccaggagtgcttaaaactgaagaaaattttttttcacccaattcttttgtcggtcggtggtggtggctactggttatagcacattaagcaccgtcgcctcagatttttcgacgaactttaaactggatttgacgcgacaaaaagcagccttggattggttccatgcaagtgctcttgcagcacctagcaatagcaagccaaagcaagccatcagagatgagcccatgaccatgaccctggtcaatcca

SEQ ID NO: 47033 - DNA, 1102 bp, Oryza sativa
aattcctgcagcccacttgtgcatttcaatcctaccacgtacgactgacaagccattttataacttattgaaaataatttataggtaaaacttttatataagtctttagcgatttaaaatctaatgctaaaagataaacaatgattaagaaacctcaaaatgaactattaaaaagtttcaaaattttaattttgacagcggttgataaaagctataaggcaattcctttaagcccggggaaacctctttttcgtcttccccttccactcccactctcacttcattcaacactggtccctatcccgaaacctaaagtctaaacttagtgttacgcatgggtggagctacatatacttaggctctgttcgcaagagctggttcccaactcgctactctcatttttcgcgcgcacatttttcaaactgctaaatagtgcgtttttaaaaaaaaagtttctatacgaaagttgcttaaaaatcatattgatccatttttttaaaaaaatagcaaatacttaattaatcacgtgctaatggactgctatgttttccgtgcgtactgtttgggtcaggaaccggctggagcgaatacaggctttggggggtgcccaagaatatataccccatccgttcaaatttagcttaaaatttttttagctataatttatctattttcaccatatatatatcccatgcatccaaatttagatacccatatcaagctaaattcgatccaaaccctccggagaagacaccattaacattgccagagcacaaatctcggcgtggattataaggctagcaaatttgactaaaacaattgaaaaattataggcgcctgaaatctaacaatttcattttcttaaaaatcccattccccctacccggtggaccatggcaacattagaatgccaacgacaacaaattcaaaaataaaacaaaaaaatggttcattttgctgcggccaacgttaactttctcaacgttcacggaaacgtcatccaaattagcaaacgaaacacaccaccctgtgaaatttcttttcctcgtttcaagcaaaagtagtgcaaaatcctcccctgcccccacgtgaacggtgcagt

SEQ ID NO: 47034 - DNA, 1501 bp, Oryza sativa
atccctaaattatacaaaaccgtgcaatttagatcccgtagcagtatagatgcctggtttcgctgacgtggcatcctagtcaataaaaaaataaaaaaaaagcatgtggggcccacatgtaagtgagagaaaagtgggaccgcatctcttctttcttctcttctcttctcaacttgcttctcttctcaggacgtcaccagcggcagatgcgggagaggcggccgaggcagagcttccacagtggtgacggcagtagtggatcggatgttgttgacgtcgaaggccagcgccggggacgcggcatggacggatgagttcgccgagttcaaggtggggcacgcaatgctggtttttgagcgactccgtggcgttcatcgagggcgggtcgtcggccctagggtccgacaacggcgtctgcgacggcgatgacaagctcgccgcgacgcagacgcgctgcttcactgcatccagctccacgcccacgaacctgttggtggcgttgccgttgagggaggcgttggtgaggccaaggaacccatagtggctaccaatcactctcttcaccgcggcgccgggtgagaaggaggtggaggtggaggcagaggcggaggtggaggcggctcccgcctcgggagtggcagcgactgagggggcaggcaccaccggcgcgtggatccagcagcccgccgccggccatccccatctaggaagagaagaaaaggaagaagagaagagggcggctaacatgtgggacccacataattttttatttttattttgctaactaggatgccacgtcagtgaaaccagagatccatactgcaataggacctaaattgcacggttttgtgtaatttaggagtgaaaatttcttgtattgaggattagatgtcatacaaactcgatataaagttgagggacaacgggtgaacttattccacatccaattaacagcgggcacaagctagccctcgatccattaaaaacgttattactaaattttacttatttatttactagcactatgccctagcttggtcattgcacaacacacaaaaaaaagtctaggtcactaatcaattaggtcaacttaatcacttttatttactaaataaagaaagcatcacgatgctcataggacctcgcattccagccagttttccattcttctagcaagctctctgattctttatttcttatgaacaccgtagaaatattactcctaccttgcttaagctacactgctaatctcctagtacatcacccacactgtcaagctagctacacacacctacgtgcgcacgtccgctccgatggcggcgagtgtcgtgtccgacaagtccagcggcggagcgagcttgctccggccgtcgcgggtcttgttcctcgccgtgctctcgacggcgttctggtcggtgatattctacgcgcaccactccgccgtgcaaggtaacgcgaccatggcgtccgtcttgctccggccgtcgtcgttctcccgccc

SEQ ID NO: 47035 - DNA, 1501 bp, Oryza sativa
tgcaaaagatagccagaaaagaaaaaaaaggctcaaaagaagctagtacacacaaacacaaactggcccaatgcattatagttgttgctgaattattctagtactgcgagaagctgtgttctttgggcgttttggatctcaaacagtgtcctgtactggagaccctaccatattgcaatgcgatgaccttttcggatggagccaagcaagaagagaacgttgagggtccatttgcaacgatccattagaaaatggcgtgcactttttgtcgttctgtccatcactctgcaggagaagacccatgttcctcggcatccaattccttattctgcagcgtgcatatgcacttgtgacagacagcagtagtagatctcaccttaagtacagtttcacttgaaagtttttgctacaacttgtgccagttttgctaatgacatactggcagctactagctctctcatggtagtacatgagaagagaatataagatagtttgctaatgtttttggagatttgatctggcagggacaacggcgaggcggcggcgtacgccggcgtcaactacgccggagttggaaccggcggcggaggcggtggcggcgccggtgccggcgggatggggtatggttatctcgggatggtctatggcagcggcggcaattggagctgccgagctgacctgacactgcaattgacttcattgtttcttgcactctttgctctcatatgcttgcacccattgtgattgtaagatgcttcattatgattcaattggaaaggttaggaaaaaggggagaagaaaaaggaagcaaaaggtgttgacagttgacacttagggagtagtaggcaacagtgttacagtgagatgatatccaccatgtaatgagcacatggatgggaatattgcaggtttagccaatgtagttgttgcaaaggggaatgggattattcagactaacttaagctattaactctaacctctctgtaatctctgtcgaagggtaacgaatctatggtttaatggataaacaaagttgagcaaatgctagaaagaaaccgtaatttggccgtgcttgtgacaagaaaatttgatccggttgagaggtggcccaaaatcgtttaaattctaagggtgggcaaatttgctcctgttcagaggtgtataccaatttcgattatgggcataatttgggacgcctaattttcatggtcatcggttggccaattttttgtatgggcttttatatgcactgatttagatctgggaatgtggtccgctgctgggcttgagtattgagcctaaaccaacccagacagagccgacttgggctctagcaaactgctccagctttcgagaatggcgatgattgaagagccgcaggtagtagaactgcaaacaaaactaccatatcactaagcttaataaacagcagctgaaatcacaaaaatacagttaaccacaaaattcatgtatttccaacaaaatacagttaacctcgaga

SEQ ID NO: 47036 - DNA, 1501 bp, Oryza sativa
ctagaggtttgagctcttgctaaatttcttctaaaatccacatacaatgtgtcattccatagaaatttcataggatttgtaaagctttaatcctttgaatcaaagagcctttaagggagaatttagcctattgtatggaagtgcttaaaataccggtagatccacgactcaatttacataaaaagtaatgttgacttttcttccttgtttttccaagtaataaacgcaaaacaacatcttcttccctctgtatttccaaaggtgcaccgcaagtccatttcttgcgtggttgaatttccgaccgtccccgtttcagatatctagcgcgaagaaaagcatacgtagcatttggcaccaccgggaaacagaagaaaaagaaattcccccattactaaactataaaacttttcttgtcccaaactaaaaaacgaattccatcgcgaaccgcgaagacaggcgcgcacgaccaggaacccttttcccacccttcccttctaggcaaccgtgcgaagtggagtacaggagtgtttgttttttcagttaccacgaaccccgaagacgacttctgctgctagcctgctactgccggtgttgctttgttcagagttcagacatgcattgctttggttggtccttgttgtgtggtcgactgctcgtgtgcatgcaatatgcaagggtgtaaaattgaaaatttgattgaaattggaatgacgtgatggaaaagttagaagtttgtgtgtgggtgtgtttagtttacgctaaaattggaagtttggttaaaattggaacgatgtgatggaaaagttgaaagtttacgtgtgtagaaaagtttttatgcgatggaaaagttgaaagtttgtagataaaattggaaacttacctaattaagcctaattaattgggaaatgcgagacgaactttttaagcctaattaatccatcattagcagatgtttattttagcaccacattgtcaaatcatggagaaattaggcttaaaagattcgtctcataaattaatcgtaatctgtgtaattagttattttttagcctatatttaatactctatgctagtgttcaaacgttcgatatgatatagtataaaattttagagtgggatttaaacagggccatagtttcatctgacacgatatggattactaaggccgagtttacttccaaactttttcttcaaactttcaacttttccatcacatcaaaactttcttacacacacaaacttctaactttttcatcacatcgttccaattttaacgtgaactaaatacaccttaggcattagggagcatgaacacaggcaaccattgttgctagagcatgtttgctgctgtaatcatcccacggcgaggattactgcagccgcaagaaacccccttctccgttgttgcaacttgcaacttgcaacgtccgattcttcagaaacacacacacgcactctctctctctctctctctctcttatccactcttggcctcttgcta

SEQ ID NO: 47037 - DNA, 157 bp, Oryza sativa
cttaaactcattgttctcaacaacaagtgaggcatcacaaatagaaacacacgagctagaactagagcaagggctaggcatatccataagatcatcacaagaggtagaaatgctagatgatgcaacatgagcaatatggcaagtagcactatcatca

SEQ ID NO: 47038 - DNA, 1501 bp, Oryza sativa
agctctccagaccatgcaacacacacatatgcatatagataaacatgctgaaattaagaaacaacaagattaatttctaacaatcaccccctaatcttgttgtctttatttgacaccttctcacttggattcaaagcagcgtcggctcgtcgtcggcatccgcaaccacaaggtgcgcctgatggttcttctttgtttcatggcacttcttctcccaagagtagtgaccatactcctggcaattgtaacaacggacctttgacttgtcaaacgtgtcgccgttcttcttgcgatttctcctacgctccagccactgctcttcggtgaggagcaagcggccgccatcaacgccaccatcattgtcaccgggcctgtaccgctcctccacagttcggaggcgccccgtgacctcctcgatggacagcgtcttcaaatcaagcaattgctcgattgcaatggccacctgcacgaaccgagaaggaacaacacgaagaaatttctgcaccaccttctcctcctccagtgggtcaccgagcatgcggaggttgttgacgatggcgttgagcctcatcgagaattcatccacagactcactttccttcatgcggatcaactcgaactcattccgcaaggtctgcgccttcgcttctcgcacacgcgcaacaccaacgcgcatggtcttcaccgactcccacgcctccttggccgtatccttcaccgccagagtcggcaacatctccggcggcacggcacggaggatggcggagagtgccatcctgtcatcctggtactccgcgtagccgggctcaattgccgaccacaaaccttgagcctgcaagttcacgcgcatgacgagagcccagtcggtgtagttggtgcgcgtcaacatggggtagaccaccgagccagccgtctccttcatcaccctctgcacgatgatctgctggccgccattgttgccgccatcagtgccgctgccgtcggcgccactgccgctaccgctaccgctaccaaatgttgggaatcaaagcaactcacgcgaacacagtgaacacaaatcacacttacgcgtgaagagcacaagaaagaagaacacagaacactgagtatttgtggcacaagcacgcaactggtgccttttctcttgcttttcttcttcttaacaaaatgattacaatgagcagctatttataacacagcacatacacaaagctggttgttccgcttctcaagccacacacgacgcccacgtcccgtttacttggccgcaacttcacaagtactgagtcttcgccgacgttcgttgcttgaaccaaccaactaacctgcatgcatgcaaactgaccacttcctactcctaatcttgtgcaagactcggctaatcactagcccataattatgcatggctaactaactaagctacatacatgtgctctcatctactggctctttattggctcactactcactgccaaccactactcactaagccatgcagcac

SEQ ID NO: 47039 - DNA, 465 bp, Oryza sativa
ggaaccctaggtgaaggaataggtgctcatcgatttgcaccaatagagggtagtttcttggtgtgattcaactccttcaactggtaaatccctctcccttttgtgcattgctctcaaatcggtctatttcaatctttagggttaagggtagtttcccctttgcttcaatagacctacaccttgatgttctagttccaatcttgtgcaacactgttctagcaatttttagaatcatttgtgtggattgtggaaggatttgggtatgcttgtgtcagtggcggtctgaccggacgcggtctgaccggccgtgagccgtcggtctgaccggccttgagccgtcggtttgaccggccgtggctctcggtctgaccgcccctgacaggcagcacttgcccttcctctcacttcactatgtggtttctaaaattgttgctcatccatcctttgctccttgtttttcagcta

SEQ ID NO: 47040 - DNA, 463 bp, Oryza sativa
tttcaagcagtaggcggcttgctgcacatggcttgtttttgttaccagtttttttgtcgagcctatgtgaattttcacaagtttacagccatctgtgtgatggtaaattgaggatcttgctgtatgccaattcacttgctagtgttgtaagcatgcatcttctttcagcttcagcagttcaaggctgttgatttgatggtactgaattagttccctgaaatacttcagataaagtaaaagggaaagcaaaataaaagaaaaatttcagttctaccagttcatggcttagttaaaatcttgggaggtgaagcatggtgtttaggctctctcttcttgtgtacttgagagtctgaactctcaatgctgaagtaataaccactgcagttctgctaaaaggttattggctcagtagagaaatagtatatgtttctgacttgtgttctatatattgccatttttcagg

SEQ ID NO: 47041 - DNA, 264 bp, Oryza sativa
gatttgttttgcacaaatgagggctttcagaatagttgaagtagatgtaaagatcggtctctgcatgtgaataattcatttcattggcagattcactactaacttttttagataatgaatttgctgattagatggatggtagtgcacgaatatttagtttgccatttgtagggcatgaaaaaactggatgtttatactgttctaattgaagtaagtgagctggtaaatcagtaatttgtattgactgtttttccttaatacaga

SEQ ID NO: 47042 - DNA, 365 bp, Oryza sativa
ctgctgctgcaagtcatgctctccaaattgagttggccgaagtggaggataatcttatctgactgaggattgctggctgaataaatcataaaaaaagataatgaaatagctattataaaattaaaataatggatttaaaaccatattataataaattctcactttcaaaagatcgcaggttaattacaacatcatcttttcgtctatacttatactttatgctaaaattgaaatttttaaagttaatttatgagttttatttatcatttgctttgaatcgttaacaacacgtgtaaaattattcttattacaagtttttagttgctaacaaaccgtatgaataaacataatcatatgataaaaga

SEQ ID NO: 47043 - DNA, 158 bp, Oryza sativa
cttatttggaccggacgggggcctgacccacgcagacgtaaacgccaggagggcaacccgccgctggctcgctttatatcccgcgtgagctccacaccgagcgaagcggaggtccggaggaggaagcgcgagagaagctcagctaggcagggcgacgg

SEQ ID NO: 47044 - DNA, 485 bp, Oryza sativa
aatgattggagctttagctaatcagacaaacatttgagctcccaacgaaatctccacagtactaacagtccttctgtactggaaaaataaattgcttccacacctttgatagcgaaaaacttcagagcctcgcaacaaacccacaaaaatggatctccgaagcgccaagaatcacatcaaaagtacttcaaactcagaactccaaatcctgtctgccacaggttcctataaccatgaaaatcccagccaaagaaaacccaatctttccaccccaaaaccttcgccaagatcagatttttggcaccggcaacaacaatccccgccacggctccgacgcagtcgggctctaactggcaaaacgcaacagccgcgacagggaagagagcgacgaggaggaggaggaggagctgaggcggagagagcagcggcgcccagccaaacgggaggagaagaaaagtaggcaggaaacgattccagaagcagca

SEQ ID NO: 47045 - DNA, 238 bp, Oryza sativa
cctgcgccccagaagctgatgtaactccaaaccaaaaggaccaataaccaattactaactaactaactagtatcataatcactaactaattaccaagtaagtaagtagtaattactaacttgccaggtcagcatctttagttcttttcacagcttcagaaaggcacaaacaaaccaaaggcttatatcagccagaagcagcagcagtagccagcagccagcagccacagccagcaaag

SEQ ID NO: 47046 - DNA, 329 bp, Oryza sativa
actcttgacaacattctgaatccattttgctccacctgctgaaagtctgaaacactatgcatgtacagtagcacaatccatccaatctgacaaatgatctactgctctgcgtccgaagatatagcagtttctagcattttaaaattatctcaaaatataataatttcttggcatacttattcatctcaatcaaacacaatgtatctcttgtttaatttctttacttactctttcatcttaaccaattacgactagtccacctatttaattttacctttctcttcattacttcatgaaaaaataaaaaaaatattcatattttggtcagt

SEQ ID NO: 47047 - DNA, 530 bp, Oryza sativa
ccagttttgaggttgtgggtaatgattgcgcaagaaaataagggaggcaaaatagacgtatccttttggattctgattttgaatgagagaagaaattgacaagcaatatcacgagccgagcccatttgcccctctgtttcctgtgactagcaagttctgttactgttactactgcgtctgaaagtctcaatgaacttttgctctgagataaagcctatataaaattaccaattcatgtcagagtagcaaaaaataaaaactgtcttggctcttgaatcttgcacggatttatatcaccaattcaaaaacaaataaacaaaagagaaatggagaagatgaatgtagagcacaaccatctctgccgagtgccgacttctcgagcaagtgttgattatgcagaatataaagttgatagtgataagacaacactgtggagtagtagttaagattaattatttgtaattgataatgtcttaagttcatttgttctttttttctcaatgcatgacgaccacttttctgtttataga

SEQ ID NO: 47048 - DNA, 198 bp, Oryza sativa
ctgggcctcactcaaagacaagctgtgatttagctttcaggcgaaggcgcaagctagtttttttgaagatagggtgagtccccacccaaaagaagagtaggtagaagtggtgcatgtggtatccccttgagatataaaaggaggaccttgctcacttaagaggggaagaagggggagaagacctgagctcgtagagaa

SEQ ID NO: 47049 - DNA, 1501 bp, Oryza sativa
gccgcctattcctgtgttgcagcgagtgataggtccgtcttgacctcgtcggcagcgctgtcctcggcctccttgcgccccgcctcaacctctgcctccctgcgcccgcggctgaagctcgggatggagagaaaggtgcgtcgttgccgccgtgcgcttggggagaggtgggagataagtttttattttatatgtttttcgtgtgacttacatgtgggttccacattattttaattctctccttgttgactaggatgccacgtcagcgaaactactcatgcatacttgcatgacctattttatacggttttgaacacttgagggatagagatttctagtacttatagattcgacgtaaagttgggggacgcaaagtggacttgatgaaaagtaagggcctgttcactttgatgccaaaaaaaaccttaccaaattttggcatagttgtcaaaattttggtaacttgctaaaattctgtaatgatttcttatatagttaccaaaatttggcagcaaactaaatatagacacttttttttgcaactttaccaaaacttgataaggttaaaaatgacatcaaagtgaacaggcgttaagtatcatgatgaagaagcggatttccttctgccgtatttgggctgttctgatagtcaccttcttggcccactatctgttgggccattggtcataatgggccgtgcggctcacttgctcacctcgcacactgttcgcctcacacgatgagctcgagaggccgaccacgagctccggcggcggcggaaagcgcagcggttcccggtcgtcggccggccaggtcttatagagagaaaggcttggcagccaggtttcgcgcgggggccgacgtttcctgcacagatctggctcaggtggtagccgtcggccggtcagatcaggcgtggggagtcaggcgggacggcggtgactcggagggagggcgaaacgtcgattcacgcttcagttcttgttccggtttgatccattattcctattcattgattattttttcctcgtttttttccagcattccaattttaagcattactaatagaaacattttgtcgcagtttgctgggtgtgatggtgtgaagaactgaagatctgcagcccctgggccgttggagtgattgttggaaggtcacgcattgagagagtggcaaatggccaaacgctcaatccatccatgctcacatcactcaaggtatcaagctgcgaaatcacataatctttgcgtagtatttgtttcatattgccatattgatgatactttgtacacttgtacattcattgagtcagtacaaactcttgtccagaccaaaaaaaaaaaaaccctccgatgctcaaacctcagcgcagtttctctcttcttttttttttgttctaataccagaatgattaaccaggatgtgcacatatatatatggctacaaatatgcatgtttaaattaactatatatatatattctcgtggcctggaaaaatgt

SEQ ID NO: 47050 - DNA, 1501 bp, Oryza sativa; identical to SEQ ID NO: 37971

SEQ ID NO: 47051 - DNA, 1501 bp, Oryza sativa
ttttctttttcatagtggaatattggtaggattacactgatgtgtccacatccaattaccatggttgccattagtgcggaaggttgatggtactggtgcaagggataaccgtgtcaacaatgctatttgggagttaaaattgaattagaaagttgcgaaactactctgaaaacacattataccataggtgtaaattgttatatagtaactacatctttttctagaaaaaaaatgttacatgcacccgagataaatattttcaacatatggccattatgacagtacctatatatagtttttttcatatctctagtcattttaattgctatattgacagggggcggagacaggagtagggcagctagggctgcagccctactccctactcctgattctaaatattcattgaaattccattttaaaacttcaaaaactagaagataaaggcaaaatcatatacactcaactaattgggccctaggtttggaaaaattctggctccgccactgtattttgatcattttgattcacacaataacaccagcgtttgctcttcggcttgctagccgcactaacatttatattttaaaacttaactttaaattgattttgatgtttttatcatcataatttattttttaacattagcttttaagacgctaataatacatatataaaagttttacttacaaagtatttttttatcgctaataaaccttacgatttaaaatttatttggttactgatctactccctccgtcttgaaataagtacactcttttagttcaaatttgatcattttggaatggaaggagtagtacttagggctgttttggtttgatgccaaaatttgccctaccaaataattagcactttgaatagtaccttatagatgtttggattgatgtcaaaatttaacaaagttaatacaactcctataaaccaactataccaaaatattggtagtatcaaatcttgcccatgatttgacactaccaatgatttggtagggcaccaaaccaaatgagcccttaatccactgttctagtgacataatccactgttctagtgacattcttgggtacgtgcctgtgtactcatgaccactccagaaaaattctatagcagccaacgactagacaacatgctccacctttgcaaatccaattacaaatcgtacacaaaacaaaagattagcgttgaacccaagtgtggccttaccaatttgcacgcgcactctctctctctctctctctcttccccaataaaaatcgatcaggtcgccatcagcctccgcgtcttcccgtccaaagccaagaaaccaaagctgcaagtagccagccagaggaagaagaagaagaagctagctagcttctcgggaaggaggagggaacggagatcggaggcggaggctccaagaaagcagcaagaaagtgcgaaaatctgaggaggaaggagaagggaggttgaatcgatcgatcgatggctcggcggccggcgc

SEQ ID NO: 47052 - DNA, 1501 bp, Oryza sativa
aaaaatattgagatagtttgggcctatttgaaagtagaaagacttatttggaaatcatggatatacacggtgatgtaataactttgtaaattctatctctctccctatttgtaaatattatttatatatatatatatatatatgcgcgcgcgcacatggtggcgctacgaaggaagtagcgcgcctctcagcgctcgccttcctggcttttagttttttctgggtccaacttcggatttctcgcttttctcatgtgccgcatcctcatggaccgcttttactactaccaccgcctgcaaaggcttttcccatcccatttgtcccgagttaaaaagttactcgtctggtgatgtgaacgcttaatgagtaaaaaaattatacggcaagtaaaaaaatcactggatcatctctcctctaatttgcctgtacaccactcctagtatatattaattgcagggtgcgcgacggctattccatttggaaagctcgcgccgctcttcaccattacaatgccaatcatccggtaagcagcttatatgtgtgtgcatcactttcttcgctctttacttatacgtagatgtgtgcttatgttgttcacggattaaattaaattaaattcagggagcggagtatgatctcgtcaagcctttgatggccgcctgcgtcattttcagaggtaaactgtggcatcatgtcagcttcttggctcacaggagggatcagctggttgcaccacccgttgaatacttcttcgcagagctacgcgatggctgctccgacgacgactccatcgtcgaagcttgcaccatgatcggtaagtaaaattaccctattcttacaaaagtcatctacattcagattcagaattattcttattcaccagtctaaaagcaattattcttattcagctttctttctttcttactttcgatcttcccatttcagaaaatccacagagctgctccggaaacaagtgttcgttttgccctgaacaatatcaaattgcgcacccgagcgagcaggagcttttatgtggaaaagaagaacatgccaaggactttatcagactgatgaatatgtccccgatgcccttcacatgctccaccgaaacgcctgagattggaattgtgattgaacaatagcaatatgcatgaaggcattattatggagcatgccttcatattagggtccataatataataaaagccttcatgcatcatcaagtgtacatattatggtcatgatgtaacaaatgcatatgttattggtttgatgctattcataagagaacagaaacggcacctgacctgcttgcacaaaagctgacgttgaacctcgttgcagatgcacaaacatcgatatgatcaaatttccacataatattttttttaaaaaaagagaaggtcgatcattcattctccttttactactagagaaaaatattatcagataattaatcagaaacaaaaatgcatttttttccctttaatcatgttggagg

SEQ ID NO: 47053 - DNA, 1501 bp, Oryza sativa
gtggcggagccagaatttttccaaacctagggcccaattagttgagtgtatatgattttgcctttatcttctagtttttgaagttttaaaatggaatttcaatgaatatttagaatcaggagtagggagtagggctgcagccctagctgccctactcctgtctccgccccctgtcaatatagcaattaaaatgactagagatatgaaaaaaactatatataggtactgtcataatggccatatgttgaaaatatttatctcgggtgcatgtaacattttttttctagaaaaagatgtagttactatataacaatttacacctatggtataatgtgttttcagagtagtttcgcaactttctaattcaattttaactcccaaatagcattgttgacacggttatcccttgcaccagtaccatcaaccttccgcactaatggcaaccatggtaattggatgtggacacatcagtgtaatcctaccaatattccactatgaaaaagaaaaaaaaagattccaaaaccaaaggcacaattttgagaccaccctatcaaggataattctgccattctgctgagctgggaagaagatttgatcagttggaatagggaagatggtattggaatcattctaacttccaaacagaaacacacaggctctataatattaacttcaatcatgacttgacctcaaactaacaattaaacaaactcccttctgcctttgtttccgtgattgaaagagttatggatggtcgatgaacaggcaggaagaaagaaagcaatggaaaagagcaagagaattaacggctggactggaagagaacttttaaagacacgctttcgatgagaaccacacaaattgcccggcttctcacgagttaacaatctgcagcttgcgtgtaaataaaaaggggaaaaatggaaataagaagaggggaagatgccaccgtgtcaacccaagtatgcataaaaatggcgagggctatcatgcacatgaaaagtcaaaaacacacttgcaatagcattatccgacacaactcatcactgattattcgttcaataatagcatcactcacaagcatacaagcatacgtttgttcctttaataatgtttgcataatcatagggtatgtttggctagccaatagagccgctgcacgcagccataactgttgcagctacagacacaaacagtacactgtttgtgttggctgcacaacagtgaagttaagtgcagccgaacagagccaaaatcaacaattaatagtatcattttttaaaagacccaattactccgtcagacagacagtagcatgaaacggaccaaaggaagcagacttgcagaatagtgacattagattgatgaaggccaggagcagaagtgcgtgtgcgtctgtggtccgtccgatcgggcatcggacggtccagatggcgcgggaggttatggctggcgtcttcgtgcggcggccgcaccacacccacccgttgcgttgcggcgg

SEQ ID NO: 47054 - DNA, 372 bp, Oryza sativa
ccactacccgagattccccaggtcaggacaagaaaaacagaccagtattcactccattgcttgcagaagatcagcccgccattgcaatgccgtttcctccagcatcacttcagcaacagctgcatacacattccataaaaatgtgtcaagatcgagatgaaccttctatggcatagtaggaaatttttcttgtaaaagttgcttcatcaatttataactgatgaagaacatccaaaaaatcttcaggaagtaagtacactgcactcaagtacgaaacacataattcgtctgttagtacactactccaaaaggcatccggatttccagccacacagcgatcaagaagggccactaaataatcatcaagaaaaa

SEQ ID NO: 47055 - DNA, 1501 bp, Oryza sativa
cattatcgtttgctgttttcgttgtggttctctccatggtcgttaatgattcatcttcttcaggtgtcagtgtgtcactcggtttagtaattaacataagcagtgagattaaaattcagaattaattacgaatgtttcttttccttctccctttcttgtacgactgtcttttgtgctactgaattttgggacagaatttgatatttgacctttcagagaagattattccttaatccttcttggaagttacagtattactacttctgtattgctagcgagttgtgcgatatctggaaggttttgacggctgaaatacatgtattagtacttgtatgaaaattaaaatctgtgacaacggaagatcaacgcaagagggatcacaatttacaaaatgtcaaactgattgttgaccctgggtaaatagtaaattacaggcagacaacaagtcagacaacacgaaagtagtacgtattactccattccataatacaagggattttgagtttttacttacactatttgttcactcatcttatttaaaaaatattagaattattatttatttttttgacttactttattatctaaagtattttaagcacaacttttcgttttttatatttgcacaaattttttaaataaaacgagtggtcaaacaatgcaaacaaaaactcaaaatctcttatattatgtgacggagggagtactacacaataatacatgtcaggttaggaaagcagaaagataggtttgtgaacggtggcgctcttccttgagtggagcatttgtgaatttgtcatctcatcgactcatcatcgtgcaatggatttttttcggttttagattttttttaaaaatatttacagaaataatctatcggccaaaaaaaattacaaaaatagaccctgccgccccatctctggggcggcaagctgacgtggcaaacgggggaggaacgggcggtgacggagggagggttttttgcaggaaaacccttgccgccctctggtggggcggcaaggggcccgaatgcaaaaaaagccagtcggggccggctattttgcaggcggccccttgccgccctttggccgggcggcaggcctcgctgcctataaaaggcctgctgcccagcccccagccctcattcttctctcctcaattccagtgaaaaaaaaaagaagagaggggaggagaagagaagaaggggcgaagccctgccggattcagacgccaatttcaggtaatattcatagatcctatatgtgactattgagttaaatagtgtgtattctttaaaaatttgtttgaaaaaatgcattatatttttagggttttagttgtactaatctagaagtgcgtattgtagatattagtaactacgtagatatgctagtttggaatcaatacattaccgttgcattggcttacacaagaagatattacgttgtagatgtttattgcatgaaagagtaatatgatctagttatttcgttgacagata

SEQ ID NO: 47056 - DNA, 1501 bp, Oryza sativa
aacaacaaaaaaaattgtatcctggtgtagtgatttgttttatattaaacgtaaaaaaaattgtataccttcacatcgttgctataagctatagttctttgaggtggccatgattaccattgaacatttatcggagctaaagaaaataagctcgttctaggattaggtaaaggataatagaatgttattatgattcgtttcgatgtgcatgaaaacacgctgattttactctgtacatgcatgttatacgtggctaggggactgtcaggacgactgagagacagcaaacagaatccaaacatgtgacttcgcttgagtaaggaagtaaggggttaagcttaattactctgcaagttaacgtgcgtaagttgtaaccaattattccgcacgttgcccatggtttcttgttactactatagctagctagctttctttgatgagtgcatatgcctagtttgtctcatcatgtggcaaactcaatcaacgacaggcatgcatgctccattgcttgttcttccagccaggattagaaggacaaggactactacaacaaattaatttagattacttaaccttcaatttatcaccaaagtctgcaagtatgcatttgaattgtatacatacaaaatctcttgtgctcttcaagtaattacatgattcaactatgtgttgttcttttttagttcatatacaatatattgtcatcaattatcacatccacacatcattgcaaattctgacagaaaacacaagtgcaatcaagcaggtccccaacaacgagcggacatcattaagcatagtacaagaagatctgctagataaacactgaaaaatcaggtttgagtacacaccaaatcaaccagtagacttttattttgttttatgtgtaatctgtcctgcttacttgtgttctaatttctatatatatgtatatatcgagggaaacagctgtgtaattgcacatcatcatgccaccagtttgagtacaaataaattagacctgtcatcataatggcatatttacattaattaattagttagtgtaagagacagccataagctaacttttgtggattatgacagtactccctcaattctaaattggtctacatatttcatatatacactaagatcaagaaaagctaataactctctcatactatatttactctaacaacaaactcgatgcatgcaccatccatactattttctagccaatagcaaatcaagatattacatgtgtgttataaatatttatgtgcatgaatgtatgcatcaatatccatttacttcaatacacaaataacgaatagacttaatgaatgaacaaatatgtagatcgatttggaatggaggaagtactttttaatcacaagaatactcccttaaaccgttgggcgcggcaaccaaaaatacacgttgtgcaccaatgtcaaccagagtttcatacgacgtactaggaattaatagcctaaactttttaattcctctttttttcagg

SEQ ID NO: 47057 - DNA, 1501 bp, Oryza sativa
atttacccagggtcaacaatcagtttgacattttgtaaattgtgatccctcttgcgttgatcttccgttgtcacagattttaattttcatacaagtactaatacatgtatttcagccgtcaaaaccttccagatatcgcacaactcgctagcaatacagaagtagtaatactgtaacttccaagaaggattaaggaataatcttctctgaaaggtcaaatatcaaattctgtcccaaaattcagtagcacaaaagacagtcgtacaagaaagggagaaggaaaagaaacattcgtaattaattctgaattttaatctcactgcttatgttaattactaaaccgagtgacacactgacacctgaagaagatgaatcattaacgaccatggagagaaccacaacgaaaacagcaaacgataatgtggtctgaggatgatgagccgcccatgttgaccaacctactccactaggctgaccaccactgcaaccatcagctcatcaggagcacgagcacgaggactcatcaaggccgtccatggtccattggacgcctgtgattgcttcctgagggagactgtcattcgtgaacgtccacataccgtgttgcaacagcaaagtcgatgtccatcctgactcggtctatttatgctcataaaccatggtctcttgtttttctctctttctttcgatgcttcgacgaacttgactatttgcttcttttacttcttaatttaaaaaaaaagattatttgcttcttttcttaccaggaacagaaacaattgattagtacaaaatggtacttcctccgtttcacaatataagactttctagcattgttcacattcatatagatgttaatgaatctaaacacatataaatatttagaatcatttatatctttatgaatgtaaacaatgctaaaaaaaattttacattgtgaaacggaaggttgtacaaaacaaaatacatcttaaaaaaaatcacttggggttacatctgagaaaaaaaaatcttaaggattaacaaaccagctatgctctcattggatgtactagtatcatgtatgatatggaagcattttatgtaaactaattgagcacttgaggtgttgaagtggcgttaattagtccaataagcagacgatttgaccctaatagagtcattacaaggagcagcccggtcggtcagtgtgtgtcactgtctctcaccctcccaacgcttagacatttcaacgttctcctccacagcaacagcagcagcagcagcatctcctcttcttcaccgcatctgccagcctagcgagcctaatcaggtcttcgtcttcttcttcctcatccccgtgccaataccgatttcgcgagctccgatggattccgcgagagaggagacgtcgccatgagaggggaagccgagctgtgcgtgtagctcgctgcaatcgctgcgccggtcaagaaaccagccggaatcggcggctgattccggtggaggaagatgcggcgga

SEQ ID NO: 47058 - DNA, 1501 bp, Oryza sativa
gtctttttattaaattcatagtattttatattaagataaatagttaaacattatgtcgaaaaatcaaccattgaatatttaaaaatggaggaaacaaacttagcatagcttagctcgctaggttttctgtagtggaacctacccactgatataaccagccatatttaaatattagactcaacacgtttaattgctcgtattttttattaactattcttttggtggtaattaagtgatgtacccgttaatagcaatatgtttatattaactttaataatcttaaggtatattggtctagtttttggatgtgctcacataagaatacacgcgtgcgcctagcacctgccttatatatgaaacacacttgtagcaatcccagtatttgcacacatgatcgaatatatatgtttggtgaaaagtagtacggagtactagtgttcagtagaaatgtatacatgggcctgtgttaactgaggtcagagctacaagaatctctatgcactgtcagatttgttggtgaggtcaataacactggtgctagcgtttagtcaaagatatcatgccatagatttctagatgcatgtccttgctagcattgtcatgctcatgccagtagtacgtctgctaaaacttaatgtatttttcggtattaatttcatcagtattactagtatgatataggtttgagtactcattttgcaacttagcgtatatttttagtttttttttcatcagtagtcacgtagaagaagaaaacatgaagatcgcacttgtactgcatgttcccgattggaatagccattgcatcgtaggttgcatcattgaaacagaaaactacatttactagaacttatgatgtaccggaagaatctttgcgcagcatagattattatgcagaaagttcatgtatatgaccagcacgacacaacctccaattagattgcttgatcatgctaagctgcacttctctgcacactactaacagaccaaaatatacagtatttgtaaacttagtgcaagtacagatttctttagtcaaaacagcaagtatacttgatcatttcttaatcattattgaatcttgatggacaaagctagggttgtagtaggcttgtagccaggaatctgctgctgggtaaaaatgagaaaaatatattaattagttgatgtggatgatgatctgtactacatgcagccaaagtcatgtgctcatggctacttcaaacgagtttgtggtgtacatgctggtcgttgatgattccttccctaattaaacaaacgaatttaacctctcttaaatttatcttaaccgctagtacgtacagtcctagctagcgagtcaaaatggttaatcgatcgccacctggaccatgcatcctctctctatctctatataagctgcctaactaacactaactaggataccaaattaaagaaagcatactaagcttagtgtgtgttgaatcggcgacgaagatgtcgtcgtcggcgacggtggtgc

SEQ ID NO: 47059 - DNA, 1501 bp, Oryza sativa
aaaaatttacgactcttcgactacaagagagagagagagagagagacatgatgaatcagttgcgtgtgcgtgtttaattagttgccacaaaatggtaaacggcgtaatctacggggaaaatgcagattatttggcaggcaaggtaacgaacctcctgtattgttggcaacgcagacagtttagaattcaaagtcaaaacaacctgggcgtgaaggatcattaatctgcaaaccgggataatctaatctaattaagaatcgatccgagctcgtcacgcgcgccatcacgttatagttcatcgatcccaaagttaattagagtactagacaacaatttgattaatataaggctatgttaggtactcagtttttccaatttcaactcctttgttttgcatacacgtgtcttcccaaactactaaatggtacattttcgtaaaagttttgtatagaaagattgtttttttaaaaaaaataacaataatttacttttaagttattttagctaacacttaagtaataaggtttcgttttctgtgtagtgtgatgaatgacgtacctgcagcgggggtgatgcagacgaggccggtgatcatgccctggacggcgccgacgacggagggcttcttgaagaagatgacgtcgaggcatgtccagacgatgaggctcatggcggtgcagatgttggtgttgaggacggccatggaggcgacggagttggcggcgtacggaccaccgccgttgaaccctgcccaccccatccatagtaaccctgcccccgtcagcgtgaacagtatgttgttcggcgggaacctctccctgtccttctgtgcccttggccccacctgccagccacacattgatatatatgtacacttgtcagagccacttcgacgtcggcggcggcggagtactattgtttagcttattcgtgaacgataagtaattcgtgaataaaacttttatatatatgttcttagcgaacttaaaaaaggctgaaaaataaacttcgatgaaaaagctccaaaatcagctttaaattaatataaggttaaaaattttaatattggcttatgagtataagcataagcgaaaagatgagactggtggtacggacccagtaggcggcggtgaagccggcgatgccggcggagacgtggatgacgtagccgccgcagtagtcgatgacgccccagtggaagaggaagccgccgccccagagggagaaggcgccgacggtgtaggagaaggtgagccagagcgggacgaagatcatccaggcgaggaagctcatgcggccgaggagggagccggcgacgaggatgagggtgatggcggcgaacacgcactggaagtacaccaccgtcgccatcgggtacagcggctccaccgccgccgtctccacgctgccgtcggcgcggtagtggaccgtcgccggcagcgcggcgcggccgacgaggaggccctggtccagcgccggccgcgccttcccccagatcggg

SEQ ID NO: 47060 - DNA, 1501 bp, Oryza sativa
cctcaacagaccaaaagaaaagaacaattaaacgttgaagcactcacagaaattcaggtatctgatatatttgtttttacatccctgatacagatagtatggaaaaggtgctgttcaagatgtaaacaaaactaacatgctgaggctaatccatctactataaatgtgttttgtttatgttaagagaggttttgagtaaccgatatagaaatagacaaatagctgggaacctataattcaactgtaagttctgcacattaacgtagagcagaactagaacctaacccagcaacgggtgcactgcgccatgcagtcccctcggcagtccacattgtaccccaaaacttttggattccttaaaagaagactccggagtgtttttccatttattccccagtcactgtccagcttgcctacattcagtttcacctcgctgtcaagatcacatccaagtacttctgggaatttcttcagcaatttgcgaaggtcatcatcggagagcccaagagttctaatgtagttcagtactccactaaccacctcagcatttggaacctccttctttctctcttcactccagtatggtgaatgaatccatccaaatgccttcttcagcattttgtcggcgtcttcaatggagtaatccagtgatgttagtatctgtttggcttcttcccatgttttgttgtcaccagcatcgacaacggtagcttgagcttgatcagcggagaatgtcctccattttctctgagtcctactattttgagtttttccaaattcaatgtttggctggatagttaatcttcctccatatttcttcttggaaaatctcgcatttggtgaactaaagagatcacactacacaaaacatgaatcactcaaaattcatcaaaatacattaaatcaatctgaagcaagctggaactgaatgtgatatagtgaaccagttttttcaaggaaaaaaaagatagacatatagaaatagagaactcctaatggagatatcaagcttgttacaaactagaggtaacataataaaagtataaaacaccgcataacttattacataactccaagtgcagaaacacagtacatggcccttcactgaaaacatagatttttgaacaaatggagaattggtaaatgatgtttgagaaaagcatctagtattgaacatcaaatcaatgagaatgctgccagggacctaaccaaaataaatacttaaatgcagtctgaatttgctgaacgtgtcgaggtgtaaaggtatatctaagtatctaaccactggatgactgaagaaccccacgcacatctgtttcattaaacgcatttgagaggccatttcatcaaattcatatggtgtcatagtatatgatacataagtagtcagctggcacaatatttttttttcactgaacaagacatttaatccttatgtggggcgcacgttcatataaagagtgccaataaatatagtccgacactgaaaggcgcacatgct

SEQ ID NO: 47061 - DNA, 1501 bp, Oryza sativa
agcaataaaagatcattgtacttagaattttaaaatactcgtaatcagttctcaattggaacatagaatagttgtatacctatattatgcttctgtttgcatacccatatttttagtagtctggacccatacatgcaagtattagaacttggatcctttaccttttgtattttcttctttgatgttgaacttgcacaaaataagagcagtttcttcctccagatagtgggcgcttcagtttaagcactaactgcaattctggatgtgctcatgtgctatttgctaacaggtatgggattacactggactgggttacacaaggtatagtgcaagggatgtgggaaaagaatatctcgggtatgctctatgaaagcagctgtgatttatgactaatttctgtcaccaactcattactaacttcttatttattaattcaatgtttagatgcgtggtggagaacaaggtgctttgcaactcactgttgttacgattacaggtttgtcttcaattgacatatttgattttttttagtatctgcatggagcgtgatgtttgaactcgtctaataccactttaatctgtaaatggaattgtatgcttccttgcatatatttggaatagaacattcttaccatctatgcattcaagacagctaaatttatgaggcctttataaacacacacacacacacacacacaccattttatggttcctttcctcttggttaaccaatatagtttattagcagtaaaggttttgtgataataatagagtaaattgcattagcggtacatgaacttgtcaggtgggtgcactttagtgtatgaacttataaaatgctcgttttggtgcatgaacttgtttgatacatgcaaactaaggctaaaatgacacgacaagaccgatttttctatgctgaacattataaattataaattagtagatgatgtgcgtgcacatagtagaaatgttatatttgtaaacttactttccactttatctttctttgtttctatctcttacatcattactcggttttttattttatgcaatcgttatgcctatatgtttatccttcttagacacatgtttacatagagtttaaatcaacaagattaaccttgatgtgcgattttgaccttgttcgcacgcaccaaacaagtttgtgcaccaaaacaagcgttttacaagttcatgtactagatgcacccatctgacaagttcgtgtacctctgatacaatttactcataataatactcccacccatgtgtaggacagagtaaacctacatagaagttgatggtcgggttatttgcagccagataatcttacctttatttttagtaaggctaatgcttaaagatttttgcttgatcaggaggaaaatggagacattgaaaagatgatctaccctactagactgatttctcttgctttgccatcaaagagcagacaagcaccaacaagggaagcaatatccagtggttaccctccagaaga

SEQ ID NO: 47062 - DNA, 269 bp, Oryza sativa
gtgtttgttcacactaaatttgtaattttgaatattgaataattgtctaattgccgaatttcccatgaataaatccatttgttcattttagatgagactggcccttgtagtgcacatattatgttgcacaaatctttgtagtacatagattcttgctatgtgcgatgcgttatgacactgaattgcatccaatacctcctagatgacagttaatttgggtattcatcgtgttcaaagctcatggttttactgcttgaacttgttgaatg

SEQ ID NO: 47063 - DNA, 1129 bp, Oryza sativa
cgtcaatcctcccggtgatccttttttttttcctctccctcttcttcttcttcttcttccgggacccaacaatgatcaagttgcttacttgacatactaccccatctagagtacgtacaacgtacacaatcacaggttcactctgctacacatatcagcaattcagcatccgcaaagctaacctctgggggggacaggtatctcaccgtttgctgcatgcttagcgtggccttttgcttgaaaacgactttaacaaacgctctcgagtctcgatcgcgctgtgtatcagttctggctttttgagcgaaaatgacgtgcctgtagcttggtcgccgtctacaagcttagctggagactggagtagcatccatggcatccatgcaatccttgttcatggttgttgcattagtacatcagagcctatcctatctagtcctgaactcaactgacctctgaaccaacgcaaacggtgaaaatgggaggcggggaaatgcaggtgcagttattttgtttcactgggcatacatcattttaaaagaaaacacaactcaaatggctaggaaaagttgataaaaaaaaggacagttaattcttatgtcatgctacatgttgcttcctccgctctaaaataaataaacttttatacacaaatgaggagtacgacgtttctattttgtaaagcactgttatatagaaaaaaagaaaagaggaagaagaagaccaacaaagactacgagagtcaacaggtgctgcactcatatgcatcaaaagtttaaaaacataaaatcatacggagtaatattatgcagtcacaggaaaacaggtcaaagacagcgttcctctacgcgggaacatcatccccgtcctaggaaaacaggaacttgtaaaagcctctagcaaatagcgtactacgttccttgatccttgcttctcaacctcatcgtcccaagaactttatgttttttgtacccatggattacctatctatcccattgaatactaataccataattttgttacagctcttcttttaagctcatttgaaacgcaagaatctaaaaatacatgaataaataaacgtaggattgaagtgccataacatgtttaatcgcacaagaaacaaaaacac

SEQ ID NO: 47064 - DNA, 1501 bp, Oryza sativa
atattctgcactttacagtgacagcaacagttcaagaattctgcgagcattgcatagtgagtaaaccatatcggtgtgcagaagaatgcatgtaaacatggtcctaactcctaaggtagggcgcctttacagcccaaatggcctacagcttgactcgaattatggccagaggaacagcctgaacctttctcaggggcaaagtggcagcggccgtgacagagcagggcagggacgctgcagcttttgccccagtgcagagataaaagcaattcactgaaattttgtgaagatcttgttcatggagatagtaacagcatatggatcatatcgaggagaggataaaagccccccgcgtcgtgatcattggtttgcaggaaagtgcagtctgggatgaaatagtgcaaccattggacgtttcatcattgtttggcagttgggtcagcagctgtgcctttcttctcaaaacatcaagagagcaaactgcgcttaaacgctttccactctccatgacttgcaatgcaaatcacaatttcacaacatcaggctagtcacacaggaataacataccaccaccgtgttagaccactaatagaccagttgccatagcaacagtgacatgacaatattgctaaaaggttgtgtactgattactgaaccaaacaccatcgtcatgtcacagatgacagaaccatggcaacggcacacacacacactgctagaaaggacagacaattaatcgcaatttcacaaacccaagaatccaaaagacttggtatctacaattgctgcctctgatgatctatctgatcacattcttgattcttcaccagctacttactagtattctccggcctaaaatcaagcaaattcacacaaaattcacccatggaaacaccagcggaaatgggaaattaagtacggcaagccatacacacaagacaaagcaagactagctccaagtacaaatcaaccccgcgcgcgcatgcaatcacgtcgcaaattgagctgcatagctgcggcgcgcgatcaccgggactcctcctgtgctggccgtctcgtggcggcgccggagagcgcggagagtaggttgaggtggtggacctgcgccaccgacgacgcgtacgcctgcgcctcctgcgacggcgagacgagggcaccccacgacgacacggcgggccgcggctgttgctgcagcgcctcccagaacgtcggcgcctcgtggtcctcctggcgcgggcgcttgccgaggaggaaggaggaggaggcggtggagggggcggacgagcaggagaagacggccggggtggtgccggagccggtggcggcgaggatggacggctcggcctgccggagcagccactcgatggtctggccgtcggacttgagccccagctcgcgggtgagctggaacacgcgcgccgcgcagacgatcggcatgcgcacgcgccggccgcgcccgttcaccttgctgtgccggtccttgccgccctgcgtcgccgcc

SEQ ID NO: 47065 - DNA, 159 bp, Oryza sativa
aatttgcggtggatgttgattgtcagaatttatacgagtctattgtgggcctgttcactttaatgccattttcaaccttaccaaattttggtaaagttgtcaaaaaaaagtggctacatttagtttgccgctaaatttttgtaactatataagaaatca

SEQ ID NO: 47066 - DNA, 566 bp, Oryza sativa
cccccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcatca

SEQ ID NO: 47067 - DNA, 187 bp, Oryza sativa
cagttataaactaataaacatataactgtgcaggaaggacagttgagctacactaacctcatacaccaaataattcatagtccaactgtcaccatacagcaacaaacagtaagcatatcaacttacattatatacctgacaaaaaaaagagaaaataataaatgaattgatatgtaaactatgaata

SEQ ID NO: 47068 - DNA, 354 bp, Oryza sativa
gaattcgagctcggtacccccgatagtccaactgctagagatagagatattagtgtacaccacgctgacatgtcaacgtgttgtgccacgttagttaaagtggcagaaaaaaatttaagaaatagtcttatctctcccgtctgctaaatatgtaacaacaaatccaaaagtgttatttgaagagtggcacagtttggtattgtaataaatactgtagttaagccccccacagtagctctaataaaaaggcagccagtatatatactggatatagctggtcgtcgtctttgcattgtctccttgtccggtacgttggttggctctagcttagctggtgctcgatcgcgaacatca

SEQ ID NO: 47069 - DNA, 626 bp, Oryza sativa
cgccttcttccacttcttgccttcccctcttctattccacttgtctcctgcatgcttgccagcgctggtggtgggctccgagttcagccacctcagcgagctaggaaagcaggagtaacaccggcttccaacagctactacctgcagccctgccttccgtctatatataaaccccccacccctttttttctcttcctctcaaacgctccatcactcgctggcgccagagacaaccaccttcccaaaccccaccacaaccttcccttcctacctcacatttgagcacacccacctttgcttcttctctcgcggaaagcgatggagccaatagaggaacctagtggtaaattattcccccatttcatgatacccgaggcgacagctgggatcacatcctcctgcatagggcatggtgggaggagaatacgatgttcgtccaagactaggactgaacatggccttcttctacttctatctcttcctcctctacttcattttctcgaaatagactccacgctataatatccaatccaagccgtcatcattgcgattgattgtcgttggctctagcgagttgtgatctgacctagccacagcttcggtgatttttgtttgcgttgtttagt

SEQ ID NO: 47070 - DNA, 1501 bp, Oryza sativa
ttccagtcacgtacgcaaatgagattcccatatctatgctacaacatgatttgggaaccacacaagaaaagacaaagtgatcgggactaagatgtggtcggccgaaccacccatgagcaatggtttgcacaattcctcactgaacctcccagaatttttagtttaaatggttcttactattgaaaaatatctggaaaatcaaactcaagattacaataaactaggacgtcttaactagggtatatgattttccttgaaatgacttgcatactctttattcttcacataatacttgttccttgtgaacataaatttataggaatatatcttatctaagtaattgatgaataaaagatggcctgataaaatgaactttgctcttatgtgttgagtattttggaatttttatgaagaaaaaggtataactttacaaacttctcaatgatgcattattcctaccaaagtcgtatgttgatcatattgacataccttacacatgagctgcatcttattacattgagtttagtcaaattgttgagaatattgtaagattctttttatgatttcaagatcaagatcacggacacaccacaaccatatgctatatttctacactggaagttagcaacctttgcccatccaccaaataatgcctccgtatacctatgatcctctctccaactatccatccaaaatgagacttgtgctaaagaaatgagaaaaaaatagatatatgctcacaaagatatcctcgagcgtgaaaaataaaagagaaagagaaagcaagcacccatttctcgaagtgttgctgaaatatttgtatgcaggatgttatatatgaaaatacacctgccatgtgaagaaacatacctccggccaatcaatcatgagcacagggattgaagacccacaaataacagcaaaccgacataattgaggccaattcagtgtgtcatgagagcccatatgtcagcctcacagaagaaagttggtggctagtgacagtggaagtggttcgggcgtcacgtgaagcttcctcattggttccctatgacggtaatggatgaaatggacttaaccacgttcgttagtaactgttattaggcatcaataaaagaaggaatgagcttcaatctcaacacacaactcaagtggagatctctaactttcattcaaggctactctctagcagagtgttagaaaatatggagagagtgagggcaaattccaacagcagtctctcaactcttgtacctcggcagatgtatgttttataaaaatgagtactcgatatttgttctgggtttttaaattttcttgtttaagtaaaatatattctcatcattgcagcttcatcgcttaatattttatataaagtgctccaatactcaggctgtataaagaaggaaattcttgcaccaggctagctatattagtaatagataatgtagatgtagtgtttatgttaaggattgcctttgtttgttgcgtgctccacagg

SEQ ID NO: 47071 - DNA, 167 bp, Oryza sativa
tctatacacagtgaaacattgtgagtacactaggtgaaatattttatgtggaacaacaaataaaacgaattcccttaatagagtatttccaaaatatgtgggtgatttgttgcaacgtggtgcgtggtggggacacgtggcaggagcggcgcagtggtggggataca

SEQ ID NO: 47072 - DNA, 303 bp, Oryza sativa
acccccccccccccccgaaattttttatttttgttttatttgtttgatatttttttcacgcttagggacacacaagaaccaaccatagaaaaattgaactcaaatggatgtaatatgtgatatgtagaatttttcctctcctctcctctctctgaactagtgcagaggagagagatgtgcaacttttttatttttattttatttttttgatatttttttcacacttaggaactcacaggaaccaaccacgtaaaaaataaactcaaacggacaaaatatgtggcatgtggaattttccaaagc

SEQ ID NO: 47073 - DNA, 441 bp, Oryza sativa
tggacagaaagctcgtggctcgttagctggctcggctcgtgacaggctcggcttggttcggctcatttgaattttctaacgagccgagctggcattttagctctttagagataacgagccagctcgagctggctcgcgagccttaacgagttaggactccatcacagcccaaaagcccaatacaacaaaaaggcccaagcccaagacactgcaaaccctatcctcactcctcactcaattccccactctccccagcagccgccgccactctgcctctcccccagccactgccgctccacctctcccccagccgccgccgccgctccgcctctcccccagccgccaccgcctccgccgccgctaggagatcgagtgcccgccgccgctcgtctctgcctctcccccgcaagcgcccgccgccgccggtctcctcctctccct

SEQ ID NO: 47074 - DNA, 1501 bp, Oryza sativa
ttcttcgtgtcactgaagattagctacttccatggcacatgctgaaaaattcacaaatcattgaagtcagatataatttgatgtaacaatcaattgtaggaaaagaaatgaattctgcaaattagcactaggtgtgcagctgatcttaaaattcttccaatagtagtgtatggtatgacagtatatgctccaagtgatatggaactatgaaaaagactacatagtagcaaatccagaaagaaatgcatagagcatgtttcagtatcagctatgtgctataggaatggcacatgaaaagtagcaacattgctgttgcatgaagatatcactttcagattccattcaaaaaattacatcacttttacccttgtaggtatgaccaaattctacagaaagtaaaagcctaactccgtagccagattcagctcatcacttcaaaatcataggcttaaagcgccagatagaagctgattgcattagattagaccatagccaaattcagctcatcacttcaaaattacagatcacaggcacaatttctccatctgtaaccaagttttattaggtccacctaatctaaggtttaagatcagccaaaaaaaaacttaaaagtaaaagaactaattatttaggaaataaaaatgatttacttagtaagttagctgttttttttttctcaactcaaagtagattttgccagcatttggaattagcattcagacatgtctttaatcgtgattttgatctaatagaaggtacagttcaccttaaacattccccactaaaaaaagaacacgcaactgacgcctagatgcttgcctttcccccattttttttgtgaaacctttgggatccttgacaaaatttaaagaaagatgaatgttgatcaagtagcatattcttcccctttgacaatccctagtgcaagcactaaaaaaggcaagcattgctaatgccactcaacacctcttagcttaaacaactgaaagggagaagaaaggaagaaagaaaaagaggcatctggtgctttgcaatcatgccattgagtggttatcaatggcaattgccaatgccattagcatgccacctctgttcaaagctcctgtcatcagtcaggcactgacagtgtcactgcaactgcaaaaaaaaaaaaaaaaggcttgtgcaaccaaagaaaagcatccaagaagagcagcatcaatggcgcggcgcgacataagctagcccgtgtgtcgcgaaaaggggcggcggccatggcagcaatggtggtgcatgggtgaggtagcctattatcagaattctccctttgctcccatttctttaaccctccaagcaaagcttcctcctctgtcgtatgatcagcgtgcaaagtggagattccaaaccttcctctccaccaacaagtcctcctccggcgcaggcacgccacgccacgccacggcgtggacaaggccgagcacataaggcggccgccgccgcagccgcagccgcagccgcagcc

SEQ ID NO: 47075 - DNA, 1501 bp, Oryza sativa
acatgctgaaaaattcacaaatcattgaagtcagatataatttgatgtaacaatcaattgtaggaaaagaaatgaattctgcaaattagcactaggtgtgcagctgatcttaaaattcttccaatagtagtgtatggtatgacagtatatgctccaagtgatatggaactatgaaaaagactacatagtagcaaatccagaaagaaatgcatagagcatgtttcagtatcagctatgtgctataggaatggcacatgaaaagtagcaacattgctgttgcatgaagatatcactttcagattccattcaaaaaattacatcacttttacccttgtaggtatgaccaaattctacagaaagtaaaagcctaactccgtagccagattcagctcatcacttcaaaatcataggcttaaagcgccagatagaagctgattgcattagattagaccatagccaaattcagctcatcacttcaaaattacagatcacaggcacaatttctccatctgtaaccaagttttattaggtccacctaatctaaggtttaagatcagccaaaaaaaaacttaaaagtaaaagaactaattatttaggaaataaaaatgatttacttagtaagttagctgttttttttttctcaactcaaagtagattttgccagcatttggaattagcattcagacatgtctttaatcgtgattttgatctaatagaaggtacagttcaccttaaacattccccactaaaaaaagaacacgcaactgacgcctagatgcttgcctttcccccattttttttgtgaaacctttgggatccttgacaaaatttaaagaaagatgaatgttgatcaagtagcatattcttcccctttgacaatccctagtgcaagcactaaaaaaggcaagcattgctaatgccactcaacacctcttagcttaaacaactgaaagggagaagaaaggaagaaagaaaaagaggcatctggtgctttgcaatcatgccattgagtggttatcaatggcaattgccaatgccattagcatgccacctctgttcaaagctcctgtcatcagtcaggcactgacagtgtcactgcaactgcaaaaaaaaaaaaaaaaggcttgtgcaaccaaagaaaagcatccaagaagagcagcatcaatggcgcggcgcgacataagctagcccgtgtgtcgcgaaaaggggcggcggccatggcagcaatggtggtgcatgggtgaggtagcctattatcagaattctccctttgctcccatttctttaaccctccaagcaaagcttcctcctctgtcgtatgatcagcgtgcaaagtggagattccaaaccttcctctccaccaacaagtcctcctccggcgcaggcacgccacgccacgccacggcgtggacaaggccgagcacataaggcggccgccgccgcagccgcagccgcagccgcagccgcagcaaaagcttcgctgcatctcacaatgttaagc

SEQ ID NO: 47076 - DNA, 659 bp, Oryza sativa
aagcccaaatccaagagcagctagctagctaaccatcaaaagaaaagatacttcatctttcttgctccaatccaagttctccatggatttctgatgtgatcaagattcaagaacatgccactgcctttcttggattaattcttcctttcatccttcctttcttcgttgattcagttcatgtatagattggtcaagaaaatgacaactacacccccaatttgtacaattaattagattgtgtaattgatttgaggtgtgcagattaagatcatagtaggtcctaattaaggggaaagaaagggtagtggaaacagtctggcatggtaaagtaaaaactgattaggaaaagatgtagtcttgttgcaagattgaacaagaccagtgacttcttttcttgcaagctttgttgcttggaggaaacaaattccatggaggggaggaggaaaggggcaaaaggataaaaagagaacaccatgaaaagaagcaaagctactcctatgtaggaaggaaatgtgcttttggtaatggagattgtggccctagcgccatgcatgtgcttcttctcctcctttccatcccttgatccttgtcatgttctttcgcttgcttttgtttcaaggattatctagaagaataagtgaataataaccagtctcaga

SEQ ID NO: 47077 - DNA, 644 bp, Oryza sativa
caagtagccgtggaagagtttgttagccgagggaggcggtggcatttgaaggcgtcgcgagaagacgcaggtcgctctctgacaggtgggtccccgtttcaactttggtcaaccgtagtcaatgacgggtgggcccgaccacagggagtgagtgcagcagatttcgtggtacagaatttgctcaaatgacgcggcgcaggttcgggattgcatttcagtggactctgcaaatcttatatacaaagagcaattttacggttattaaggaggtaccattttttctattgcaaatttggtacctcttgatacctaggtactacgaggtaccataaagtaccaaaattttacactaaaattttggtatctcatagtacctcctcaagaaccatagaattgctcatatacaaaatgcagagttctgaacttctgatcgctgctgcaaacaaaacaaatctgttcaatcctttcaagctgttagtttttacacaattaggaggatccagtgattcaatcgacccattttacagaactagctgccgtggattgctaatcgatcgggtccagtgattcagaactcataacattcagttactgtcatcactcattagaattcataatcatgcacatttctaatttcttacagt

SEQ ID NO: 47078 - DNA, 171 bp, Oryza sativa
gatgcagtgggaggtgcttcccgtccccacaactctcttcaggcgagacatcccggccatgggccatgtgagctcctcctcctcgtcccctctcttcttgcgattcttgaactcgtttgcgccaaagattatatcgatttgagttctaattgtggcaattcttgatgctga

SEQ ID NO: 47079 - DNA, 316 bp, Oryza sativa
tcatccatccatcatgcgccgtgcttgtgccggcccggcacgaataggcccatcgggccattgggccggtgcttgggcggcgtccatgaaaacgccgtgctggcacggcccgatttggcacgaagcacgctgggccgtgcctagcccggaacggcccatgtcccagctctaaccgtcgctaacaaactcctcctctcgtcttcctccgcacgccacgcgcccacgcctcgccgtcgccgatgagaggagaggagcccgcttggtgacgcgagcgcccgcgcgcgcgaggcgaccaccggcggggcggcgggagcaa

SEQ ID NO: 47080 - DNA, 1501 bp, Oryza sativa
cggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaaataatagtgagtcataagttatcccaatagtgtgctaatgtttctaagcagagctaagcaattatatctaatatctagttgaaccaatatacatagcccaactagtcaagttataataacccaaggtatcaaggaataaagtaatcaagaacaaaagggctataacaatgaataggttaattccacccaatgacattcgaaaataaatgcaatagttgaaaagaaacaatagctttaaacgggatcaacatgctcaaagggttgtttgggatctgtgtgacttcgtgggatagcgttggacagcggatgattaatattaattaattattacaactgtttaaatctttcaatttctgtttataaatgctcgctttatgcaaatgaaccacttcagctcttctttgatgattccctgcatcatacccctattccggtatgacttgctgagtacagtgggtagtactcagtcttgctctacttttcccaaccccagagttcgagttcgggtcagatgaaggtttcttcgaggagtaggctttgtccgtgccgtcgaggatgcctgtggagtggtgttcccgctgcagttttagtcaaggcttagctcctgttgtctttttttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttttgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttttcaaaacgagtcagtctagggttttagtaaaactattgggatttattcgtcagtcagttgggatttgatgggtgaaatgcattaggtcctagctcaggaacatgggttgcaaggtatttatgctttatttgttattattagtatgtatctaatttctcattattttatcgttatgtgagtctgtcttttttattcgctctcatgcaaaatgatctatgcataaaaatttcgctcttattcgattcccttatttgagtcttttattgctttatttaaatttggatttgagcatgcattgatcctacccctttgtcttctctagatggccggtcacccacccaaccaccgcggagaaggcatgatcaactttgtggcagagttggcacgca

SEQ ID NO: 47081 - DNA, 1501 bp, Oryza sativa
gatatcagttggttggtcagctcgtcatccagacccgccatgaacttttcctgcttctcggcgtcggtgcggacatcctctggtgcatatcgcgcgaggcgattgaactcatggaggtactctgtcacagtcctgttgccctgatggagcgcccggaattccctcttcttttgtgccacgaccccatctggcacctacgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggaaaaggtgggtggcctgacacgcaggaactcaggcaacttggactgagggggagggggaccaaactgttgatgctgctgttcggcgtgctgcagcatccgctggtgcatctgctggtgctgctgctgcatctgctgcatcatggctgccatcatctgggtctgatgtgccattacttgggctagcgtcggattctcgggaagtggtggcggaccattgccagaatcgctgtggggatgcgccccatcagtgcgctcttcgccgttgctgccctcgcctgtcgcgcggctaccattcctggtgtagaccatctggaggaaaagcatacggggagaagaagaaaaacagatgctcagaaactaagctttattacataggaatttaaactgcaattgttctgatctgaattaaaacacttaaagagcaagcaaaaatccttattaagacagccatatcataggcacatgatatcgaccgtcgactgaccccaaacaagcaacctaaacacacaaactaacaagcagaagctagacagtcgataaactaatggaaaacgagcctaatgctcggaacggctccttcggtcggtggagtcgaaggcgtcctcctgctcgtcacccggtacctctgagcgactcccggagcctggcaggtaagtctcgccgctgcctgactgtgagccactggagctgctgctactgagatcgcggctgccactgggagtagcagacaaccaacttccggtgccactggctggacctctggcggctgatgctggagcgaaggagagagcggacgcgggagctggagctggagctgcaggaactgcgggcggaactggaggtgctgcgggagctgctgatggaggtgggttcctgggcgcaagctggatgcgcacgggtgccgtcgtcgtcttgcgggcgtagtgcggatccggactcctcctggcgcgggaagaccctttaactgagcattctccctcttcaggcgcgctatctcgtccttcagagtgacgatcctcatgagcttcccatcgttcaaggccttggtcgccttgtgcaggtccgagtgcatcctatccaatcccctcatc

SEQ ID NO: 47082 - DNA, 1501 bp, Oryza sativa
atagtagggtttcatttgcaaaagcagcatttaacaaatatttcagaatttaataaaacagttaagtattaattaaacaatattaatccaacgctacacaacataccctgttgtataggcccaaccattctgaacaaccatcccggctgcacagttctatcttcaaaccaggaatatactattccaaaccaggagctaatcaaattattaccagttatagcatcaataattatgatgagaggtgtgagactaatcacgaaaaacattgttagacctgcccataaccgcgggcacggctattcgaatagttttactctgatcagaggtgtaccactgtacccacaagacacagccccacaacatgtcaccatgtgcctcaataccaccacggtacctcggaaaggagctgtgacattaccccttgcataacacaacccaccacagcgcaccgttcccggatcataatcacccccttataaacaaggcatggactccccagcgacccctgtgggcttatctccgccacttctcagtctggtgctctgcaatgaaccatgctatacaaaaggtaaagccgttgcccacgctggcttgtggttggcacggttaatgtttcacaaccgaaactcgtgaaccggtccttaattgccatgagcacgactctcaaaaccatgtgctcacaacccaccattatcaggttttagttggcaagtaattaattaaccaatcacgattgaccatcgtgaactatcattaagccatcattaaataataatgaatcataagttatcccaatagtgtgctaatgtttctaagcatggctaagcaatcacacctaatatctagctgaaccaatatataaagcccaactagtcaaattataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcgaaaacggactctccggaaacgtcggaatctaaacagaaaagagcaaaaaaaaaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaagggatttattgcgtcagcggctagggtttgcggtggaccgggcgcacggcagcggttcacgggaacgaacggccgagatcgatcctatccaaaacgaacggccgagatcgatcgggtctacggcggctcacggcagacggccacga

SEQ ID NO: 47083 - DNA, 435 bp, Oryza sativa
tatctccgtttccggcctaccgtttttattccgtttccgaaaaataatatgaatagggaaatggtttagcgtgtttcctgacccttttttatccctacgtgtgaatgcacgcacggtttcatggcacattggcacagacgttttgcaccccaagaacctgttcaaacgaacacggttccagccttccacacgacatggatgggatggacggttggatttcacaccccgagacgagacgcccacattttcaaatttcaaaattcgaatcgccgtcacaacggccgcaactccctctcaccaccaccttttcatatataaactccccctctgtcccctccccttccaatccattccccttcccccaaatccaccctaccttgccgcgccgccgcgacaatccatagagatcatcgagagaggagtccaccggagcca

SEQ ID NO: 47084 - DNA, 356 bp, Oryza sativa
gtttcacctggccctgtagtattaggccaaattctcttctaggtctgagtgtccgactttctgacttcattatataacttgcagttctatattgtgttggttagaaatgtcagaagcgtccaggtcaaatagggatagaaaccagaaggtttgcagctttgccatttggacaagacgatctttgtgtataattggattgaaaaatagtttggaaaacccatttacattgtaacacactatcatttactcttgacatatgttaagctacactgaaatggttctcgctgacatgctgaaattttagatatgcagaaaagacgatttctcactaaacgccttgttattttctttataca

SEQ ID NO: 47085 - DNA, 221 bp, Oryza sativa
acacactatctgatataagatgagcagaggtagagctagctagctgacaaccagagaaaaacaccccgggaagttgtctaactcgaacctgacatgatttcttttgctcgtgccgcatccgaaacctacacgtatatacgtacgtacgtgcacacggcctcaacataacgcgcatagctagtttagctgtattgattgtcgatcgaatcgccaattcgcca

SEQ ID NO: 47086 - DNA, 154 bp, Oryza sativa
atgccacaccagcatcgggctccagttcagaacgtcgcaatcagcgcttcggataaaaaaaaaaacctttcggcgctaccgaccttgtgagcccacccaaaactcgaatatacagtacgatatacacacgtctcccccacccaccccaatcaat

SEQ ID NO: 47087 - DNA, 574 bp, Oryza sativa
aaagtcttcgatcgcaaccatgcgacccaggacaggctggggttcagtacctcctacttctctttctgtggtcccgcgaccgggaagggcgccatcctcctgcagtttcttcagtgacgcactggtggaggttgacttaccgccggggatcgccggagaaaggatcgagatgagctagctagggtttttgcgggagcaaagaagacgagggatgcttggaagctggagagttccttcaacaggcggacttcaaatgggatccccaaaactcccttaaatagacgtacttccgacggtgcgaattccaaggaaaggagagagatggccgccgaaaatttcggggtccattatgcgcgacagtttttcggacttcaatttaaattcactcatgaccgttgagcttcacccgacgttgtcgatcactccttgtctctcggtttccacatcgagaacgatgacaacatcagaagtcgcgatcggtctcacaagatcatttaagtagaagtcgggggctactgtccgagttacaggtaaggtataccctccacccttcgatatacgtcacattttgata

SEQ ID NO: 47088 - DNA, 198 bp, Oryza sativa
cattatgagtaaacagtatatatgtgtgcagtgcggtgttgttgatctatctaactatgaacaattaagcattttcatttttcatatagatatgtttttggccttctgatcaatagatcttttttctctttagattgtgttgtcttctgagattggaatatgatccaggatatgatggttattactgcttatggttac

SEQ ID NO: 47089 - DNA, 1501 bp, Oryza sativa
tgtgtcggtcgggccatgccggcccgactagcctcagcccaggcatggccgggcttgggtcgtgccgtgccggacggtccagatggccatctataagttatgtggctttaaatcgtactccatcagtttgtttcaagtaaaatcatcattgactttgaccaagtttataaaaagaattatcaatatttttcaaaaaaataaatatactataaaaatatatttaattatgggtttagtgaaatcaatttggtgttgtagatattgttatattttttttttctgtttctataaatggtttgatcaaggacaaacctatacttataataatttagagcattaaagctataccattgaaagttcatatctgtatattttgtctcgttgtcttatcagctactattgtttacattcgttatatattcaactaaccattagttcttattttaactcttcttcatatatattgcagtggttcgcgaacactgttgctctcgtgttgcttgctttctttgttgtcccgttagttccacggtgcaacagtatcgagggggtatttgccatcgttttctgtttggtcatccttcttgggatacctgtcatgggtcattgtacgctaaaagagatccacgaagaaatgaaggctagagagggaggccgataataattagagtcctatttgtgatcaatctagcccttttacattttctctcctttttttttgaatgctaaaaaacatgaattcttttacttgttgtgcataataaaattttcagtttgatatagggataatagctaataatgttttgctataggatcaaattttatccctgatatgacatattgtccaaccgagcatttgaaattaatttaccactagcaaaatatctgtgtgttgcacgaaagagagatattgcaatgatgtcagatgataaaacgcgtgtgatggaaataaaaggtaaggaagttgagcaaagggtaaagcgttgttagagcaaagggcaatagcagactattagccggctacaaacatatttaatgagataaaagatgagagagaagagcagcgggctacagatctgtagccagctgcaacacggactctaagacgtattgtgtgtatgataggtaggaccatatattaatagtgtagtaagcaactattatataaattggctatagatgaattagagtcagtagtgggctatactattaaacttgctcttagaagacagaagggtgacgcggcattgtgcaaagtgtgcaacgaggggttattgtcggataccggagaaagacacggaacatcggtcaaacctaaccatttctcttcctccacatgttgtcggtgagcggtgactgggaggaggaaggaggcgctcatcggtgttgatgtcgacaacatcagcatggcgcatggcctcccgaggtaggcgccagtcactcagtcactctgcggataaatgggtctcacatatatttttttaattctaacaccacataa

SEQ ID NO: 47090 - DNA, 197 bp, Oryza sativa
ttaaataattgtataaggcaaggcccaagacaagaggtatataaaatagacttactttccagccatttaaacacaacccacagagttgagggaccaaaaatagactttttctatgaggaaacatgatgagccattgtgccttcgggccggcccgagtagtattgggccgtgtatgccgcccgtgggctggcacggca

SEQ ID NO: 47091 - DNA, 224 bp, Oryza sativa
caatggatctacgaaaagatcgtgtatttacaactacaatggaatagtatacaaagtcaacacaaatcattaaatagaatttatggctacacaaaccgttgaagatagttctagacctagaccaagacgaactcgcgttatgtggtgttagaattaaaaaaatatatgtgagacccatttatccgcagagtgactgagtgactggcgcctacctcgggaggcca

SEQ ID NO: 47092 - DNA, 1501 bp, Oryza sativa; identical to SEQ ID NO: 34873

SEQ ID NO: 47093 - DNA, 724 bp, Oryza sativa
tatcctgtgtcatttggttggtggcatgatggtttcattccctgcctgacctgaaaaacctgataggttcattagcctagctcaggccaccaaaaacgagcgcctggctcagtctagttacacaaaacaaaacgcgctaatcaagcttgtcctgtcacggacccacgactgtgcatgcaaaaggtgttggaatattttattgttgaatcttggttggtgcaaacgaaccgaaaatacaacatttgcttatatgcgatagattaggatatgagataccgttttatttaaataatatctaccttaaccatgtaattatgaaccatctaatctcaatttagtttcctcaggcttaggctactaaccaaacaacatttgctcaggctagcctcatcaggcaagttttgacaggatagctaatgcctcttaggcatgtagttttcttaggcacatcactcaggtagccaaccaaacaggcccaaatccacaggccaaacaggccaaattgctaacgtgagactatgcctcccggtcacggtcaacaccagtgtagcagcactgcaaattaagaatgccaaattaattattgcaaggactatatactgttaataacgcaagaacaggtaaccgatcgagcagtttatcgtacctttacccaaaagaatagatgtccaaatgaaactagaacaccaataagaccgaacactccttcccatgtcaaccccaa

SEQ ID NO: 47094 - DNA, 187 bp, Oryza sativa
cggcaggtgcggccttcccgcagtggccccggggccattctgggggtcgggggcgcctgacaccgtgtgacaagcaggcggagggccagctccggtcgtcgggggcctcgggccgccgttcggctcgggagcctctcctccctgctctctcccgggtcgagtcggcacagggtggggatgcgcggaa

SEQ ID NO: 47095 - DNA, 1501 bp, Oryza sativa
tccaccaccgtcagtcgtttagagtcactaatatacgtataatttaaattatatatatatatatatatatatatatatatatatatatatatcaagcttacatgatctatttaaaactcaaaacgttttatttaagaaagaaagtaccccttagaaattaatggctacggactagtgaagtgagggagatatttagtggcatatttgtttcaattagatgaatagtaataaaatattttaaaaccgttaaatttgtaatgatatatgtatctaattaaccttagaaattaattactatatggacaagtgaagtgagagagatataagtattgtattgtattataggagtagaagcaaagctccatcgctctgcagctaagccacgagcaacacaaaccacacctgttctgcggcgagaccatggcgccgccaccggccgctcacgccgctggcctccgcgtcctccgcacgacgcgcgtcgcgccggcgccgcccgccggccagcccgcgctgcccaagcgagccctgcctctcatcttcatggacgtgatgtggctccgcgcccagcccgtcgagcgcgtcttcttctaccgcctcggccccgacgacgatgtcgacgccgtgctgtcccggatggaggagtcgctgccacgggcgatccacgccttctacccgctcgccggccgcgtccgccccacgcccggcgagaccaaccggtacgagctcctctaccagcccggcgacggcgtggcgttcaccgtcgccgagcacgacggcgtcggcgtcggcgtcgacgagctcgccacggacgagccgagggagctcgccaagatcgcgccgctcgtcccggagcttcccgagggcggcgcggagctcgcgctgcaggtgaccgtgctgccgcccaagcgccgcggcctcgctctcggcgtcatcgtccaccactccgcctgcgacggggtgggctcgacgcacttcctccacacctgggccgccgcctgcgccggcgaccggaagctcccggagccgcccgtcatcgaccgcacgctcatccgcgacgtaccggagatgcacgacgagttcgccgcacccacgaacgaagccaaagatctgttcaaggcgcccgacgccggcaagttcctcgccaccttcaccctgtccagagagcacctccagggcgtcaaggacgccgtcgccgccgaggccgcacgtcgcggcgttccgccgcctcggtgcacgtccctcgtggcgatgtacggcctcatgtggcactgctaccgccgctccagacgggaaagcgacaacggcggcagcggccgtgccgccgccgccgcccacttcatcttctccgtcgaccaccggtcgcggctggtgccccgcgtccccgacaagtacctcggcaactgcgtcggcccgggcttcgtctcggcgcccgaggaggagctcgccggcgccgccgtggcgggcggcgtcttcacggcctgcgcggcggtggccgccgcca

SEQ ID NO: 47096 - DNA, 1501 bp, Oryza sativa
cttgaagttccataaaaaaaaagggagaaaacttaagtcgctataaaagacaatacatatataaccgtatataaattaaattacgtctgcctttttttagaattttctttaacttgtaaagagaatatttaggagtattaatcacatatatttgatttgattttaaaatatttttatgttgtttatcaatcataaaagagaaaatctaggcaacgggatcacgtcccgacgggattgtttaatgaccaactgacatcttgcatggttgtacttgactacgtggaaactgatttaacgtgagggtcataaacgatgtatcccgttgctttgacggtataccatggggtagtctctctcatcataaaatccagctactattttttaagttcgtgcatgcatgcctgtcgggcttatgtaatttctggtcgatgcaacggcaagcttgtcacacggaggcataattaaccctaatttggtatttgtccacatacgccaaggtgatgtatttgggccttgcccgtttgatagggtcacgtcatgtaggatttggatgaccgggctagacccgagcacgagagaggagggtgggcctgggatgacacttttgacttttggatggatatgtttcaccgttagtctcattttaaaaaacaaaatatatgtgattaatatatacatgaactatttttttcatatttgtataaaatgattgaatgagatgaatggtcaaatatatataaaaaaagttcacggtgtcaatatattaaaagcggaggaagtaataaaatgtataacgtgcaggtatagggctcacactattttttttatttgacaataaatcatagtccatgtgcaccttaaataattgattgaaatgtcatgatataaaaaaaaagactaatcatcaaacaactcaacttataaaaagttgttcatagacgatcacaaatatattagcccatgtctctgcattcatgtaggcttgcatgaagacacccgtaactgggagattcggctatgatctacccatagaacttttatttaaaatgaataacaaaataatgatttagatcttaaccaccgttgagaaaaacggggagggaggagagacgcatacacacgcgcgtgaggggaggacatgtggcatcttcaaggaaaaatcgcatacacacgcgcgtgagggaggagagacgcatacacatgcgctagatcgaatgaaggatagaaagaaggctaggacatataaggacatcgacattttctttactacttttaaaattctgtagttgtggccgttactccaaccctatcatacatgcggaatatgagttgtcagattgtctaatccaatggctcatatcgcttccgcaacgctctgatcctgcagagcgcagacgcgcaagcgttcccctctctcccgtcttcctctcaaccactgcctcgatcccctccgtatcaaccgccgccgccgccgatatccgtcgtcctagcgtcgccttaa

SEQ ID NO: 47097 - DNA, 1501 bp, Oryza sativa
aactcaacacatgatggctctactatagaactaatatattcattcactagttgtggcatggatataagtgaagcatcgcacaactcttctttatcgcaagaaacataagcaaattgttttgtgacaaaggtatttcaacaattgtttccactatgggttgctctaatgtagcacaagtagtggacatagttggcacatcataattatgcataccttgagtagttgtagcaccattatcattacctttttttcttatcttcagaaattataggcacttagtcaattaaacattcctcaagtatgcatgaaactatggataggtctttttgctctccatctttcttctcttcctcctcatcatcttcaacattggaggtgctgatgtagccatcttccgtagcaacgtatgcccgttgactagggcaaaccttctgcatatggccaaatccttggcaatggtggcactgaatgcgtcccgttgaagcgacggatgaggcactcttggcgggtacctgcaaagaacttgtacctaaatctgcaggtcgtggaggaggtggttttggcgctgtagaaactccagacgcaactggttgcttgcacgctggtgggggcgcccagaaagagataggcttgggcagactcgaagatggcgtcgtgcgcggtgtgtacgtgttcgtcttgttcttgacctgttgatcatgcccctgtaattccttctctgcaagcatagcaaactgaaacaactggttgacaatgttaaattccttattatctaatatgtcctgaatctcgcgcctcaatcccatgtaaaagcgacaaatggaatccttggttccttccactatgctacatcgcataaataccttttgtagctcaccatagtaatcctgtacagatttatccccttgttctaaacgcttcagtttcttgcttaaatctctaagataagatggtggaacaaatctatcgcgcatagctaccttaagttctttccaagtagtaggtaaaactccatcgtcagctaacatagcccaccacatgatagcaaaatctttgaactcactactggcttgtcgaactctatgttggtcaggtataaggtgggcactaaacttttgctctactgtcatctcccaattaaggtatttctcagcatcataataaccaaaaaaagatggtattttaaacttaaccttaacataaggatcatcgggcacgcgattattgttaccttgttggtatcgctgattttgagcgccactcatacctgtcattgcaaacacaaaaacagcagcaaacagtaatctgctacacggtgtagtggtgcctctcaataactcagccaaatggagcaccttatcaagctattacaagtgtcttaccagcaatgctaaggacggtacaaccgtggctagttcgtgacacctcgaaggatgtgatgtggcgattgcaaagatcaaagtggtgctgaccagaagtatatatgtagagcttgggaggc

SEQ ID NO: 47098 - DNA, 677 bp, Oryza sativa
ctcttaaaatgcacaccggtaaatttgcagaagcatttcatagctgtcagccacagagtgaccctgatctgccatctcttaaaatgcacaccggtaaatttatccggcctcagtgcatcggcaaaaccagtcatagtagaatcacagtgcctataataaggtttttggattgttgagattataggcatataatgatttaatctattccataaataaatcatgacattacagatgaagactagcatgaacacatcattagatctacacagtataacaagaacagatcaaatatgtgcaacatattgaacacgtatcgaggtggccccgatcgcaggcgaggcgaggcgagcaagcgcgcgcgtgttccccctcttctctctactacacatgcttcaagtggctaggagggcattctcccttttaaggaggtccccctctcctagaataagcaagggggatactaaactccacatgcatgccatcccatgaggtggacttttgtgattttccaaagaattaatcttcgagtgggctaaggcccattcattaattccaacaagtgcaagatctaggaaggactgatccccttgttcataataaaaaaatatccatcaagcacttttcctcccaatataaacaatgctgtcacaaccaaatacaatgcctccgctgataga

SEQ ID NO: 47099 - DNA, 1501 bp, Oryza sativa
atgactttggttcaataatttgaatttgaatttcaaattatgacaacttcaaacaatgttttcaaatactaaatgatttcaactgaaaaattcatcaacaacaaagttgtataactcatcaagatctataacttttattttggttatttttctatataacatttttttgaacagtttcaatttgaatttgaaaatatgacaacctcaaacaacattttcaaatactaaatgatttcaactgaaaagtcattaataacaaagtggtataactcatcaagatctataacttttatttgggtcatttcttcatccgagaaagttatttttaacattgttcacaaaatgtacatatctcttatatagtttataaactacaagagagagatgtaattttttgtgaacaatgttactgtcattttgtcggatgaagaaattatcaaaataaaagttatagatattgatgagttatacaactttgtagttgatgaatttttcagttgaaatcatttagtatttataaatgttgtttgaagttgtcataatttgaaattcaaattcaaattattgaaacaaagtcatatagcaaaatgaccaaaataaaagtgaagaatcaaattatataatatcgacaattgtttacagtgaagaatcaaatattgtatattgctagaaaaatgcccgtgcattgcaacgggtgatgctagttttatacggtttagctaggatgaaattcactttgggaatttgcttggatatttttttaagaaaataatgaactgtaattaggagtccgactttcttctcatgttagcatgcgagtttttttaaagatatttcttatacgacttctttttatatttccaaaagaaaacgaatttaaaatcgactcaaacaaggatatgtatttccaaaaacaaacaaacttaaaaaccgactcaaatacgaatgacgtaccaaaatacaggcaaaaacatctttaatttttataatagtagagatgatgtcaagaaaaagtatggtacaaaattaaatatctacacaaaactgatgtaaaagttttttgaaaacacaaattaatgatctacacaaaatctatcatccatatataatcttagaataaaaaacacaaattaatgatctacacaaaatctatcatccatatataatcttagaaagaagtgccaatttcaagtcggtaaattagaacattaaagttagaagatgagtatgtgttacaatttgctaattatcacattttccgctctcaataagtatagaaaagacatcgtattcaaattgtattaaagactactccctccgtttttaaatatttgacgccattgacttttctaaacatatttggccgtttgttttattcaaaataatttaaataattatgaattcttttcctatcatttgatttattgttaaataaacttttatgtatatgtatagttttacatatttcacaaaagtttttgaataagatgaatggtcaaac

SEQ ID NO: 47100 - DNA, 1501 bp, Oryza sativa
atcgttaccccaactccagaggtggtcgtgaatctcgacggatgcacgatcagcccaactacgagggtatttgttcctgcaagcaatcgagaaccagcaagaacaagatgaacaagcaactaaatttgcgaatcaaagatgttggattgaatcaatagaagtaacaagtggggttcaataacaagcaatccggcaatctaatcgatcacgggatcaactcggcaaagtagcgacgctatactttgatctaaacaaaacccgattattcttggcggcggagaaagctataagaagaggaagaggacgaccacaggagtgctggggtcgttctctcaccctacgacgtgtccctaatggacccaacttaatacactgcccattgggcccaaagaggtgacgcggcaccgtggacagaaaaggactcggtagtaaaatgaagattgtggctgcccagaactgatatggacatgaggctggattcatttgaaagtagacttgacaagctttccatgaagtacttacaagcccaaatcggagttcgcaggaagtcgtggcggccgtcagaagtttgtgctatgctgtagtccgaatccatcccgcgcgaatcctctccccgtttgatcctctccattgttcctgatagttgagttgacatgcacgagcgtgggtaataggaccatgaagttgtaattgtggaagtgtggatgtatcgttggtgttgatgtcctcatcacatagaaccactgcttcgctctcccgagaagggagaacggaaacagtcgcagcctgacggtgtcgggattgacgcccttgatgttgtacgtgctacagatctccaggaactgttgcagatcagcattggacccctcattaggctcaccacagaacgggtttgcctgcgcaatcgtgatgaggctggacttcaagtcgaaatccacgtcccctatgttgacctgcggcccaatggccacattgtcagcagagggagcagcgaactcgcggagagtcttattagccatagtcttgaaggtcggtggcgttggtacggctggtttatctatcggtagagttttctgcggagcagcgactcacggcctaatgctccgaaagaaagcttctggattttctttgaagtttttcggcaagttgaaaccagtcatgcactaccctgttttcacaacaaaagtgaaaacaaccaaggttagcctgcaaaggaaaatgattatacagaggcaaatataaaatattagttcaagtagtctctattatgaatctcctccggcaacggcgccagaaatgcttgttcgtatttcttaacgacattactagaaatataattcccagcaatggcgcaaaagtacttctgatatattatggttacagagttcatccgcaagcccacagatataccattgtagtgtttcacccgagagtattccaagggtatcgtatttattttatcccgtggaaagatcatgtagagagaacttgactaataatt

SEQ ID NO: 47101 - DNA, 315 bp, Oryza sativa
gtccaattccgagttcaaatggccaagttatggccatttgaagtttatatactcttaaaataaatatttgcgaatttcttcatttaaattttaatttaaaaagggtttatcgcgtcagccgaggggagggggcgcgcggaccgggtccatgggagtggggcccacgtggcagcctcacggtccacggtggaccgggtgcacccgggctcacaccggccggtgccgtgggccccacacgtcagccgcacccgagggcgcgggcggctgacggccaggccccacacggcagccactcggcgcgcccgagggcggcca

SEQ ID NO: 47102 - DNA, 654 bp, Oryza sativa
ctggtttgaagatagaactgtgcagccgggatggttgttcagaatggttgggcccatgcaacagggtatgttgtgtagcgttggattaatactgtttaattaatacttaactgttttattaaattctgaaatgtttattaaatgttgtttatgcaaatgaaaccctactatgccatcctttgttatcttgtgcgcttgcatatttgctgcgtggcttgctgagtatgtcatatactcacgttgcaatcattcatcagaggaagagttctacagtgaagctgatggtgtggaggattaggtgtaggcctggtcaagctgcctgtggagtggagtcgtctgcgccgtttatcttattttccgctgcttagatctttattgattgagaggaactatctacctctataatgacattttattcgcttattaattagagtaataattgtactatattatcaatttgttattgtgtgcctcggctgattcctgtacgagggttcacacacatgtaagcgtttggaattttggatagaaattccgggcgtgacaccccgggacaggtaggcaggactgagcccctagcagcaggacaccggccctgtgccatcacatctcgactaccgggccgcagctcgtgtagccttcatttgccctaga

SEQ ID NO: 47103 - DNA, 349 bp, Oryza sativa
tgttttatctagccatgcctatttacctttgttatgaccttattattgttattgttattattaccttgttcaccctagaataaacaaaaccccaactagtggacactctactcatggtaccactagtatgaatttaggtagatgcttcgccgcttaattaggtaacattaggtggttttacaactctagactttgggaatattcatatcacctagacactatggaatggttggattattgtggaattggattcacacctccccctctattcaaaaccctcaaaatggttttaggctgggctcggggtgcatggttttgatagtagcacctcggtcatataaggaccggt

SEQ ID NO: 47104 - DNA, 1501 bp, Oryza sativa
attcaaaattcagacagtaatactagtagaaatatgtacttttcatggtaagtactttggatccttcaagttccttacatttcatctcctgctgtcatttcgcgccatctcaggggtgcacaagttgatgtgaagcgacttccgaaaaggccggcgcctccgagatttggccggaaattgacggaatcacaaaaggtaagctcaagatagttctgtctgcttctcagagcttatgctgcctgcaatcgtctgctctttccaacttttaagcctcaacctgcaaagttgtgaattgtcacaggctagagcaacacacatttgccttgattgtggatacatatacttccttcccaagcctttcgaagaacaggtaagattcacttcaattctttcacagagaatcagtcttttggcactcacagcccgcaaaatcaggtgtatccaacaattcaactagtgctttttatccatttcagcctgatgaatatggctgcccacaatgcaacgcaccaaagaagcggttcgcgaaatatgatgcagaaaccgggagggcgattggtggtgcgctaccacctattacagtgatcgtcagtttgataatcggcattgccggagtaggggctttgcttgtatatggccttcaataggctgccaatatcttcacaggtttttgactgtgtaacaagaagctcagcagattgctggtgcactctcttatctagcaagaaattctgagtgatatatatcaagggggaaaggaaaaacatgagttggaggctaatggctaaatgaaaaatcaaatcttcttatatgaatggagattaattttctattctctcttatttatggatcattattcatttgtcgccaaaggaagtccacttttcagaaaatgcttccaatttcatgtcttctctcaacagtgtagtgaatttgagaaaaaaaaaaccggatatgttggctttgtttggttcatcttgccatgtactaatgccttcttttgtcagtatggctcctaatctgaaactaatcaaggaatttgctaatgaactgaaatttctaatctgaaactctgaaatgaatccaattgattgcataagctttttacaatcttcttagataaccattagaataaaagcagttgtactgagtccacaactactgagtttaatcagtttactttgtatggttgaagcagcccatggtaaacttaatgatatcagccatcattttctgttgctaagctaagtacctcccaagtctacatggaggcaatagaagattttgttccagttaataaccccagccaaaccaaacaaaaacaaagaatgacacatacatgaaaatgacaagacctacaaatcactatcctctatgccatctttctctaaaatcagttcatctaccagctttaagcaggtccctacctcaactaaattccaagacaattgacatcaggacacaagcaggtagttaaaattagttggaacaagatgaacac

SEQ ID NO: 47105 - DNA, 1169 bp, Oryza sativa
atggatgccctgtaatgtgaaacaaatactgcagtccgtatgttggatatggttgccaccttgttacctcccagctgcattctgtttcttttaagtctgtgctttctatatggtatctatggcttgttttgtgatcgtcccggataaatgtgcattgtactggtacccatgttcatccttttgcacatgagatatatttggcttgtgttcacaggccacaaatttgctggttttgactgagaatgtcacttttatgtccatttggattttcgatcaataaccaaactgagaatgcatttagaacatgaaagtttcccagacttctacatcaaacaaaaaaaaaaggtgaattgtttgtgaaatctcaaacatggccatcgttcttccaagctgtccatttgtagccacagtttcagggtgaatggctacaccctccgttttaaaaatgccattactacctaaggctgataatacttattggtttgaaccggacatagttttcaaaaaataactttgatcactattttttattactatatatgaaaaatataaataaatatatgatttgttgaagtgctttttaagatcatatgtatacatatggtcatcatatttctaagacaaatattttagatgttatttataataaaagtttttaaagtttgacaacagtcttatctaaacaataacaataagtattataaatatggagagaataattttagctatgaatctcgatctactccctccgtcacaaaatataacaactattggactctgatacggtctccgatatgctactttgaccaataatatctttataaaaataaaatgtttcaaataaaaagagttgcatattatgatagtttgtttaatgataaatctagtaacattaattttctatggttgatcttttattttttttttgctattaatagttaaagtttaaaatgtttgacttgtcactatactaaaaatatttatattttagaatggagggagtaatttttttttctagaatggaatacatgtcggtgtcaggttcacagtttccacaggtatgcctctccctttggttgtgagtttgtgactgtgaggccacacacatcactcttgccttagccacaccatctccatccaaaatggcagccatcttctccctcaacctc

SEQ ID NO: 47106 - DNA, 409 bp, Oryza sativa
acctgcacactacaacatagaaatttgctgcatctagcttctgagttctgatagctgtccatattcagtcttctagtgtgattatgtcctttcacaacatgtttgtgaaatgtcatggtttttatctatatttttggttttgtgctgaaaagtagtagaagttactacatgctagatgtgttttgactatctatttctttgtcaaacttgtaaaatctcactgctacttccaaatttttaactatctattgccctcatgtcccttttgtaatcaattagtcaattcttatatgaatctgatctaccttgccaacagttctttatattaacttgttactgtgttttgtgttaacgaagatatttcacgatgacgttgctaactatttctttttctataatcttctgaagc

SEQ ID NO: 47107 - DNA, 180 bp, Oryza sativa
cccgatcgccgctcaggtgagctcctcctcttctttctcttcttgtgtgtttgttgcgtctcttggagttgatttgggtgggagttgatttggttgttggcttgttgcaagaactaaccgtgtggtacaatctgtgaattgatcgaattccttctgctgccattgttgattttgtgcagt

SEQ ID NO: 47108 - DNA, 306 bp, Oryza sativa
cctctcctcctcgcgacgcccattcactgtgctcgggcccacccgtcattgacttcttttgacctcattgaccaaagggcccacacgtcagagagcggcctgcgtctccctcctctcctcgcgacgctttcaaatgcaccaccgcctcgcctctctcgcagtctcgccttcctcgccacgccacgccacgccacgccacgccccacgccacgccacgccgagaagccgaggagtagcaagccactcgccgccgcgcgcgcatcaccggcgtacgtacgtcgtcccatccgcggcgggcgcgcggga

SEQ ID NO: 47109 - DNA, 1501 bp, Oryza sativa
cgctccaagccagcctacacgccgccctatgctcgccgctctctgccccctacggcttgtttggcaccttgagggaatgggattgggagtttacacgagggaattgatggtgagattaagatgggaatttggtttttattcccaatatcttgtttggcagaggtggtggaaattgacagggagtttagttggagattaggtcattaatgaaaatggatggctgagatttgtttaggcaaagcaaaggagaaattccctctcaattaccacccctacccaggtattgaaaaggagggagttccttcctcaattccccatccccatcccaccaaaattcccttgtctcctgaccaaacaaaacaaataatagccccatccctctaagctcccaatccctcctaaaaactccctccaaccaaacggaccgctagagttttctggattgaactaatctctgtggtaggagtactactagcagagaagtattatacttgaccactttttgtgttagacattgatttgtttttatatattttttttagaactgtaggagtagtagacttcttcggtggtagagaagaatctcaaacactgtgcttgtactagtagcactgcattggatcgtgggactgtacatactactagcactgcactgaactgtcgttgctatggatcactaggtgtttggatccagggacataactttagtctatgtatttagacattaatttagagtattaaatatagactacttataaaactaattatataaatgaaagctaatttgcgagataaatttttcaagcctaattaatccataattagagaatgtttactgtagcatcatataggctaatcatgaattaattaggctcaatagattcgtctcgcgaattagtccaagattacggatgggttttattaatggtctacgtttaatatttataattagtgtccaaacatccgatgtgatagggacttaaaagtagtcccatataaacaaggtcttatgtagcacttctttttataggctttgagtcttaaatatatactccgtactgtgtattattatgaatataattgtctattttgttatttgagatagtggaaattaaattttcttattaatttacaatattgtgatggtagtgattattttatatggatttctacgatgatgatgatctccttgctcaatggtgggagcaggaggaagcgtctgacgacgatgactactatattgcagctgctcttcttactgacatagagcataagagaaccaaaaggaagcatcgtggttcagtcatgggtcaagagataatttacagggacagatttgctggcaatttgcgcatagtggctgattattttgcagatcctcctatatatagtgcaaaattatttagaaggaggttcaggaggatgtcaagggagctctttttgcgcatagtggctagtgtggaggcacatgatgactactttaggcaaagaccaaacgcgg

SEQ ID NO: 47110 - DNA, 1501 bp, Oryza sativa
aaattaataaaattaatatgtcagttcaaattcgacttcaagttataacaaaaataacatattaaactctaactagtacttatcgaaactgaagttgaactggtatatttatgaagtgttatatttcatattaatctatcttgttatttttctaaaacatttttctataaccatttaagtggcatgtaataaacggggtagatattcacccggtatccaccctagtggttgaaaagtttccctaccataccaacggcccatggttgtcaatgtttttttttaactcaacttgattttgctgccccatcacttatttaaaaatttttataattgattatgaccataaattacttctgatgattatattatgagtgatgaaaaatggatgctcatattcatgaagcttttacagacatcaataatatagcatatctataacatatttctaagtgtttatagttttctttagaaaaaaaagccaggcaatcaaagtctaaactagattagtgtccacgttaattttattcgagaatggaggaagtatatatcttgtagtaactccgtcccaaaatataagaatctattactagatgaaacattttatagtacgaaaacgtctcattcagttttaggtttttacattttgggacggatggagtaactaattactccctctgtttctaaatatctgataccattgactttatagtacatgtttgaccattcatcttattcaaaaacttttgtgaaatatgtaaaactatacatatacataaaagtttatttaacaataaatcaaatgataggaaaagaattcataattatttaaattattttgaataaaacaaacggccaaatatgtttagaaaagtcaatggcgtcaaatatttaaaaacggagggagtagtctttaatacaatttgaatacgatgtcttttctatacttattgagagcggaaaatgtgataattagcaaattgtaacacatactcatcttctaactttaatgttctaatttaccgacttgaaattggcacttctttctaagattatatatggatgatagattttgtgtagatcattaatttgtgttttttattctaagattatatatggatgatagattttgtgtagatcattaatttgtgttttcaaaaaacttttacatcagttttgtgtagatatttaattttgtaccatactttttcttgacatcatctctactattataaaaattaaagatgtttttgcctgtattttggtacgtcattcgtatttgagtcggtttttaagtttgtttgtttttggaaatacatatccttgtttgagtcgattttaaattcgttttcttttggaaatataaaaagaagtcgtataagaaatatctttaaaaaaactcgcatgctaacatgagaagaaagtcggactcctaattacagttcattattttcttaaaaaaatatccaagcaaattcccaaagtgaatttcatcctagctaaa

SEQ ID NO: 47111 - DNA, 1501 bp, Oryza sativa
atccctctcatcgaaagatcgagacaccctcgagcacatcaggtggtatcagagcccaagttgctcggtgagagatttcgtaattttcttattcctacagtccagaaaaagccaaaaaaaatattagattagttttctatgatcctactagtactgcttagttagggcttgttgagttttcgattgcatcggttgtgttaatttgttggttttagtgtttagtcgattagagtttcgagttctggccaccgcacatcgccatttttttctttcatcaccaccatctcagccatcaccacttctgttgtcgtcgggatctacgaaaacggaaccgcctcgctgccacggttctattttagtagattttagaagtttttatcggttggttttggagttgtcaagttgcatataaggtttgccgagttggccgtgtttctgtttcggctgtgcttgtgtctgttgcgcgaggaagaagagagaaaggggatactagatcggtttttggatggagtcttacaatttgtagattggtttctatttgggcgccatgcagaagagataaaaaggaatcgatttccttctttcattttttttaaccgagtcccacccccttgcgtcggtttccatccccctctcccaagtccgactccccctctcgtatctcggtttgaatctataccgtgagttagctacataccttggtgaattttcgtttggtgtcggtttcaagatctgtttggaaaaacggaactggtgtaaatttagcattccatttttgtatagttttattttttggttcggacttttacacttgagtccctgtattttttatatttacattggagtccctataatcttacattgaggtccttgagttgtttttgctaaagaaaatacaaaagagtgagaaacggcagaaaggtgcaaaaaaaagagaaaaaaaagccgcaccgaaaaaaaagagaaagaaaaaagaagaaagaaagaaaagagatgagaagctgacttgtgtgtgagtacaccccccccccaaaattcagtgttgtcaccaccatcttcctatcatcgctcatgtttggtttgtgtattgtggcgtcctttgtggttaggctcgtgtctctacttcggctagcctaggaccagcattgtaccaaccttgagagattattcaacttgctttgactaacgtggtttctagtttttctttgactcattacacagcccacccatagctccaccggttcgactaacacttgacagggattcagctaccaaggcatcaatacaccttctccagaggttcgtccaagtccgacggttgccatcacctcctgtttggcatgatgagaattggtaagagcttgtggaacaggttgagagtgagtgacttgatagatagaaccacatccaactagttttgtaggattttttcttcttcttcttcctttttcatttgctgctccatagtatttgttttgtctgtttattttgtttctaacca

SEQ ID NO: 47112 - DNA, 1501 bp, Oryza sativa
ccctaggttatgccaaatggttacccatagaagccctctaaaaatattggaaaagtagaactgttctcctccccttctcttttaattaaaccaaactaatggcacatgcacttcataatctcttttaatggtcctcattcaaaatttattccagtgttattagtactgtacatctattactgtactaatggctcattttaccagcaaaagttttacaatattgttttatttaatcttgctgcaagaaaataaatttagcatgttgattttataactttcttttatctctgttggaacctgttgttcaaaagtacaaaatttgtgaccttatttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccacaggatttgggactgcccctttttatgcctagattcctcatgatcgtcatgaagagaagtgccgagtcaaagtcactttgaacagtaatagtgaagatatcccctcagtgatgttcgaagctggaggaagaaactacatccatgcatgtcaggaggtagcaaggatcgccataggcgagctccgcgatcgctacagtgatcagttggccgacactgagtatcgctaccattctcgtcaaccccagggaagtgaccgtggcagctaccttgagactgagggaattgagaatgatgctaccacaaggcatttggttgagatgctgtgggctatggatgaaacccgtgcagagactgtgttagcagctcaagatcgtgaagatcggaatcgaggtaagatttgcaagctagaggacaaagtggatcgattggagaaggaactagccgcgttgaagggagaagcaccaccgcagaaggccaggatttgtcttaccgcaaggaagagagctctatttgtccctcgctatcaattggcaccaaaggtccgtgtggtggaaaaagaagttaccccagccctagcggatcctccggtcgtcaacgtaagtgatgatgaagaagaagaatcgaagcgcacccattccaagattgagtggggagcaacttaagatgatgaagacgagccgaacgagccttcaatcaactccgatgctcggaagaactagaatgccttgtcaagccgttgtcttagatcgttgtattagtttgcttgttttaagtttggttgtgtgtgtctcgcatgtgattacatcagtgatgggatgtaagtgcatgcgtttgtttgctttcgagtgttaggtagttggtgagcttagtggtgtgagagtcttcagtttgtaataatgaaactcacttaagaccaataaaagtcaaattaattctctgtcctaag

SEQ ID NO: 47113 - DNA, 1501 bp, Oryza sativa
cccgactcaaacaagtggaaatgaatagtcctggatgcagaatactttttctgattcttacacttattgcatagacaacaaattaaacccttttgcctgttagcttcggccactttcaaaaaataatgcacgccatcaataaactctttggaccgccggtcagcgtacatccatttccgatccatctacatgacatgaaaaaaaatcgtacacaaataattattcgtacaataatgacactcatacaataattataaaataattacaaactctttcaacagtcacacaataatgacatatcattattcatacaaaaattatgaaatattacaccaaataattcttatttactatttctaaagttttaaaataatattaatgtgttgtactccttttaattttcattttagtttgttttctattattcaagattaacttttgctatattttccttctcaactattttataaaaccttctttagcaaataaactaaatttctatatattttttattccccacagaaattttctctctcatcaacttacaacaaaattttggagacaaaaaagtgtgctaaacatagctccaaatgtaatatgacaaaaaaaacattggaggatgaagttgctaaccttttaggcacctccgatttgtatataatcaccaaaataaatttactagaaattttggcatgacctcccctcttttttgaagaaattttaaagcttgctcgggctggaggaggaagaagatatatatatatatatatatatgcccgttaccctttttaaccgggactaaagatcggtttttgttgcaaccgagactattgtggaattaggccgaccgacgaaagatggtttctccaccagtgtggaaaaaaggtgatgcccatgccacttttgcatttcagcacatatgaatattctttatcctatatctcctgtaaataaaagtatttaaaacaacctctctgttgatctaattaagcctagcaaatttgtgacaaatggcatggaagttttcagttgagttagatcatactcctaaccgacaaaggtgctctttctttttttttccccttctgaaaccaacaattactactactccgtaccttttaatgcttctccacgtgcaaccattcaaaatgagagcacttcttacacgaatgtataagacaattccaattcaaatgatctccaaacacatacgaatcagttattcgatccttaataataaattaattagaagctaatatagtactactattctatacgctaaattaaaatatttggaaataaatagcgctaagagcaaatatagataagtacaaaataggattaaattataagggctatatcctttttttttctattttcatgtttaaagaaactatttttgctcataaatattttatattggatcctccaaagggtctatgctggcaaatgaggccgaatggaccttggtaccagaaggccattcaaaaaaaaattaaga

SEQ ID NO: 47114 - DNA, 1501 bp, Oryza sativa
ggagaagatcgggtcgacgggggcgacggtgctccggcggttgacagcgatggcggaggggcggacgaggacggcgaccgacggcgaccacgatggcgatcttcccgaacgacgacgacgactggagcgacggtgacacacggctggagcggcggcgacaacggcggcgctaggtcacacggcgctagggcgctaccgacggcgagaggcgaaagcaagggtggcgacgggtagaggagacaccggggatccttttataggggcaaggaggcggcggcgaaggcccacggcgaccggcgacgcgaaggaaacctcggtgtcggtgacatgggaccgggagtatcatgacttagagacttgaggcagacacgatcacccacgtggcctaaccccctcgggggggttgggcccgagggtgatacggccgcccttctctttgtctccccgaggggtcggaccgctcccgtctcggccccgagggccgaggcgccctgaccccttgtgggttttgcgccgcgtatatggggtaggtgagcatagcggggctcacctaaccatatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggccagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggtaaccatacaagtctccgtctgtttatgaaaagataggataagtccccacaaaaaagagagagatggtgcatgtggtatccccttgaggtataaaaggaggaccttgcccacttagaagggggatttttcggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacagactaggagcttaaaatctcacccagggcccccggccgaaccggcaaagggggacctgcacggtctcccggtgaggagccccacgctccgtcatctggcgcgccaggtagggggctctgcgggtgtttttctaagctctcgcattctttcgtgtgcgccaagcttttcctgttcagcccaa

SEQ ID NO: 47115 - DNA, 1501 bp, Oryza sativa
gactctttaccctcgcttctcatgcctccgctttcgcattcattacacactagcctattaaatcaggcattcgcgtgactatgacctgttttttatttggatatatacttgtttgtttaaggacagatgacgttttgtgtttatctgaccataattgttgtctagaattttctcttttatcctttcttaatttttttttgaatggccttctggtaccaaggtccattcggcctcatttgccagcatagaccctttggaggatccaatataaaatatttatgagcaaaaatagtttctttaaacatgaaaatagaaaaaaaaaggatatagcccttataatttaatcctattttgtacttatctatatttgctcttagcgctatttatttccaaatattttaatttagcgtatagaatagtagtactatattagcttctaattaatttattattaaggatcgaataactgattcgtatgtgtttggagatcatttgaattggaattgtcttatacattcgtgtaagaagtgctctcattttgaatggttgcacgtggagaagcattaaaaggtacggagtagtagtaattgttggtttcagaaggggaaaaaaaaagaaagagcacctttgtcggttaggagtatgatctaactcaactgaaaacttccatgccatttgtcacaaatttgctaggcttaattagatcaacagagaggttgttttaaatacttttatttacaggagatataggataaagaatattcatatgtgctgaaatgcaaaagtggcatgggcatcaccttttttccacactggtggagaaaccatctttcgtcggtcggcctaattccacaatagtctcggttgcaacaaaaaccgatctttagtcccggttaaaaagggtaacgggcatatatatatatatatatatatcttcttcctcctccagcccgagcaagctttaaaatttcttcaaaaaagaggggaggtcatgccaaaatttctagtaaatttattttggtgattatatacaaatcggaggtgcctaaaaggttagcaacttcatcctccaatgttttttttgtcatattacatttggagctatgtttagcacacttttttgtctccaaaattttgttgtaagttgatgagagagaaaatttctgtggggaataaaaaatatatagaaatttagtttatttgctaaagaaggttttataaaatagttgagaaggaaaatatagcaaaagttaatcttgaataatagaaaacaaactaaaatgaaaattaaaaggagtacaacacattaatattattttaaaactttagaaatagtaaataagaattatttggtgtaatatttcataatttttgtatgaataatgatatgtcattattgtgtgactgttgaaagagtttgtaattattttataattattgtatgagtgtcattattgtacgaataattatttgtgtacgattttttttcatgtcatgtaga

SEQ ID NO: 47116 - DNA, 1501 bp, Oryza sativa
gaaatcaatgatataaatcaacatgatatgagaaattgacaattgatttatatccatgcatgtgatgcttgtgcatatggtgcatattggatgctatgatagatgatggtatgcttcttttcacgacatgcaccaaatgaatgtgggatcctagaatattttccctttgtatatcaacgatcatatcaaatgtaggatcctcaaatattccccccttttggcattaatcacaaaaagatttgcatggaaccgaagagaaacaattttgctcaagcaaaacaagaacaaacattcacaagaccaaaaaaaaaagatgaaagctcaaagcaaaaatttgagaaacggtccatttaagaaatgctcccccttacactcggagtcttgttacttagacaagaagaattagaatggattttatttctaggagggagtgattatgagcacttgaactttctctcgaaatatactcatcaattattttctctatgagaggagtttggtcaaagatacttgagagatttttggtcaagtgagtactctcggcaatggaatgactaagattggcaaataccgagtgcaagatgatcaaaggatactaccattttatatggacactacttgtgtatgcaagtgtaaatttggaatcaagaaatggtagttggctttggtagcaaggatcaacttgtatttggtggcaaagattggaatttggagtctacccatggaggcttggttttgagaagtgcaaaaatgacttttgagtttcggtggaatcatatatcattggcatttcataaaccataagagttcaagcaaggaacacatccaaaagagttcaagaatacaataagttttagaaacaacaaagaactattacttgaaactttttatacaaccacaatgctcaaattttcaacaagacatatgcactttcaagattaatgttcagctgcatatgacatagcgaagatgattttttacgaagaggaaaaacttgtgagaatgagctctgtggagattatggatatcccatatctacacggcgatgatatttggactgaatataggataccgaatatagatagaatatcttatttgtatcctgggtttgtttctcaacttgtacatcaaggaaataccttgacacttagtcggttacgactgtattttatctgtatctgcgtattccgttagggatatagattatcttttgtaacacggactccttcccatatataaggggggtccaggtacctctaggggcatatgttgattttctccaaatcatacaatcaataagacactcggcggattcatccccggacaggagtagggtattacttcttcaataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 47117 - DNA, 1501 bp, Oryza sativa
ggaggtggtaacggcggtgctcgacgtactgctcgtctgcagctctatcctctccagaggccgtcgtccatcttttttgtgtttgtattagtgttgattctggtgatgctctgggatgtttttgagttcttggatgccgattaatttgatgaattaaatgatgggtgaaatcgggtgaaggggagttgctcgatacattttcttgaattgagccgatgcctcgagccagcttttttttattgttattttgaaacctcaaaggtgtcggttcaaaccgacatcggaaccggcacatatttttccttccatgctttctaggtgccggttgaaaatccggcatctttataggttcccaaccgacacctattttcttttctgaggtagtaatagttgcatactttcaaaaagcacgcttaattggccgggtactaatcataaaaatgattgagtcgtacctttagggtctgttcggctgcttgtgttgtggctgcgacgcagccagcagcaacagtgccgcacacatatggtgcagccgcagccaccgtagacaagcaaccgaacaggcctttagtctcttacgagagcacgcactgtgtgcagtgacgtccctcctatacatgggtgcaacaccattctcttatctccagagtgttgtgaaatccatttctgacaagttccacactggatgttctggaaggttagccctgttgggcgtgcgtacggtacaatgaatgggttggttctatctagctaggttgtgtttagatccaggggtgaaaaatttaggtgtgtcacatcggatatacggatacacatttaaagtattaaacgcagactaataataaaacaaattacagattctgcctgcaaactgtttattaggcctaattaatccgtcattagcaaatgttcactgtagcaccacattgtcaaatcatgaagtaattaggcttaaaagattcgtctcgcaatttacatgtaatatgtgtaattagttattttttttaatattccatgcatgtgcccaaacattcgatgtgacatggtaaaaaattttgccaggggatctaaacaggcccctagtctactgatttgtcgcttttcaaccaaatactccatccatctaaaaaaatcaacctatgtgacctgattctcacggatcaattgcatatggatggtttttctactcaactgagccagtgagatacaagcatataaatcatctggaggcgactaggaatcggacgcccacgtcaacatgatgtcatcaagcattcatgcgttcaaaaatattttaaactattttttctcttaatttatttattcaaatcatgatccgattgcaccattaaattcgttgcaattaaatctttaaaacaagaccacgcatggatatattctgatgaaaaaatagcttattattaaattatttttaaatgttacacgttgttccaccaagtatatcagaattgtttcactaggtagatcaaaaatgtttcaa

SEQ ID NO: 47118 - DNA, 1501 bp, Oryza sativa
agtcaatggcgtcatacattaaaatatggagggagtaattaattactcccttggtgctctttgtcaccagatatgttgatctacaaactttgaccgctcttattttttaaaagatttacaaatatttagaacaatgtcggattatcaaaataatgcggagtgctatgcatgataaatataactggcatcccttacaacagtgcaatttaaaatatttttttagtaaaaataaaattacactggtcaatggtgtcaagtataaaaggctagatggacacattcatcgtaccttatgaacttaatttttattgttacacacgatgtgcccatgtaaaaaaaaaaagaaagttggtgttgtaccgtgttgtagctggaaatcgttagaacactcttgtgtggacccctaaaacgtttaaaacgtgcgttaattggtttgaggtgtaagatttgagcacgtatagggtttgaaagcaattgcaaccgtgggcaatgctccggaattaagcacactgattcagattagaatctaaatctagcatgcacatagaaaaaaggaataccacaggaaaaattcctctacattcttgaatgaatgtatgtcaaaggaacccatcaccgtttcttccatttcacgtagaaaaaagtctattttactcccccaaactatttcattagaccctaaacagtcttttggctcattttacccctatacaaataaaaaattattcactttaatccttaatagcatttctatgatttgttacacttttacgagtcttattttaagctaaaactttgtagagccgtagataacatcattatcaaaatttcaaaatattatcaatttttttcatgatctatataaacggtgataaaaaaaattgtaaaaaaaaagagaggtaagttatagcgcatctatcaatcgtactaaatttcattgtcctagaagaacaaaaagagaaatatcgatagagagcaaagtgaatcgtttttaatagttcttcgtgtaaaatgagtgaaaaaaaactttggaggttaagtgatgcattgaaatagttcagttggagacaaatgaactttttttttccttcacatacatgatccctaactcttgtttcaacaaatccatttgcatgaacaccaaactggacgtgagattttccaagacccaccttaaatgcatccccatagtataaccccaaactatcaactgattggctttacaagttgcaaaatctattatgtacataacaagaggcaatcgccgaggacaatgtatattatgaccccagaatcaagcaccctgatttggaatgaataactatcatcgatacaattttattttcttgttcgaaatcggacatgcatttggtttctctataaaaggaagaaataatctctcgtgagctctcatactccacacataacactgttgttgtctaggcagcagataggaacacatacagggaattaagcttctagccaaagtatcttgcagcca

SEQ ID NO: 47119 - DNA, 1501 bp, Oryza sativa
ttcggtgaaagttaatgcaagaaattgaaaataatgtggtgtgatatgatgcaagatggtgggttctttggtgttaggagaatatgtgcatctaattctcccgaagctcacaacttctcctacaagattatgttaagcaaatgataacatcagtatctccaataacaaatagagatacacttcgataaaaaaaaaacaactagagatgcacttcccaattaataagagcaagcttatgaggcttttggccttttggttgctcacttggtaagatggatccccatctttgtattaatttctaattaaagtctctcctataagcagaatctataagccccaaaattaatcctaaaaatgcaataaattctcacattagtcaaaaacattaaatcaacaatgtccatttatccaatctgttgatcttctagcacaaaatatatggatttattaaaacaagaattaatgaagctcctgcttttttggttttgactattaattactccctccgaaccactgaataaggcacaaatgtattttaagattcaactctttaaatatttgaccaataactattttattataacttcaaatttatttgatgaaaataatatcactggatcagtggcggatccagaaatttagttcgttggtgtcataacgtgtctatcggtgtcatagcatgctaactatatttagaatatagtgttataatatatggataggcggtttaagcatagcttgccaaaagtcgtcggtgtcgcctgacaccagtggtattactgtagatgcgcccctgcattagattgacatttgaatttactttcctatgattatgattttgttgctacaaacagttgtataagagaaatttaatgtaaaagattagttttcgagtccgtgataagttcaatcatgccttatttagtgggacagagtgagtataatttttttatgatttaataatacacgcaaagtgagcataactcaattggttaggaaaaactctagaggcgacagtaaagcacaagggacctggccatggcgattgggtctagggtgtaatggggatccgacccggtaaggtgagagctatcatgcttggtgcactgctacctttcccagtttctttcctgatcttctcaagtcatggcttgccctagaatcactagcgccacttctcaaaacactttctagcatcttcgaaggctagagcaatgcgagtttgggtagaggaatattgcccgagagaaggtgttacagtggagacattggagatggaaaggggatgggatgggagattcacaaggttttgcaacggtggtgaaggtggtggggaaagctccaatggcggacatattccgttcaagcatgtgacatccacaccactcccccttccaaggggatgtgtatcgaggtggaggaggtgcatagggcttgggaagaggccctccaccaccacagccgcacaatttactgggtgttggcttgagagggtgggggg

SEQ ID NO: 47120 - DNA, 265 bp, Oryza sativa
ttaggttaattttgaccgtgtttatatataacggccagtactaactagtacatttcatacatgcaattaacctaattaaatcttgacctggcatgaatcagagtaagcgcagaaaaagaatgaaatggacgctttcagtttcagcaatatttcgaaatcaaattatgtaacattaatccatcatttttcttgtacagaacccaccaaaggaaggtttagcaagctcatttctttgcgttgtttatgttgttggcaaatgtgaaaa

SEQ ID NO: 47121 - DNA, 435 bp, Oryza sativa
tcaagtataaatctttttttttttcgccgggctggcgtaagatacgcggctgaagtttattaagattgggaagaggttcaaactagtacaacaattacagctgccatggaggctaagagctgtacgcccgctattgttcaagtataaatctttacttgtttgaatattcaccataatgttatagtgatgaattgcttctctctttcctatttccaggccaacgttttatctgagggtaaaattcaagaagatatatatggcttttggtgcaaatgacattgtgttgcatatcaagagactaatgtattcatctgtcagaattggatatcaatttgcttgtgattaccctatagtactagctgctggcgttttgttgctgtttctacacaggctttgcccttctctattcaacttcttgctgtcttcatctccagt

SEQ ID NO: 47122 - DNA, 1501 bp, Oryza sativa
agctctgtcatacagcttgttggaattgttggagcccatctcatagctgcatacaaattcgaaaatgctcagcaccgcgcccgatcgtacgctgaaaaatcggtcgccgcgcgcgccgtgctatcgagccgcacggatcggacggctatccatgcatcagactgtgacgttgacgttaatcaaagcaaatactaacatctttcatttcttggaaagattttttctcgtaaactatttatctaatctacaatctgattgcaccactaaatttgttacaattaaatctttacaataagaccacacataattatatttcgacaaaaaaatattttggcttttttattgattttttttttagaatgttgcatatggttttcttaatgtttcaaccaatagttttacgatgtttcagatagtgtactagtgatgtttcactatatatggatcaaatattgcagtggattttgatattatggaacgcgtcgttgcaacaaatcacccacatattttgaaaaccctctgttaaggaaatttggtttattttttgttcacaaaaaatgtttcacctagtgtactcacaatgtttcactatgtatagatctaatgttgcagtgaactgaaatactccattgcaacaaaaaaacccacatattttggaaatcccctattaagggaattcggtttattttttgttctaccgaaaaatgtttcacctagtatacgtataatgtttcactatgtatggatcaaatgttgcagtgaactgaaacgttctttcgctatttgctgaaacattgtttttatataaggtgaaacaacacccgatttaaacgagtgaaacattttcgatctacttagtgaaacaattccgatatacctggtggaacatcgtgcaacatttaaaaataattcaataataaattaaaattttttttgtcggaatatatccatgtgtggtcttgttttgaagatttaattgcaacgaatttaatggtgcaatcggatcatgatttggataagtaatttaagagaaaaatcaatttaaagtagttttacacgtaaatcgggcgctgacgttatcagcacccaatttttctccaacccaatcgggcgcccgagccatagagtcatccatacaaatttatctatagacgatctcatttctaaagtggcaactcttcttatactgatctagaaaattaactaagaagttgttaatggaggacatagataggtgggtgcaccacgccgagcacatctgcatatagagaaagttagatgaatcgttaccgttaattatataatttactgagtaaattatatccatccaaccctgtttttactttggaatgcataatcttttccttccgtttcatgttatggtccactctactcttcgtgtgtctttctcattcccacgctccctctatccaagacaccacacgctctatagtagtgccgagcgactcaagctcaggtttcatgtgcgtgcgagcggaga

SEQ ID NO: 47123 - DNA, 1501 bp, Oryza sativa
tatttgtacaaaggcttggtcaaaaaaattatttgtacaaaggaacatatgtattttttaacacaaaaaaatatataaaatggtaaatagtgccagtggtatattatttgaataaacatgtaattcgaagaatgtttatatattacaatgtagtattggctccggttcaagattgaagtgtttgtaaattttaagggtatgttagataatggaaaataaggagtgggattggaattaagaaataaaagaagtgttaggattaaatggaggagagagaatgaatagttagcattcaaagatgccttttggtgggtgggaaatcatttccctaaagcccattaatcaaacaagacctaagagtccacgaggtcatgtgaaacagtttgatgttttcttaaagataaaaggaatttttattcaactaacatgattattaaatcaaggtaatataaccattgagaacactcacgagtgtttaagtactatgcacatatccaaacatggtatgatagcttctttagagaaaaatgatgatattcctttttacttaacttctctctaaaacttgcaattcgtatttcacactttaaatcgtttaaaatgaaaaaatatcaactacaaagctgtagatctcgtctgtgtcatttggaaaatttgaaaatctgtttttaatgagaacttataaacatattcggacatgtaattgttttccaaagaaaacgttgtcacctacaaagttgcacatcccattgaattatatagcttcggtgtagagcatgtgtccatccaagatcatttaaaacaactaggaaggtggtctgcgcgtatgcgtgggcacttatattattaaaaggtaagattattgtttgttcagaaattttttctaatagatttagggcaaactaaagtttggataatgttattttataataatttaaggtatctatttttcttaagatatcttagaaaaccattcacaaacttttgagtaggagatggattaaatacttacaacttttgaataatgttttttttctcgagtaaataagaaactattgctagttaattatcatacagtccatctatatacatacgtatagtatggccgcaaatgaaaaatccgagtgcaagatactcaaaattcttttgattaaatcgtctcatgaagacgcatgatatggtaataaagggagggaagcatatgcatgggaaaaaaagaagaaagagaaaaatgaaaaaaagggaggggaggcatacgtaccatgcacgtaggtgcgtacctatgccgaggtgggacctcgtactatttagtttgttctaagatcattttaatctaacggtttataatattggacctacgatttaactgaaaatcaagtaatagatactttgattttttttcttagaatttctaatatttgccctaatttattacagcaccacgtggcagcttgcgagcattttaaggaattttaaatgactaattagaatattaattgtg

SEQ ID NO: 47124 - DNA, 1501 bp, Oryza sativa
tacggctgaaagtaattatggcagccatctgtggggaatgtccaggaatcgagcacactgatttatactagaatctgatctagcatgcacactatgaatataaagtagagatctctattgtctttatagactagtggaaatgaaactactccgtttgttttatattataaaactttttagtattacccacattcatatatatgttaatgaatatagacacataaatattaactttaaaagtcttataatatgaaacggaggaagcaattcttatcataagctccaagctccacacacaacattatagagcaatgtagggcttcctttgaaccgcaataatatggctaggtaaagcttggccacctttttatcgaggtttctttgaaattattttttaatttaccatatttttctctacatttaagaccatattttttaatgagccgagccaaaataaaaacaacagtcattcaacattaaataatatgtattttaaaagaaaaaaactagatccatcttatactccctctatccataattataggaaattatggtccttgggtttgtccaaaattatggaggattttggttatcccgagaggatcagtacaacaaccatcagcaatcccactcccaccccttcccatctgaaaagacacacagagaaaatcacgtgtactattagtactaatccccgatcctatcataaaatcaacttcaaaattaagtttgaaaattcaaattttagctttggctttgcctttttagggcaaccgatggagttcacacttttttctcttccttaattagtgctaaaagggaataatcccttatataatcctagtccagagggagtaacaatttttctacatagctaaaggaagttttttttaacttccccctagccaaaggtcaatttagaatcttagattttttagattctagcttctgatcatgttctgaattaaactgtatgggagctctccaaaacacaacctttgcctaaccatggtactagcaaaatcatacatcttaataatgtgtttttctattccaacattactataagtctataatcatgcattccaaagaagcccttaattaacccattattctaacaatcaagttgtgtgtgcactgcaccacaaagcagcgaccagagagagatttccaggaaatacaccatatatgcatcccatagtatatgttccagacaatcaactgatcaaaactgactggctttacaaagtatattatgtagaaaataaaaacagacaattcccaaggacaattcatgtatctcaaacctcagaattgagcaccctggtttagaatgaacaagcatcattcatccagtttttaggagtcgatcaggaattgagcattcggtttgtctataaaagattgcaatatctcctgtgaactctcaagttccattcaaacactgttttgttgtttgggcccaggtggcaacaaatatagggattgagcttctagcatc

SEQ ID NO: 47125 - DNA, 1501 bp, Oryza sativa
ggaatgcttagtattaagttaacatgatcaaggttggaatactttaatctgtacaacttaaggctaaatacacagaacaatgaggggccctttgaatcgtaggaatgaaaaagatgttggaataagaaaaacaaaagattctgacaggaattaaagtgcaaaacagacgattacaaaacacatggaaaatacaagaatgaccgtttgattggatcgcaggaaaaacacaagaataagatagagagagactcaaaggaaattttccaagaggttgacgctctagcaaaattttctccaaaatctctataggattgtccattccataggatttttgaaggataggataggattcaatcccttgtttcaaaggtattcataggattttttttccaataggattgaaatcctcgaaaattcctatgattttcctccaaatcaaagaggccctaagtgatttgccttcatcctatgcgtaggaatagaaaaatgagctctaactggatgctaatttccatatggaatttcttaggaatcataaccaaaggaaattttcctatgcttttcctttgctcaaatactacaaaacgaatgggccttgtacgtttttcctttatttctccttcaaaacgaatgggcccttaaactttatcttgaagaagctacggtttgaaatttgaggaacagagaaagtagtaggttaagataggtcaacatcaaccttcaagtgtgatatcctaggttagttggaggatggtgattgctactttaccaatcacaaagagaaacaagaggcaacatctactgctcacaaccctacatatcactattgttaggcctggtttagatcccaaatttttttccaaaaacatcacacatcgaatctttggacatatgcatagaacattaaaatatagattaaaaagactaattacatagttaaggggaaattcgcgagacgaatcttttgagcctaattagtccatgattagccataagtgctacagtaactcacatatgctaatgatggattaattaggctcaaaagatttgtctcgcagtttccaggcgagttataaaattagttttttcattcatgtccaaaaaccccttccgacatctggtcaaatatccgatgtgatacaaaaaaattttcttttcgcagactaaaacagaccctgactgaactttcctagaagcatgaagaatcaacggtcaaccatccaggcatcagcactagaaaatcttttgttggccactacgcaaattaattaatgaatactaatccctaataattatactgttttttgcttcttcacttgttgaccaaatctggatatatatatatatatatatatatatatatatatatatatatatatcgatcccccaactagtccgaaacctgcaacagcaacgggctgtccaattccacaatagaaggaaagcttcctggccagccaaccgccggcgagacgacggcgacgatggccggagccagaga

SEQ ID NO: 47126 - DNA, 674 bp, Oryza sativa
tgagagctagtgagcctcactccatactttgagtactcgagttcatagcaagcaaatcttcgattgggtttgttactcttggagactaaggtctcctagacggctaggcgtcgccggtgagcacccaaggttgtggtgtgccacggaaagtttgtgaaggcttcgatttcgcctccgcaagggaagaaatcaagagtgaaaccgaggagtgcatttgtgcaacctcgtgaagaaagggttgaaatagacccggccttgtggcctctcaactgagacgtaggatccatggatccgaacttcggaaaacaaatcaacgtgtctcttctcttggtttgctcattcttgccatctctcatattgtgcttgagtttgttttggcccgatctacttgcatgcttaattaatatagttggtgaccttatatcttgcttagataccttatttgtcaccttttgattcgtatacattttgtttattcgtgcaacaagttcatagctagtgttttattccgttacccgccgaacttttcggttgagaccggaagttcttatcccataccggaagttccgatttgaaccaaaagttctctaatctctaatatgctatgaagttgtgataattttttaggaacacctattcaccccccctctaggcgacatcaagttcctttcagg

SEQ ID NO: 47127 - DNA, 1501 bp, Oryza sativa
  unsure (1)..(1501): unsure at all n locations
tgtctagatattgtgtttcttttcatacttagtgctgcatcagttaagtttgatctactaagtcgtgcttagaactaccatctctagcctgctttctggttgccggttagggtagtatcagagtttcagccgatcttatctgatttaactacttttattccatatgcttaatctatatgttaaatctgccctttatgttaagatcttatcgcatctaagtatattagacttatgtttggtatattctacttgctttaacatcttaatacagagtggtatcggggtattagccgatacatgccagatccatttgatcggctatgctataaaagtatataatcccactattaatatatatttcgatctaagtgatttatattgtctcggcaaggtgaccgatctatcccaatcacttgatttaagtatatatcgatataaggattatatatcattaatatctacagccgatcgagtagatttagtcctgatttgtttattgatatttgtcgatcgatgtacgcatgacatcggcttgaaataaataatatgtcatcggcacctagccgatcggctatcatttataggattgattgcggtttctttgttctatttcttgttaattacaagatcaaatcaactggcacgctcatacatccgaaggtgagttttggacctgcactggagttaagcagatctcccaggcctcgtgttttctgtcaagaactagctctcaatgacttggctcctcgcagattcctgcttcttaggctatgttggttgtatgattcgatgatctatgccctcccccggggggtcccttttatatcacagatctggaggtctccaagtagaactcggagatatcagacccaatacgatacgccgacgacccagttctgtccgagaaggactcttcccatctgtagatttcgtgaaaggtttccttaggatatgtagaaaacatccgcgtgcgcgtgggtatgccatgtcgatatgtaacgtatatcgaagggtagagggtatgcctgacccgtaaccctgacacacataagatacatactattgtatttttcaacttgaaaggagacactagatggagtataaaccagctacgactagctgtgtagtcatgtccaatgaaaaatgcatgcattaaagttactttcttttgttctaagatacttctataatatatgtaaattaccttttggctttgctgaatttacttttatatgtctaagaagtaacttagtgaaatctaaaagtaatttagacatatcataaaagtaatttatgatttttcatcaaaatataatcatgtgagatcttgttataaagatttaattattacgaacacaacggtgtaatcggatcgtaaatcggatgagtagtttaagagaaaattttatttgaagtataggtgtatagagtctctcatagatggagtggtagntggtttagacncaaccagctaccactactgtgtagttatctcctaaac

SEQ ID NO: 47128 - DNA, 1501 bp, Oryza sativa
atgagcacttacttctgcgtactcagccgatggcgtggtagacgggctggcggaagtcgacatcgccgcgggcggaaacttggccggggaggagatcgccttgaaatcgccttgcgcaccgagggaatcgccggagagagggaagatgagtttggcttaagcggtgaaaacggaagtaacagtgtgaagtttctcggggacaacggttagtatttaaagcagagtgataacggtcggaaaaacggcaagtgcgatattttctcggagatgaaatatcgcaaatccgaaacaatatcatatattccggacttggggggaatgtgttaacaaccaaatttggtaatccaagtgtcagagatgaagataagatcgaagcagaatccaagatcaagatcgtttcagaaacatagtaagaatcggctaagtccgaatcttctatgatcttaatcagtagagtttgagtcagacaaggttagccgattgagccgattccgacaatacgactcggtatacgttgtcgggttgtgttaatgtgcttcatatggattgccacacacggattgggtcctggaaaggcaattgtatctattaattaggatattttatgtaattcccttatagatatgtttgggcaaaagtctaccgcaaagacttatggtatcttagagtttgttagagataagagtcgtgtccaacacggacatactttgtaatctcgggtataaatagaccccgagccccatgtaatacaacaacacacgttcaatacaatctcggcgcatcgccacccttttactttcgttttgtttcgacgagttcttgctttcgggttgagctgcatcggtttcgatcttcaactagaggtaaaagatgttatggcggcttgcgttctcgggattagtgcttccatctttatgatactctaatcttgtttatgtaattcgtcgagttatcatatattttatataatcttaggcaatattgttatttaaccatcaatcggctaacatctatcgctagaaggcagttgatcaggttaaataccaacgttgacttagattatataggatatccaccactctatgaaagatccagcggcttgattgtctagatattgtccttcttttcatacttatagctgcatcaattgggtttgaccttataagtcatgattagaatcttatctctagcctgctttatggttgccgattagtgtagcatcggggttttagccgatcttacctgatttaatatatatttcgatctaagtgatttatactgtctcggcatggcgaccgttctatcccaatcacttgatttaagtatatatcgacataaggattatatattattaatatctacagccgatcgagtagattcagttctttcttacttgttcatgactgccgatcgatatacatatgacatcggctcaaagataaatgatatgttatcggcaactagccgatcggctatcgtttatggatttaaccgcggtttc

SEQ ID NO: 47129 - DNA, 1501 bp, Oryza sativa
  unsure (1)..(1501): unsure at all n locations
ggaaatagagtaagaatcggctgcagtccaaatcggctaaggtcaggtcggcagagttcgagtcggacggggctagccgatacagccgattccgacaatatgactcggtgtatgtcatcgggttcaagttgatgtgcttcaagatgattggcacgcatggatagagtcctgggaaggcaattgtatttattaattaggatattctatgtgatttccttagagatatgtttgggcaaaagtctgccgtaaagacttatggtatcttagagtttgttagagataatagtcgtgtccgttatgggcgtatcttgtaattctcgggtataaatagacccgagccctatgtaaaaaaaggagaacacatccaatacaatctcggcgcatcgccaccctttttgctttacttttatttcgacaagttcgtcctctcgggttgagctgcatcgacttcgatcttcaacaagaggtaaaacttgtcatgacgacttatgttctcaggattagtgcttccatctttatgatactctaatcttgtctatatgattcgtcgagttatcatatatctcacataatcttcgataatatctttatctaacctataatcgactagcatctgttaatggaaggcagccgattaggttagacaatgatgttaacttagattatgtgatatatctaccactctacgaaacttccagcggcttgattgtctagatgttgtgtttcttttcatacttagtgctgcattagttaagtttgatctactaagtcgtgcttagaactacaatctctagcctgctttctggttgccggttagggtagtatcggagtttcagccgatcttatctaatttaactacttttattccatatgcttaatctatatgttaaatctgccctttatgttaagatcttatcgcatctaagtatattagacttatgtttggtatattctacttgctttaacatcttaatacagagtggtatcggagtattagccgatacatgccagatccatttgatcggctatgctataaatgtatataatcccactattaatatatatttcgatctaagtgatttatactgtctcgacaaggtgaccgatctatcccaatcacttgatttaagtatatatcgatataaggattatatatcattaatatctacagccgatcgagtagatttagtcctgatttgtttattgatatttgccgatcgatgtacgcatgacatcggcttgaaataaataatatgtcatcggcacctagccgatcggctatcatttataggattgattgcggtttctttgttctatttcttgttaattacaagatcaaatcaactggcacgctcatacatctgaagcgaaaaagggtttttttgggaaaccttgcaacctggggaaagttaagcagatctcncaggcctcgtgttttctgtcaacacgcttttggcacgcctggtgggacaggttagaagtcagaaatcaatcttcctca

SEQ ID NO: 47130 - DNA, 1501 bp, Oryza sativa
cattcattcaagaatgtagaggaatttttcctgtggtattccttttttctatgtgcatgctagatttagattctaatctgaatcagtgtgcttaattccggagcattgcccacggttgcaattgctttcaaaccctatacgtgctcaaatcttacacctcaaaccaattaacgcacgttttaaacgttttaggggtccacacaagagtgttctaacgatttccagctacaacacggtacaacaccaactttctttttttttttacatgggcacatcgtgtgtaacaataaaaattaagttcataaggtacgatgaatgtgtccatctagccttttatacttgacaccattgaccagtgtaattttatttttactaaaaaaatattttaaattgcactgttgtaagggatgccagttatatttatcatgcatagcactccgcattattttgataatccgacattgttctaaatatttgtaaatcttttaaaaaataagagcggtcaaagtttgtagatcaacatatctggtgacaaagagcaccaagggagtaattaattactccctccatattttaatgtatgacgccattgacttttcgaccaacgtttgaccattcgtttcattcaaaaattttgtgtaaatataaaaatatttatgtcatgctcaaagaacatttgatgacgaatcaagtcataataaaataaatgataattatataaattttttgaataaaacgaatggtcaaacgttggataaaaagtcaacggtgtcatacattaaaatatggaggtagtattacgtatcatcactgaagaaaccaccactctaaagtctctattgcctaatagactttccacttgtacagagtacagatagagacaccatctatatctttgatcaacgcaacgacttacctgccatgcgtcaaacctagcctccgttttttttttctgtaaggtatgataacgtctccaggagaaaattttgacgcgtcagattattttatttaagtaaagaatgctgtaatttctaagcttgaccttatgctacaccgtttgttggcaaaatcgtcacaagaaggacctcctgtcttttatttgttcttgttgctccatatgttactgctgattttgttctcctgaaattaaaattcatacgcagattgtacctgaacaggttcacataactgacaaagccagttcaaacccaaattggccaagttagtttaaaaagttcaacataaattcaaaattttgagaaatcttgttcgatttttactgattttagctagctagcttgatggtaccgggttgtatacatctctagttgcagatattggatgtttttatttgcttaaagaatcttagaggaaatgtgtctgggcctcagggaaagttagatgatgggctggcatgctgacatggccagtttgcacgcatggcatctcctagctactaacacaaagggctcataaacctgccaagttgttaaaccgctgg

SEQ ID NO: 47131 - DNA, 1501 bp, Oryza sativa
cgtcgtcgtcttcaccgctcatcctcgccgactcgtcgtctcgtggcgccgcctccgtcgtcggcatcgtagcggcgtgttccacgccatcctcgtcttcgtgcagccgctgtaggctgcccacgtcgcctcctcgacggccccggtcgtcgtcgtcgtcgtcctcccgtcgttcccggtcgtcgtggccttcgtccctccgtcaagccgatcgcgttcgccgcccgtagttcgtcatgcgagccactgcagccccgtcgtcatcttcgtcctcggctctgcgtcatcaagcctcgtgccggccgtgtctcgccttcgttcaaggatcgccgccgaagttgttccctcgccgtttgcttccgtcgtccccgagccgtctccgttcccacgccttgtcgcgtggtggtaaggatccctctccctcactgccccgtcctcatcctttcggtgtcgcccgtgcctgttgtgcggttgtcgacaccggtacccgtgtaccggtgtcggtagtcgttcgtgtgtgcatgtggtgaccgtgtttgtgtgcgcgctcggtagccgcgtggtttccacatgtgcagccctcgtggtgtctagtggagtccgtttgtcggccacttgcctcgtttgacacacggggtccggttccgtcgacccgtggaccgtctctgtgtactctgtctactgtggtcctttaggttgacatgtggggtccgcatgtcaacagcgcagccttcctgtcttttccaggctgacgcttacacatgttttatagttgcaaaacctaattataataatccgcaaatctccatataacagcattaaacttcggatgaccatgtcttggtcatacgagctccgaatcgatccgttcaagtctcctaatgttttttataacctaaagaaccatgtgttttctttttatgtattgttattgcttctttataggcttgtagctttgcttgtgtgcttcgcgtagcttctgtcgttccggaggttcccgaagcgtggttcgtggtcgtcgccgaaggttcggaaggccgttgtctctgagcaaggcaagtcacatcatccttgagcatattgaatcccagtttataaaattattttgatttaaattaacgtattatcgctttatttaaattcccgcgttatcattgttttatttagccatgcctatttacctttgttatgaccttattattattgctattgttattattaccttgttcaccctaggaaaataaaaccccaactagtgggtactctattcatggttccactggtatgaatttaggtagatgcttcgctgattaattaggcaacattaggtggttttataactttagactttgggaattctcatatcatttggacactatggaatggttggcttatgttggaattggacacacctccccctctattcaaaacccccaaaatggttttaggctgggctcgaggtgcgtggttgggttttgtttgtcgtacctcgggtactata

SEQ ID NO: 47132 - DNA, 1501 bp, Oryza sativa
gcctgtggatttggtacatgactagtaattcaaagtcccgtttagtatttacacatgaacaaataatgttaggggttatttcctctatgctctatattactgagaacatgcaatctacagtagtgctcaagatagaatttacaattaacaattttcacagggcagcatatttataatttatattgaagcaacaattaatttcaagaacttgaatggaagaaaggtaagagagttggtacatacttggatccttgaattcttggcataactgaactcactgtcccctttcatcatgtggaaatctcgctcgatcttcatggctgcaagatgctttggctagaagcttaattccctgtatgtgttgctatctgcctagctagacaacagcagtgttatatgtgtggcgtatgagagctcacaagagattatttattccttttatagggaaaccggatatgcacgtccgatatttcaaacaagaaaataaaaatatatggctgatatttattcattctaaatcaaggtgcttaatattgtatttgatacaatccaattagtacgggattatatcaaatacaaaattctcaggccatgagatattggcactatgtaagcaatactcacaaacttacaggcggtttttctaagtatccaccagtgaaaaccatgaattttaaaggctgtttcttaagaaacagtctgtaaaaaatgtggtgacttttataggtggttctcttaaataaaatacatgtaaaaatgtttttttacactgtccttcaaaattgaagcaatatgttctggatttaaagaaaagtcaaatgattataaattttatattaaaattgtagctcttgatgagatctataaaagttttttttatttgagatcacttttcaggccgaaatagtcattacaggctctcaggacatagggtaattttgcacattgtcagggttatggataccacatacccaatagtaatcgattaatctcggcagggcccagcacataccaagtcttatacggaatcataactcgtatataaaaggagttccggataaggaaggacaaatagagttctatatggaaatgacaaagactacacggattgtatctatattggtctctctagttctacttggacaatgcgacatctataggtataaatacaagcctccctagaaggagaggggacaagccacaaggcacaacatacacacaaggcaatacgccactaaatatcgacatcagagattagcctagacataccctatccggcgcctatggaggccggcaagagggatctagctctatctctgatctcgacgagatcatattcgaggaggaagactaccctgccgtcgactacgagttggttatccatgccgccaagtcgacgaccttatctcaaatattgtactggtgtgattatgatgaataagagcaacaccagtttcggccaacaggagttgggctatcacctgtcagataagaggtccga

SEQ ID NO: 47133 - DNA, 1501 bp, Oryza sativa
acaaatttcaaaagtaagttcaatgttaacttcaacacacattgtcgacgggtgatacccgtagaccggatatagagggtattggggtacgttggtacaaggatctacgtagtacgacatcaaacaatcaaaagacaagaattatactggtttaggccccttgataggtaatagccctaatccagttgatatgggattatatggtggaaaacacaggttataaagagaacgatggaacttgtcggatccgacaagatcgtagtcgagttgattcgactagctctcaatgacttggctcctcgtagattccggcttcgtaggctgtgttggttgtaagattcgatgatctatgccctccccaggggggtcccttttatatcacagatctagaggtctccaagtagaactcggagatatcagatccaatacgatacgccaacgacccagttctgtacgagaaggactcttcccatctgtagatttcgtgaaaggtttccttaggataagtagaaaacatccgcgtgcccgtgggtatgccatgttgatatgtaacgtatatcgaagggtagagggtatgcctgacctgtaaccctgacagtagccccgacttttgcttaaaatgaactcgtgcaaccatttacgacttcgggtgtcgagaacgttatcattcctggtgcgaggaccgcggagatagaacgtaatcgagcatgccgtttgaagcccaacggtcacgagtgaattttgaactgaagtccataaaactgccgcgcgtaacgggcccagtgatttccggcggggatctctctccgttccttggaattcgcaccgtcggtagtgcgcttatttaaaggaactttgggagctcattttgaagtctgccaaccttgttgaacacacaccgcctgccagcgctccttgccttctccaccgccaccagaaaccctagttcgccaacccaggcttgttttccggcgatcttggcacagcaatggatctcggcaagtcgtcttccaccggcgcgacgttgaagaaccttcaggaggacggtgcccttcccggccgtgaagacatggagagagaagtaggaggtactgatcctcagcccctcttgggtcgcatggttgcgatcgaagattacgttttctgcggttttcttcctccatcttccgagtttcttctcctgatgttgaatttctatggtctttctcttctccatttgaatcctaattccatcccctttcttagtatatttgttcatctctgtgaggccgagccttttctcgatctcttctgtttctactatgaactgcgttggatggaatccaatagggtgtctggttgcgtcgggttccaacttcgtgatggcatgaaatcgcgttatatccccttccagtgtccttcttcccgcagtaagtggcggaataagtggttctatcttgagatgaaggactcaaaccctgtcttcgttgttcccgaggatcaaccggacaagattccggcc

SEQ ID NO: 47134 - DNA, 1501 bp, Oryza sativa
tttttttgcttattgcagcaatcgtaactgacaattctaaaatgatcatgcacgtgtgaaacattaatcttcttttttttctttcttttctatatggtatataagggtacaatggtcatttcattcataccgctgcatgcgaggatgacttggcatgctcacatggtactttgtgtgggtctaaggactacattaacccaaataattaatttagaggacttgtatggacgatttgaaaccttaaggactaaattgagcccgaagcgaaacttcaggtcatattagctattcaccattttaattcaaacttatcctttaacccacataactaacaactcttttgataaatgacacttatgccccctcattcacatatatagagaaaaaatgcatgtaatgaattctttttatagataaaacaaaaaaaaattatgtgcttacaagtgtatacgatagccattaggctcaattttcatgtgcacatgttgaaataatgggaagtaaatatacaatgttgtttatttattttggtttcttttttctagtgtatagttgtatacaagttaagggcaaaagggacattttctaatagaattgatgactaaaaatagccatatggcatattaagtgggcccaatgataattttaggccaaaacaaatacttagttggtgtttggatctaaggacttaactttagtctatgtatttagacactaatttagaatattagatatagactacttacaaaactaattatataaatgaaagctaatatacgagacaaatttttaaagcctaattaatccataattagagaatgtttactgtagcatcacataggctaatcatgattaattaggttcaatatattcgtctcgcaaattagtccaagattatggattggttttattaatagtctacgtttaatatttataattagtacccaaacatccaatgtgatagggacttaaaagttttagtcccatataaacagggtcttagaggatttttatgttaacaaaatgaaacctgaagaaccaaagtgagccttcggtgaaacttgagggactaaattagctattcacccttttttttaaattcatcccccggttttcgggatttcctttcaccaaatcaagcacatagcacattacatttgtctttttttttttttgagagagagactggctctttgaaatgtataaattttacaggattctagttcagttcctcgaaaaatcctttaaaattccaccgttccaaaagaggcctgataatatagagaacaaattgattcctccattcgaaagtaggcctaattgtatattcttgagaacaagcaataaaaaatgtggtatatacttgacaagggagggagaacaagtggaaacgccagtaatttcatgggaatatcatcttctgccatcatcatagggttcatgaatgaagatcaaatgctggtaacatgaactgaaacaaactgcaagatgcaaatgaata

SEQ ID NO: 47135 - DNA, 1501 bp, Oryza sativa
ggcgtccccgtgcgccgcccgcccgagccgcggcgcccgcgccgccgcgcacgccgggagcacgattgggtacgtgtagtggtcgggcgccacgcccgcggcgcgcatccgcgcgtagagcgcgagggcgtccctggcgtgggcgcgggagtgggcatgggcgcggaggagggtgttccacatgtaggcatcccggctgggcgcggcgtcgaacaccctgcgtgcgtaggcgaggcaggcgggggccacggcggtgatgaggctggtggcgaaggccgggttggcggagatgccgagcacgacggcgcgggcgtggatggggaggagggcgcggagggaggcggcggcggaggcggaggcggcggcgaagaggaggcgggtgtagtggtggacgagggcggcggcgggcggtggcggtggcgctgccgccaggggaggaggggccattagcgctcgtcagttctgcgggatttgtgatggtacgaatttgaggggtcttttatgttttgaaacagcaacttcatcaaaacttttagatgagtaagatttttcttgtgcaaggaaaatattttgaattttaagtgtgcagcacgtcctcctagtaatctttttttgcttattgcagcaatcgtaactgacaattctaaaatgatcatgcacgtgtgaaacattaatcttcttttttttctttcttttctatatggtatataagggtacaatggtcatttcattcataccgctgcatgcgaggatgacttggcatgctcacatggtactttgtgtgggtctaaggactacattaacccaaataattaatttagaggacttgtatggacgatttgaaaccttaaggactaaattgagcccgaagcgaaacttcaggtcatattagctattcaccattttaattcaaacttatcctttaacccacataactaacaactcttttgataaatgacacttatgccccctcattcacatatatagagaaaaaatgcatgtaatgaattctttttatagataaaacaaaaaaaaattatgtgcttacaagtgtatacgatagccattaggctcaattttcatgtgcacatgttgaaataatgggaagtaaatatacaatgttgtttatttattttggtttcttttttctagtgtatagttgtatacaagttaagggcaaaagggacattttctaatagaattgatgactaaaaatagccatatggcatattaagtgggcccaatgataattttaggccaaaacaaatacttagttggtgtttggatctaaggacttaactttagtctatgtatttagacactaatttagaatattagatatagactacttacaaaactaattatataaatgaaagctaatatacgagacaaatttttaaagcctaattaatccataattagagaatgtttactgtagcatcacataggctaatcatgattaattaggttcaatatattcgtctcgcaaattagtccaaga

SEQ ID NO: 47136 - DNA, 351 bp, Oryza sativa
aaaggtgccagaccacgtgggcgattgtgtctgcctcaagcctctagtcatgatactcccggtcccatatcaccgacagtagctcacgatggttaatcgtgttatgataattaattgataattaaaacttatcaagggtgggttgtgagcacatggttttaaaggttgtgctcatggcaattaaggaccggttcgcgagctactgttgtgagaaattaaccgtgccaaccacaagccagcgtgggcaacggctttaccttttgtatagcatggttcattgcggggcaccagactgtgaagcggcgagaagtccgtgggggtcgctggggagtccatgcctctggttattga

SEQ ID NO: 47137 - DNA, 436 bp, Oryza sativa
atcttcatccgtgcaagcgccaccgccgggtcggcaacgatgacgacgccgccgtggtgaagaggatggtggttcgaatccaaaattttgtaatatttttgataaaatagagtcaaataaacaagggcagaaggggtattttttttgttccaattgacaccgttacatgccctgaatagaagatggttagattgtatcttcaattttaaataggagggtcaaatgagcaaagttgaaaaaagagggtcaaattggaagttaggtctcaaaacagggtcagatgcgcaattgccccaaagtaaaaaataaaaaattggtggggcccacttgtcaaccccacttctcccttctcccatgggagactatgcagtggcgggaggccagtggtacgatgacctgctactccactctcctatgctcctccatcctcccaagc

SEQ ID NO: 47138 - DNA, 220 bp, Oryza sativa
gctccaataaagaccacaagaaaggccgatagctccccaccacttgtcaaatgccagaagcgtgaacgcggcaaggggaaggtcggggagttggcgccggagccaaaaaggggcaaggctgcgacgttgatgccggtgagcaaagcggggaaggtcgtgagggcgctagcccaatttgagctaggcatgccattggtggaggacaatgtgttagccgtga

SEQ ID NO: 47139 - DNA, 1501 bp, Oryza sativa
tgttttagtctgcgaaaagaaaatttttttgtatcacatcggatatttgaccagatgtcggaaggggtttttggacatgaatgaaaaaactaattttataactcgcctggaaactgcgagacaaatcttttgagcctaattaatccatcattagcatatgtgagttactgtagcacttatggctaatcatggactaattaggctcaaaagattcgtctcgcgaatttccccttaactatgtaattagtctttttaatctatattttaatgttctatgcatatgtccaaagattcgatgtgtgatgtttttggaaaaaaatttgggatctaaaccaggcctaacaatagtgatatgtagggttgtgagcagtagatgttgcctcttgtttctctttgtgattggtaaagtagcaatcaccatcctccaactaacctaggatatcacacttgaaggttgatgttgacctatcttaacctactactttctctgttcctcaaatttcaaaccgtagcttcttcaagataaagtttaagggcccattcgttttgaaggagaaataaaggaaaaacgtacaaggcccattcgttttgtagtatttgagcaaaggaaaagcataggaaaatttcctttggttatgattcctaagaaattccatatggaaattagcatccagttagagctcatttttctattcctacgcataggatgaaggcaaatcacttagggcctctttgatttggaggaaaatcataggaattttcgaggatttcaatcctattggaaaaaaaatcctatgaatacctttgaaacaagggattgaatcctatcctatccttcaaaaatcctatggaatggacaatcctatagagattttggagaaaattttgctagagcgtcaacctcttggaaaatttcctttgagtctctctctatcttattcttgtgtttttcctgcgatccaatcaaacggtcattcttgtattttccatgtgttttgtaatcgtctgttttgcactttaattcctgtcagaatcttttgtttttcttattccaacatctttttcattcctacgattcaaagggcccctcattgttctgtgtatttagccttaagttgtacagattaaagtattccaaccttgatcatgttaacttaatactaagcattcctgtatttttcctaccaatcatccaaaggatcaatgctatatttttcctatcatttgttttgcacacgcgttcctatacgattcctatgttttttttatattcctatgatttggaaatcttgtaaaccgaataagccctaagaaaaaagacaaaagaccaaaatggccctaattaataggaaagttgtattgatggataggttggtgaggggtattaaatggataattttttttgatttgccaatggatggtaagtaagaaggtagaagttggtttaattcgggacaaaattcaaacatagaaattgatttaatttgggacggaggaaata

SEQ ID NO: 47140 - DNA, 162 bp, Oryza sativa
atagtgattatctgcctggtgatgattgctctttagatgatgatgatgaggaaggtgcagctatagaaagacattacaaagatctcaagaagaagctgaggacaagcaaagtggctagcttggatgatgtgacttttggggggcacaagacaaatgcaaata

SEQ ID NO: 47141 - DNA, 1501 bp, Oryza sativa
tgatttatcgaaagatggtgcaataatagaagatgatatcctcatgttgctcatccttattcatttgcatcttgcagtttgtttcagttcatgttaccagcatttgatcttcattcatgaaccctatgatgatggcagaagatgatattcccatgaaattactggcgtttccacttgttctccctcccttgtcaagtatataccacattttttattgcttgttctcaagaatatacaattaggcctactttcgaatggaggaatcaatttgttctctatattatcaggcctcttttggaacggtggaattttaaaggatttttcgaggaactgaactagaatcctgtaaaatttatacatttcaaagagccagtctctctctcaaaaaaaaaaaaagacaaatgtaatgtgctatgtgcttgatttggtgaaaggaaatcccgaaaaccgggggatgaatttaaaaaaaagggtgaatagctaatttagtccctcaagtttcaccgaaggctcactttggttcttcaggtttcattttgttaacataaaaatcctctaagaccctgtttatatgggactaaaacttttaagtccctatcacattggatgtttgggtactaattataaatattaaacgtagactattaataaaaccaatccataatcttggactaatttgcgagacgaatatattgaacctaattaatcatgattagcctatgtgatgctacagtaaacattctctaattatggattaattaggctttaaaaatttgtctcgtatattagctttcatttatataattagttttgtaagtagtctatatctaatattctaaattagtgtctaaatacatagactaaagttaagtccttagatccaaacaccaactaagtatttgttttggcctaaaattatcattgggcccacttaatatgccatatggctatttttagtcatcaattctattagaaaatgtcccttttgcccttaacttgtatacaactatacactagaaaaaagaaaccaaaataaataaacaacattgtatatttacttcccattatttcaacatgtgcacatgaaaattgagcctaatggctatcgtatacacttgtaagcacataatttttttttgttttatctataaaaagaattcattacatgcattttttctctatatatgtgaatgagggggcataagtgtcatttatcaaaagagttgttagttatgtgggttaaaggataagtttgaattaaaatggtgaatagctaatatgacctgaagtttcgcttcgggctcaatttagtccttaaggtttcaaatcgtccatacaagtcctctaaattaattatttgggttaatgtagtccttagacccacacaaagtaccatgtgagcatgccaagtcatcctcgcatgcagcggtatgaatgaaatgaccattgtacccttatataccatatagaaaagaaagaaaaaaaagaagattaatgtttc

SEQ ID NO: 47142 - DNA, 1501 bp, Oryza sativa
  unsure (1)..(1501): unsure at all n locations
acaacctgctgccttgatgaagtctgttgaatcggctgcacaacttgttgccttggtggcgtctgctgaatcgaattgatagtagattggaggggtaaaaacatagcagccacctgatcctgtgttggccgatttaccgtctgcccgctatgctgtggctgttccctcatcaatagccaaggattaatcagctggcttggtgtcaacgctgatgaagtaggcaaagaagtcaatagcggtgccatcggctgaaccgatggtgcactcggaagaactgcttgagcaggtggctgagcatcagtgatcaaaggtcgatatttcggaaaaacacctccctgcaagtagaccgggcctgcagcttgatgctcagctattgatccatcggctatcgtcttcatcatgttagacaatgtgttgactaatactccagattgattgatcaaagcatggtgtacggcgtagtccactcgatcttggaaattgttgaagaaatcttgtgctgtctcactattctgattaagatttccttcttgtggctcgtgagcaccatcacattgaactgcatgtacctcctgagagccgtcaccctgattctcttgagccgagtcatctaaaactctttttccttcttcctccttagaggtactggtctcaggctcatcgggaaccacctttaccttgtacttttgaataaatgttcccttgcgagtctgtgtgaatgacctaaagaactattctcgtgcttgttgcatcattgcttcaaaatccttcttctggtcaggtgtgagcttttccggatcaacagccacaatattctcttcattaactttgctcaaacctagtctttggattttctctttaacagtacctgngctagccgaggatggcgacggtggcagcttctcggccatgaggaagattgatttctgacttctaacctgtcccaccaggcgtgccaaaagcgtgttgacagaaaacacgaggcctgngagatctgcttaactttccccaggttgcaaggtttcccaaaaaaaccctttttcgcttcagatgtatgagcgtgccagttgatttgatcttgtaattaacaagaaatagaacaaagaaaccgcaatcaatcctataaatgatagccgatcggctaggtgccgatgacatattatttatttcaagccgatgtcatgcgtacatcgatcggcaaatatcaataaacaaatcaggactaaatctactcgatcggctgtagatattaatgatatataatccttatatcgatatatacttaaatcaagtgattgggatagatcggtcaccttgtcgagacagtataaatcacttagatcgaaatatatattaatagtgggattatatacatttatagcatagccgatcaaatggatctggcatgtatcggctaatactccgataccactctgtattaagatgttaaagcaagtagaatataccaaacataagtctaatatacttagatgcgataaga

SEQ ID NO: 47143 - DNA, 1501 bp, Oryza sativa
gcgcaccccaatgaacatctcgcacaggtgcgtgaagatggccaatgtcatcactgcattaggggtgaggtgcgccatctggagatcgtagaaatccagaacatccataaagaaagaagaaaatggcggaaccagccctgccattgcgaaggggaggaaaaagacggaccgccccgggtagtctggtgccgggcgtccctcgcccagcatcactatctcccggccggtggcagattccggcataaagcggcgcggcagcccggcatgcctctcgctcacgatgcgagaaggcggaagtacgcttccgtcgagcagagcggaaccccgagccatggcgccggaggaagggatgattgagagcgagcgcgtgtggcgaaggtagggcgcagcagagaaagagttagggctcaagcggcgaaggcaagaggaataatggcgaaaggaagggagcaaaacttttcctcggtatttttatacccttgccatagctgggcccggctcctcgtttctcgcgcccactatctcgctccctcgtttctcactatctcgctccctcgtttctcgtgcccacgcttccactaatcccattcgcccgcttgcggcgcatgaggtggatatgcgattgtggcagtcgagataggtcgtatcgtgcgcgcattaattacgctcgccggccgaagcgacgttaccatatctccaggcgaagcaaatcagctcacccagattcgtgcgctgcttaggtgatgtggcagtcttaaagagaccgcccattatgaacagccaagttaccattaccgatgtgcatggtttgagaccgttgggtttctgcgcaaccatgaaaaccggtcccacctgtcaccaggctttaggagtggcgttacgcccgatcgcttcccttgagaagggcgatcgccctggcataacgccggggactactgtcggtgatatgggaccgggagtatcgtgaccagaggcttgaggcagacacaatcgcccacgtggcctggcaccttcggggacgtcgggcccgagggtgaggtgtccgcccttctcctgatttccccgaggggggtcgggtgactcctgccccggccccgagggccgaggcgccccgaccccttgtggagttagcgccacatgaatgggttgggtgaacacggtgagcctcacctaaccgcatttattgcggtctggtcgaacgtgtcacgctgcatgaagcacagtgcagcgcgttcctttatccggtctgtgaccggtcacagaccggtcagatcacgggttaggtggcgactggtggtctgacgcacgccttgccccatcccgtcaagacgaaagcctctaggcactcgtctcaagccggagctagcgtgtaatctcttagagatggcacgttagccctggttagatttataccaggcttcatctcaaccattacagcctatatgttgtatgaagaagggtgaacatgcagattgttgaactgacgcgtggaggacaagaa

SEQ ID NO: 47144 - DNA, 1501 bp, Oryza sativa
agggcctacgcttaatcaggtcataaggtgatttcgaaaggagaatacgggatgcttatcaaatatacttacgttgatggcttcatcgcgttccgccgcccccttttcacaaagaggcacgggcatgtcgctagccgtcgttggaccgctgatcatcacttgaccgacgcgccgctctatagcttcgctgctcagacctgttaaacgagaactggcttttgataagtcaagaggaacacaagtacaagcacgccaagatgaatacgagaaagataccccgaggagaaacccaggttgcgtcatccggcccgaaatagttataggctggatgggcccgagcctggagcggctggatccgcctaccgacgaagtctgcagcgacttcatatcccgacaagccccgttctcggagatcatcgatgatgtcgataaacgactgaagagagggggtcaaagggggcttggcggtccaggccggaatcttgtccggttgatcctcgggaacaacgaagacagggtttgagtccttcatctcaagatagaaccacttattccgccacttactgcgggaagaaggacactggaaggggatataacgcgatttcatgccatcacgaagttggaacccgacgcaaccagacaccctattggattccatccaacgcagttcatagtagaaacagaagagatcgagaaaaggctcggcctcacagagatgaacaaatatactaagaaaggggatggaattaggattcaaatggagaagagaaagaccatagaaattcaacatcaggagaagaaactcggaagatggaggaagaaaaccgcagaaaacgtaatcttcgatcgcaaccatgcgacccaagaggggctgaggatcagtacctcctacttctctctccatgtcttcacggccgggaagggcaccgtcctcctgaaggttcttcaacgtcgcgccggtggaagacgacttgccgagatccattgctgtgccaagatcgccggaaaacaagcctgggttggcgaactagggtttctggtggcggtggagaaggcaaggagcgctggcaggcggtgtgtgttcaacaaggttggcagacttcaaaatgagctcccaaagttcctttaaataagcgcactaccgacggtgcgaattccaaggaacggagagagatccccgccggaaatcactgggcccgttacgcgcggcagttttatggacttcagttcaaaattcactcgtgaccgttgggcttcaaacggcatgctcgattacgttctatctccgcggtcctcgcaccaggaatgataacgttctcgacacccgaagtcgtaaatggttgcacgagttcattttaagcaaaagtcggggctactgtcagggttacaggtcaggcataccctctacccttcgatatacgttacatatcaacatggcatacccacgggcacgcggatgttttctacttatcctaaggaaacctttcacgaaatctacaga

SEQ ID NO: 47145 - DNA, 576 bp, Oryza sativa
cggcgggaggcggcgggattcgcagcggcggcggcgctagggcgcgggggaggcggcgggaggaaggggatgacgggtgggccccacctgtcagcgagggtggcgggcgggcctgcccgtcagcggcgcgcgcgcggggagaggccgagtgggccgcggggagaggagagagagggggagggagatgggccgaattcggcccattagagagaaggagggattttagggtttttgtttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatgtattttagagtcgttttgggatgtgacatccatcctaaaaaacttcacgaaatttctccctgcatccaccgctccgattccccatccctttccagccgtatctcgaaccaaatcaaaccatccagttcacattca

SEQ ID NO: 47146 - DNA, 389 bp, Oryza sativa
tatactctaaatgtttattatatttatactatgtattaaggtgcttaattaaatagagatatttttattgccgtacttcagattttatttgcctaattacctttttaaaattttattagatcatgccatactacttattattatatagttagttatagatgaacatagttcctttcttacaagaaaatataaaaagtgaagtgcacaactagttgtagtatactatattaaatgataaaaatagaatttttgatttattgttttagaaaaatattagctacatctcttcgttggtttgagaagttcaatttaaaagtttttatgttccaataaatatacattaccttattcgctccgttttcgcatttaataataatcgattccatagt

SEQ ID NO: 47147 - DNA, 1501 bp, Oryza sativa
ttttttaaatattgcatctacttttcacatgtttctagtttagttcgtccatctttgtcgatttgcaccgtaaattgtccaccttcgctgcgacagtgcgaaatcctttgtgggtttgtcccgtaaacctttcatttgcacacgagacgggtagttatccatcattctatctaaattggcttcgttagccggtttaatttatcaaaacccatcttggtctagctttttgctaggttggggtggttggcgactccatatcaccgcaaggcgtttaggtgcctcgatcgtgattgtcttcttaccaaaaaaagataccaacagctaggttaacttgttttgggacagagggcgtaagaaatacacagccgaaagaatcaaacttaacgcggcacaatgtctagcatcaattcttttccgccacaagaacggtgtgaatactcattgtcaacttcgcttgatggcttctggcttctcccgttctccggctctccactctactctcccggctacctaccttgcacgattggtgtgtgcagcgactgcgagtccgcaactccgcctctctttctctatctccggcctcaggtgctcagcaccgcaacaacaccggcagcccgcggccggcgtggggcatgcagcgacctgcgtggcagcgctgatgatgcggtgcgtcggctggcaacggcgacgagcagggctgtggccagcagtggtaggtatttaggtcttctccttgtgctcctttttcaatttttcagtttgaactcttgtgaattgtgcatttttgggtttattttatcctctatacttgtattgtatatattagcgtcatcacatttgcagtgtatagaatttttttctctaagtcagatcacccagaccataaatcctagatacgccactaggggtgattatattaaataaaagattgagaatagatcagtttggtttacccagcataaaattcggtaaaaaaaaaagactccacatcttggaatgtcgtaggaaatgcaaacagacgagcacagccacaatgctgatgaactccggcacacataaaagcatatgaacaagtatagatcaccatctccgtccctctaacagagtaggcaaccgatgccaccaacagagttggtcacctggacaccaaatccagcgatgctgatttgatcgacaacttggtagacaagactttataggcctttgttggagacctcgcgaatgaagtagccaccaacaaagagatagaaaatgcaaaaggctctaaacaaacctgaattcataaacaccatggaaagaaaacctaacctgacttattatattgatttctaaacactttattaaaatgctaaaaatatattgcaaacggacaagagacacccctccctcccttctgcctcatgttcgtcgaggacaccagaggtggaggagggggccagaaggagccgcacgtaacgtcgctggtccttgatattcaaatatgagtgttataatggaattt

SEQ ID NO: 47148 - DNA, 1501 bp, Oryza sativa
agctagctaacgacgatgattatttagagtaacacacagattggttaattatatgagttgatgggtacttgtgtttgcattatgattttgattacatttatgtcacctcgtataataccggctgaattaatgaacaacttacgtataccgcaaatggggaaaagaaattgaatcagtacgtacgtagtgtttttctttggccacttgtaatcgctgttgcaaatagtttgtgatttccaatggaaggcagagccggtaaatggtcttaaaaaatcattacatattgtcaacgcaattataataagtgtaacgacggaaagaaagaagcatgtgatcgaacttgtgaagggtttcatatttgtatttgtattgtacacaacatataccaggatataactatacctatttaattgattttatcacactgaacacatgataaagcacgaaaatttaataggttacatatgcatgcttataataactaacaatttgactaaaatgatttgctaattactattaaatggttatatattatgatgaataaaagttttatgattatatttataacgctacacacactcgatgatataacggagggagtatatttgaatacctataaattttcataaaaaaacaagtggtcaaaatttaaacttgaatagtgttattaccaattattcgaaaacggagtgactatatatcatatatatgtatggaaaacggctcaacaacatcctaagcatgaaagcatccaaattttgctcggttacacatcaagtgatattataacatgtcattaataaagggcattatgcaactaatatcattttcaagctgggatgaaacttggtgtgatgggtcacgacctccttgtgcatgttaattttgtctctatataatcgagcaaagattatcttttttgagctaagaaagttccatgtcttatcgtttgacgcacagcagataccaacaagagttggagctccaaaacgacggcatgcatgttctgaaaggccatactacttttgattttgtgaggattcatctcacatgcacgcactagtttaaaaaaaaaattgaaacgaacatgtgtatgtgaaacacatgggttaatatatttcatcaaccttgaattttgaagtagaagaaaatggagttagatgatgtcaaactgcatgtgatctgtgccctgctttgtctcgacagtcaacaccaggagctgagctgtacaaattgggccgcacatttcatgggccgggccgggagaagctaaaaggcccatatgggcccacaaatgtgctgttccataaaaaaaataaatataaattacttgtaataataataaaaaaagaagaagaaaaagcgagataattaaaggataataaaatttggcggggagaagccacgaccgttcgccggcgttgcgtctcccgccgcggtgacctcacctctcttcctcgccgccggcggccgcgcgtccatcgcgtcgccgtcgccgcca

SEQ ID NO: 47149 - DNA, 215 bp, Oryza sativa
tgaaagattttctgcgcgtatctgttgcgttcagattgggggacgtcaagtacgagtcatgcaagtaattagcgaacttgaccggctaatcaatctaactaactaaacgagtcgctggtttctttcttgtggtaggagtttatcaattctttagtatattccatggagtggagagggaggctgcacgctgaaatgtggtcggtttttgattcagc

SEQ ID NO: 47150 - DNA, 1501 bp, Oryza sativa
aaaacaagtcagtagtattgtcttactacagaaaattatatagttttcaaactcaaacacaaaactgaataaaatacggaattttggttttcaaccgctctccatggagaaatttatttccaaattggcagtagtttttactcctagtcgctcaccgtcttggtcggtggagagggagaggtcgaagttcccggaggggttgaacgcgacacggagacgaaacccctcctccgccgccctcctcgcctgcgccgcgacgggccaccgcaacccagagtaccgacccaacgagccgctgccggggaaacgcctcagcgtcagacgttgcgagctggccactgggagttggagtgcggtggcggccatggcggcgacggcgacgcgatggacgcgcggccgccggcggcgaggaagagaggtgaggtcaccgcggcgggagacgcaacgccggcgaacggtcgtggcttctccccgccaaattttattatcctttaattatctcgctttttcttcttctttttttattattattacaagtaatttatatttattttttttatggaacagcacatttgtgggcccatatgggccttttagcttctcccggcccggcccatgaaatgtgcggcccaatttgtacagctcagctcctggtgttgactgtcgagacaaagcagggcacagatcacatgcagtttgacatcatctaactccattttcttctacttcaaaattcaaggttgatgaaatatattaacccatgtgtttcacatacacatgttcgtttcaattttttttttaaactagtgcgtgcatgtgagatgaatcctcacaaaatcaaaagtagtatggcctttcagaacatgcatgccgtcgttttggagctccaactcttgttggtatctgctgtgcgtcaaacgataagacatggaactttcttagctcaaaaaagataatctttgctcgattatatagagacaaaattaacatgcacaaggaggtcgtgacccatcacaccaagtttcatcccagcttgaaaatgatattagttgcataatgccctttattaatgacatgttataatatcacttgatgtgtaaccgagcaaaatttggatgctttcatgcttaggatgttgttgagccgttttccatacatatatatgatatatagtcactccgttttcgaataattggtaataacactattcaagtttaaattttgaccacttgtttttttatgaaaatttataggtattcaaatatactccctccgttatatcatcgagtgtgtgtagcgttataaatataatcataaaacttttattcatcataatatataaccatttaatagtaattagcaaatcattttagtcaaattgttagttattataagcatgcatatgtaacctattaaattttcgtgctttatcatgtgttcagtgtgataaaatcaattaaataggtatagttatatcctggtatatgttgtgtacaataca

SEQ ID NO: 47151 - DNA, 772 bp, Oryza sativa
aacgtaatcgccagccgcccttccgttccttggcctccacgcccgtcctttctgaaatgttgactttcttctctctctgccgctctgcgttccttcaacgcaagcaaccacgcatcaggtcaaccgacagcatctactggtactagcagcctagcagtacaaagcttcgaaattcttgggccaatccagctgtgctctgcatcccgttgacccgttgaccgctgaatcaaaaaccgaccacatttcagcgtgcagcctccctctccactccatggaatatactaaagaattgataaactcctaccacaagaaagaaaccagcgactcgtttagttagttagattgattagccggtcaagttcgctaattacttgcatgactcgtacttgacgtcccccaatctgaacgcaacagatacgcgcagaaaatctttcactatagcgactttattctgtacgaaatttcactaatcatttctgcagatctgaattaacgtacgggaggcttttggttaaatttccatccacggatcgaattaataaagaacaaagaaattgttgacacaatgttctactaatgctagtagtaataatgaacaacatgttgagatttgacgaagagatgagatgcactctactatgaacagtacaaaaatctccggcgagaaacaggggcatacaaggattcaaaattgccattggttgagatcgtaggaggcgtgacggattcgcggtttgtgctcatggcgacgaggcggcggcggcggcggaca

SEQ ID NO: 47152 - DNA, 367 bp, Oryza sativa
accaccccgcggccggcttgccgatcttcaccttgtacaccacctcctcgaactgcaccaattatcacaaaaaaaaaagcatggtcacgtctcatcaccaacctccctcatgcacatatgtcaacatgctcatgcacgtagctctacaagtacgtacgtacgtacatacatacatacccctccgtcccaaaaaaagatcaacctagattcgtaactaggaattcattttttttgacagagtagtatatatgtatatatacacaaatgtgtacttgtctactcaccttgaggacaagagggtaagagttggcggcggagtggtggccggaggcgacggaggggtgacttgaggtagtggggtggacga

SEQ ID NO: 47153 - DNA, 1501 bp, Oryza sativa
tttgtgtatgaacaagtaacaaagtgtcaaccagcccccaatcgccctgggatcggatctggagaaggccttgtgtccaaaaatcctctctctatctaagtgggcaaggtcctccttttatatctcaaggggataccacatgcccctctccctctccaaactggactatgcttctcttcataaatggacggagatcggtacggttgctgtccgggtgcccttctgacgggacggcccatatctacccccacttccgccggaaacaggtgcgacgtgggattatggtgtctgttgatgacgcgaccagtgtcagaccgtcacagatcagtcatccttgtccaccacgtgtcagcttagcaacgtgcatttttgcccttcttcatatagcatcttgcctgtaatggttgggatgaagcctggtataaatctaaccagggctaacgtgccatctctaagagattacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactacgctgcatgcagcgtgacacgttcgaccagaccgcaataaatgtagttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaatcatgcacatcggtaatggtgacttggctgtccataatgggcggtctcttcaagactgccacatcacttgagcggcgtacgaatctgggtgaaccgatttgcttcgcctggagatatggtaacgtcgcttcggtcagcgagcgtaattaacgcgcgcacgatacgatctatctcgactgccacaaccgcatatccacctcatgcgccgcaagcgggcgaatgggattagtggaaacgtgggcacgagaaacgagggagcgagatagtgagaaacgagggagcgagatagtgggcgcgagaaacgaggagccgggcacagcgatggcaagggtataaagacaccgaggaaaggatttgctcccttcctttcgccattattccccttgccttcgctgcttgagccctaactctttctctgctgcgcctttccttcgccacacgcgctcgttctcaatcatcccttcctccggcgcca

SEQ ID NO: 47154 - DNA, 371 bp, Oryza sativa
acatgtatagcctatagctactcatcagatgctaagcttacaagaccctgaggtcaccaaagtacacgtctaccagtctagtactggcagtggcattgcgcagtgatactatatatggatattcagttgggccttggcattaacacagaaaagcagactcataaaatatgatcacgtgatccttactgcaagcatattgcagtactctatatttgttgaaacaaataacatgctgtataattagaataccagtaaagagctgcttaggctttattttgtactttgaaggcactttgtatagccttcacttcagtaagtgctgttctccataccacaatagcacaagaagaattgcttactattaaaaaaac

SEQ ID NO: 47155 - DNA, 1501 bp, Oryza sativa
tcttccacgtcgttgtcgttaatttgttgcccctgtaaccctattcattattgtcttttgtcgacaacgccacccattcatccgcttgtgccgcaactatgtatgctaactcggctgggggacctccttcaccatccctgactcgatttctttcattccatcgtgccacaaaagcagcatcaccttcgtcttctctgtttctcgtatttcacacaaatggtctccatgactcctttttccttttgactgtagcgcaagatttcctccaagtgattgaaggttcagagtttgccatgctagcttcacatgtttacatttggagaacaggtggatggcatcttgattgaatatgttatataaaagttataatatagtcatagtgtagttacggtgtaattgaattataattgtggcgcaattcctgggcttggcccttttcttcttttttttttgttgggcggggggggggggggggggaataagtccacccacgtgaatattcttctttttttttggcgaaactagaggtgatcataggcggattgtaggtccccggacaaccaaaaaattcccgcccaaggcccatcaaggtatagattttgtaaaaaaaaaaataaagagaaaaggaaagtacttcctccattacaaaatataagttaagttggtacgagatttaacatatcccagtactatgaatcttgacaggtattgttgatacttatagtgctaagatatgccacatcccgtactagctagtgtttacacccaaatttggcacctaggttcaaaataaggaaatttgtcaagatttgggaaagtcatcgatttcccccacagggccggtctgaccgctgagtatgggccggttagaccgcagcttaagggccggtcggaccggcggcatgtggccggtctgaccggcgacatgtggctggtcagactggcagagtccgagcctgagtctgttttcgtcgggtcttggatttccttgctcgaaaatgtatgtttcgggtttcctttggtttctactccgagttggacatggaggaggacctgtaggaggaaagaccaacctctatataagggacaaggccggttcaattgtaatatacaacccacaatctacatacaagctattgaatcgcttttttaaatattgcatctacttttcacatgtttctagtttagttcgtccatctttgtcgatttgcaccgtaaattgtccaccttcgctgcgacagtgcgaaatcctttgtgggtttgtcccgtaaacctttcatttgcacacgagacgggtagttatccatcattctatctaaattggcttcgttagccggtttaatttatcaaaacccatcttggtctagctttttgctaggttggggtggttggcgactccatatcaccgcaaggcgtttaggtgcctcgatcgtgattgtcttcttaccaaaaaaagataccaacagctaggttaacttgttttgggacagagggcgtaaga

SEQ ID NO: 47156 - DNA, 1501 bp, Oryza sativa
acatttgcttctgaggacagtgagaaaagacaaacaaaataaacaaccctagcttgcatatctcttatctatacttatagcccactaactctaaagcttaacatgcaaccataccacatcatcacccactaaccataattacatattcaacctcatgcaagcatgcaagagcatctacaatctatttaattctacaaattaacatgtgtcggtgatatgggaccgggagtatcgtgaccagaggcttgaggcagacacaatcgtccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccaccatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctatatgaagaagggcaaaaatgcacgttgctaagctgacacgtggtggacaaggatgactgatctgtgaccggtctgacactggtcgcgtcatcaacagacagccataatcccacgtcgcacctgtttccggcggaagtgggggtagatatgggccgtcccgtcagaagggcacccggacagcaaccgtaccgatctccgtccatttatgaagagaagaatagtccagtttggagagggagaggggcatgtggtatccccttgagatataaaaggaggaccttgcccacttagatagagagaggatttttggacacaaggccttctccagatccgatcccagggcgattgggggctggttgacactttgttacttgttcatacacaaatccactagaacacaggagtagggtattacgcttcccagcggcccgaacctgtatacatcacccgtgtctcgcgtttcttcctagctggcgatctttccacataccgaacaaatccaccaaaacacaggagtagggtattacgcttcccagcggcccgaacctgtatacatcacccgtgtctcgcgtttcttcctagctggcgatcttttcacataccgagagagcttgagatttcaccctaagcccccggccgaaccggcaaaggggggcctgtgcggtctcccggtgaggagccacgagctccgtcatctggcgcgctaggtagggggctcagcgtgtgttttctgagctctcgtactcctccgtgtgcgccaagtttttcttgttcagcctaa

SEQ ID NO: 47157 - DNA, 403 bp, Oryza sativa
ttcctttttttttcatagtcctcaatagatcatctcttaataatctattttgccacacctctattacacatgtgacatgccaacttgcaaagcaatgttggtacttttgggtgtcgttcactcgttcccaatattatttatctcgactccttttgtttcctaggtctagctagctagctaggttttcttttttgaaattgaacacactttcagctagtatacatccgttctgttttactccatccattctaatataagtgcagttgtgggtttctgtgtccaatgtttaaccgttcgtcttatttaaaacatttatgaaaaaattaaaaaaattattcacacataaaatgctattcatattttatcatctaataacaataataatatcaatcattcaataaga

SEQ ID NO: 47158 - DNA, 218 bp, Oryza sativa
ctcgtctcgccgtcgtcatcgccctccgtcgctcgccgtcgtcgatcgtcctcggtgattctccctctctcccgcgctgcttagccgccgcactgccgcctagtcgcttagccaccgctatcgccgctcgcgtcgccgcgacgccgccgccctccgccgccggccggtcgccgccggtcgccgcctcgcgtcgccgctgcgtgcgcgcccctccgcca

SEQ ID NO: 47159 - DNA, 246 bp, Oryza sativa
ctatgtattttttttagataatagaatttatttcgtctttagcttcaaaaaaggtacaacaaactgtttcagatgttgtagttcgaactactgcagattataatatcatatcttcattaaaaacaagaaaactaccaacacctattgctaaacctatatctatagttgacgaaaatgtacataaccattgtttctgcgtagaggcttgcaagttgcatgtagtccttgtctttatcaaaaaccagg

SEQ ID NO: 47160 - DNA, 1501 bp, Oryza sativa
agtcttgcaatcacttctgaaatgatgaattagttagctaaggttgtgttcggcattgcctgtttccatcctcgtttttcgcgcgcacgcttcccaaactgctaaacagtgtattttttaaaatattttctataggaaagttgctttaaaaactcatagtaacccattttttaagtttattttagttaatacttaattaatcgtgcactaatccatcgctcggttttccgtgcaggaggtgagggttcccaaccctcacccaataacatagcctaagtcattttagaagtcctatatagctatgcagctgttctatatagtttgtctcatctacaactaatggtgtaattaatggctagattatacgggttaatcacccttagaagaagagaggggaggggaggtcgcataagggttggggaggggggtgctggtcctccccggcccccacggtggcttcgccactgcctaagcaaagcatggacattagcacataactctagaacaatagtaggagatgattcctcctacgaaatataaaagggacttgatagagaggaagagaataatgaaaagttatgtgtttcgtactacgtctaattctcatagtaaacgtctaattctcatagtaaacaatttctagatgattttttatgctcatgggagtgtaaataataaaatattactccctccgtctaaaaaaacccaacatatcacttcgatgggacataatctagcacaacgaatctggacagactgcctgtccagatacattatactagattatatcatatcaaagtaatagttgggttttttttagatggagggagtatttgtaactcgttccatcgctttcactaattttggttatgtaaatcgttttcgctctaaacattctgataaaaccaaacggtggaccccagaaatattaactactcaaaaccaccctaaactctcaaaatatttcttgatagaggaacatcaaaatagaagagataaaggacatctacaccgattgtagcacagcacagctaagagcaaggtcaatagtatagcccgctgttggctccaaaaaatagccatgtcatctatagtaagcagtatagctaatgtctacaatagaaatactataacacaaatattttattgtttcatgggacccaccatcttctcctacctcccattctctctctctttctcccatccgttgttccgttcatgtcttctgttctttgtttggttcttgagcaacagagatggcgggcggggggaaaacagcggcagcggacacaggagaccgggcggcggcgggcggaagagggcggcggccgtgcggcgggcgtcggagacggcggcggccgggccgagcggcggaggcggaagaggacggcgggcatcggagatggtggcggctgggccgcaggacgaaggtggccatgcgtcagcgccggcgagggcggtggtccggtggccgcgggagttggcgacggaggcaggcagc

SEQ ID NO: 47161 - DNA, 443 bp, Oryza sativa
atctgtttcaaatacatctcattttagccttctaattttgtttttaaacacagaacattctattattttcttgagaattttaacttgagccccatccttgcttatacccttcccatatttgatcactgccattttcctttattacttcatacattagttcctgcactagagtctaaaatggcatctacttttgagtggtatggactatattatactgtggcactgaatactttgtaacatatgtttcaaaatgttctagatgttaatgagtcaattaattgccttgaactgctgtgaaatacaatattaccaaaaatagattgaatcttttgatgttagctcttagttttgaaacaccatacagaatttgttaattacatctgcttatgagaactttgttcagtaaaaaataataatagtgcatctgaccatctgtcctaagt

SEQ ID NO: 47162 - DNA, 1501 bp, Oryza sativa
caattaatgtgagacaaaaataatacttatagcttatctgagaaataagaacaaaatccttatcgacaagttataagagtacttttgtctcacattatggatggccaattagccagttggccttcattttattttgagactgtcacacgttgataagcataaagtgtcaggagacccatgccgttctcttgtttactgatgagaagtgtattatataagtgcaaacctatagctagtgtgcaacgcgtgcgtttttgtggtttcaaattgcaggcacatccccgtggttgtacgtgttcctgaatttatatattcacacaggcagctgaagtcctgatatacatatagtttatttgatcaacagcttggctcctcggaactgaccatgcgtcaacaggcagggcccgtgatgccagtgacgtacgcaggatttattaattgagtatacattcaacaattatataattacatactccctccgtttcattaaaaaaactaatgtagctagtaattaatgtaacacatcctaacactacgaatttggacataattttgtctagattcgttgtattaggatatgcgccactggtggagaaatcatctttcgtcggtcgggcgaattccacaatagttccggttgcaataaaaaccggaacttggcgatttgatcatctttagtcccgattaaaaagggtaacatgcatatttgatcatctttagtctcggttcaaatgctgtcagggcttgtcaggccccccgggatctttagtcccggtttgtaacaccaaccgggaataaagatcgtaactttagtcccggttggtgttaccaaccggggctaaagatcccggcgatctttagccccggttcataacaccaaccgggactaaagttccacccctttatatatgtctttttcctccttcagcccgagcaagcttcaaaatttcttcaaaaaagaggggaggtcatgccaaaatttctagtgaatttattttggtgattatatacaaatcagaggtgcctaaaaggttagcaacttcatcctccaatgttttttttgtcatattacatttggagctatgttttgctcacttttttgtctccaaaattttgttgttagttgatgagagagaaaatttgtgtgggaaagaaagaatatatagaaattttgttaatttgctaaagaaggttttataaaatagttgagaaggaaaatatagtgaaagttaatcttaaataatagaaaacaaactaaattgaaaaccaaaagaagtacaacacattaatattagtttaaaagttcaaaaataataaataagaattatttggtggaatattttataatttttgtatgaataatgatatgtcattattgtatgacctttggaagagtttgtgattattttattattattgtatgactgtcattattgtacgaataattatttgtgtacgattttttttttcatttcatgtagatggatgggcaatgaatgac

SEQ ID NO: 47163 - DNA, 242 bp, Oryza sativa
tgtagtagttctcttctcaatcaagttgaatttaaactactccaacaaaaaatgcaattttgggaaccactagtctatcatatcacgaagaggtgacctaagaagaaaccaatgccaacaaaatgtaactttgataaccactagtctattagatcaagaaaggatggtttaagacaaagctttactctgccttccaaattatgcattgtccctgacttagaaatgagcagtggattaatttg

SEQ ID NO: 47164 - DNA, 1501 bp, Oryza sativa
ctaaacgacgtctccaaggagataagcgacggaaaaccgccgtcgctgtccgtcggggactcaaaagagccaagattgggcttttgcccgacaaacacccttgagggatgagacggcacgacaacgcccttaggagggggaaaccattgttgtcggtccgggcaaggccgggctaggttttcactcgccgctcacctccaagtccacggctgatgcaccgatgctccaccactgctcaacctctgccgacatgtgggaccactgcaccggcgcctcccgctggccaaccttcgtgcgccgaagaccgcgtcacaccccccgcagctcctcctcacatcgtggtcgcctcctttaccgccggccgtgcctcatcgcgccgcgccgtcctcctccaccaccggatgagcctctcgcgccagtccggtttcctgccatcggctgtgcctctcacgccatgccggcctccttgccaccggccatgcctctcgcgccttgccgacctccactgccaacagccgtgcctctctacgccaagccggcctccgacccctccaatcactgccgcaccggccaggtgcggccgtctgccacgcccccggctagccttccgagaccgccatgcctcaccaccattgcagccactactgccgatggccacctcgccgctaccgcgaccgtcgccacgagctccgcgccgttgtcgccgccgtgagtgcgccccgttgccacagcagccggcagtgccgtctaccaaccactgtgctgtcgccatcgtccagccgctaccaccaccttcgccacgagctccacgccgttgccactgtcgttgtcgcgacgtgctcgacgccatcgccgccgacgccgtcgccgcgagtcccgtagccccaccaccgccgtgagcttgccccgcactggatcggccctcgggggggggggtgtccgcctccggagcgaccgagccctgcccgccgttaccatcctcgccgccgccttccatccccgccgccaccaccgccaatcgccaccgcctcaccacgctgacccatcgccggcggtctccctgccagatccggtcatgatggcctcgaactgggcggccttcgccgtcccgtgcggcccccacccctggcgggagggagagacgagacgaagcccctccatcaccatccttgcggccgtgcggctttgccggcggccgctcgggcggcggcgaggcggaggaggaaggagggggggagcgggcgacggtggtggtttccacctcctgtgtcttccgtgagggaggacgacgcgggggcgaagaactgataatggacatttcttaattcgaacaataatgatatcaacggcatttcggtgccttgtgtttaataccctgatagataaacttctattaaaagcaatcccttccttccagcaatcaatgccagggtgaatacgtgttgtttattggctagctaataatctagtgctataattagcgcaccaataaaagccagaa

SEQ ID NO: 47165 - DNA, 1501 bp, Oryza sativa
ccgccggcgctgcgggcgggagcctcggcgagccggcgctgcgcggtggcgcgaacctggcggtgaccgtgaagtccggctcgaggcagccgtcgtcgaagttctgcgcgtagctgagcgggtcgtagttgagccccccggcgccgaggatggagcggccgccgccgcctccgccgtgccgccgcctccgccgcgccacgctgagctgacgcagcctgtgccacagcgccgcgagcccgagccggccccagcacgacgacgccatcgccggcgctcccccgccgcgcgccgtcgtcgtccgtcgcccgtacgacgacgcgtccacgtccgcctccccgtggtcccctccctcctccgccatcgtcgccggcagcctccccggcgatgcccacatggcagacaggaggcacgcgacgcgagagcgcgagaggtttgtgcgtgatgcgtgtgctggctttggtttttctctcgggtagatgaggcgcgtggagggagaggtggcgagccgttggatgcgagagggggacggcggagatggggacgtgggggaggtggtcccctttgccccgcgggcaaatgtggcacgtcgcatcgtgccaggcgggatctcggctgacgtgggcgtcgcttgctcgcatggcgacggttgggcacatcattttcaggttctcggtacaagcaacgtgttgctcgttgccgtgttcaatcgtatggttttctcttctttttttttttcagggcaatcgtatggttttcgatccaacaatcaaaattataaatactgaccacggtaacactacgtgtatagaataaaaagaaaggttcagatagatgaggatgaaaaagataaaagtgcaaggcaagaaatttctgtttaagtaactaactgaacgggatcatcttattacaaatataattcttttatataaaatttaaatgatagaaatacaattattacggaatagaatgtagtagttttcttaaaaagaaaattcaattaatatccagtaaccagtttgatctgctactccctccgtcccaaaaaataagacatatccatccaaaattacttatattttggggcggagacatcataagatttgttctatggattgttaggctgtgttcctctctacactttcatatcctctacttcctcgtttttcatccacacgttacccatacggctaaacggtatgttttgtcaaaaacattctataagaaagttgctttaaaaaattatattaatccatttttcccacttatttagctaacactccctccgtcccgctcattaaggcgcacacattttaaaattcaactctttaaatatttaaccaataaatattttattataaattaaattttatgtaatgaaaataatatcattggattatcatttacattcacttttactatatgattaagattttgttatgaaattggcagcttgctcgttcgttaaaaaatatgattttgttactacaaacattatagtata

SEQ ID NO: 47166 - DNA, 926 bp, Oryza sativa
tttagagaagggtattttttacccggcctctacatccaaccggatatatgcggccattgtaatttggaacttagccccacaaacaacccaatctgaaattcgctccataggagatttgaactcaggaccttgggtactaggagattcgctccataggaaattaagttcttagattagatcagtcttacaaaggcagcttctctcatgcgccattatcctcgacattttcttgaatgaaatatgcttttagttatttcgaaaaaaaagtgtttctaggtattagtttcttccatcttcttccatgactgagactgaatctataagatcagaatatatgataacttgaataatatcccaaactagagcaatctactagtacttcataacttgaactccagatcgctttagagcaatctgctgtggtattgattgacaacaagcatagttagtaattatgacaacaagcatgttcttcttcttctcttccttttcccatgagaagaagcctaactatcgaatagcaaaacgtaagacgctgttcttccttttcccatgtttgttggatggtttggaaggaaagaaatgcgcgtgtgtttcagaaccagcggcgctcagccggtttcctgtttggttcaatcaaagaggaagtggcgatttggaaggaagctggggttttcagaaatataggagagtagtcccttagtgtaatcttttgcttttgggaggttgctccggtgacaacttccattacttcgacagcttcttgttgaagttataactttgtatatttgtatatattcttcaatcttaagtaaatttggttggcctttcttggccggcccggcaatttattcatctcattaccctttgatgttggatagacagaatataagtgagcaggaaccactgactatgcaattgtttca

SEQ ID NO: 47167 - DNA, 187 bp, Oryza sativa
ggttcccgtggactcgatagggttcggaaactaattctccaaccccgcgtaacattcgtgacgcctccgacccctctttcctccgcatcgttgcacattctcgatccaacggctcgatcgtgtgaacccaacttggggagggggttcggagaattattcttcaacctggtgtgacctcccgctaagc

SEQ ID NO: 47168 - DNA, 277 bp, Oryza sativa
gtagttttttctagactaatcatggattttagtttttattaaaattacgccaaaacatgtagatatatagtacatgtggtgacgctatattcgtatttcatatgaagttaattttataatatattgatataaactatcaaagaaattaatgatcaaagttatcaaaggccatgtcaaaaactaaaatgacttatattcctcatcgaagggagtgcatactacgtaatcatgtacttcactgtatggtctttctttctttgcaaatccatataactta

SEQ ID NO: 47169 - DNA, 316 bp, Oryza sativa
catcttgtgaagaatggagaatagaattcatgcactgaccccaaagattttagccactacaccatgccaggttcaatggacaccctgttcaaatcatgtctgctatttgatattattcaaacttatttaaaaaggtcatcataaaaattatcaatttattcacattgctatctgacaagaaaaaaaagtaaattaacttatctgtaatcagtaatcccgtagagatggcagatcgagttattgttccttaatctacatttgcttactatgagtccataggagttgttgatcgacatttttcttctacatatgcagg

SEQ ID NO: 47170 - DNA, 1501 bp, Oryza sativa
gttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctgaaaactggctatggctgtgtttagtccttgcaagatttgtgtctgaactgccattaagtgttgcatgttggtttccacatgaggtggggaagggaggcgttcttctccagaattgtgactggcagtgcggtgagagcggtgagactgtcccatctctgcatcacgggaaactgtgcgatgcgagcggctgctgtggcggggttgctcaacctctgcattgcgggaaacagtacgatgcgaatggttgctgtggtgagactgctcattagctgatccatgattttcttctggctcaactctaccatcctcaaaaccaaagcgggctggtgcacgagctgcacggcgggggcggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtaggggagctgggtagtggaaacggaacacagtggcagaaccaacaacacgcttccgcgcagtgcggataaagcgtgggccacggcgggaggaagcaactggggtgtgtcctggggtgtaggaagggctaactgggtgtgggtagggcgagtacactggtgagtacggcgcacgcgagttgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtatggacaagggtacctggcgtctgagtggccagaaggaaggcgtggaagctgccggaaggaggagcctccgagacggtggctgtagtcgtgggccaggcgacgaagcgcagtccaggaga

SEQ ID NO: 47171 - DNA, 342 bp, Oryza sativa
atgcgccggaagcgggcggcgacgagcgccgccctgagggtgcgcatggccgggacgaggccgccgatgagggcgttgtccgccgtgttgatgatctcgttgccgacggccacgagggagatgtccgtcgccgggtagtacggcgcgatgttcgccgccacccaggcggcggcgccgtccttggtgcccagcgtcgggatgtcgccgtttccggcggtgaccatgaccgtgatgcccgtgccggcgaaggccttgacgatgtccgggttggtgtcgaacagcttcacccggtcgatgcgggtgcggttcgcgaggaacttcgccacggtggccggcggcggc

SEQ ID NO: 47172 - DNA, 1501 bp, Oryza sativa
catctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgcatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaaatgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaataagtccaaattggagatataatcctcacgcttgagttgatgagcccctgagcatatagcttgtccttctgtcgtagtcacaattgtccattgatggtagctgacgcagttggcatatagacaagacgaccaatatagagataatattgcccaccagaggtggcaacaatactggtggtagtgaagatagtgataccaatcaaaagtaatgaagtcgcatagccatggaggcgaagaaaccagtcggcggcagacagatcaactacaatgaagatgaaggagcccagcgataaaattgtgtagccatggcagcaaaataatcagtcggtgacagacgaggtagatcaaaggtgatgacaaaatccaccaatca

SEQ ID NO: 47173 - DNA, 1501 bp, Oryza sativa
tgtggtgctctgtggcgatgatggcatggtgccgacgtacttgttcgtgttgtgatgatgtaggttgtccaggcgacacttgactagtgcttggtgaccgcaaggcagctgggcagactagttccatcctttttctccactcacagcagaatagaggagcctttttggtggctgcaatggcagtgagtaggcgtggcggtggaagggcgagctagctcagcatttccttgaagtttgctagctcagcatttccttgaagtttgaagcaatgagaaaaagcttgcaacttagacttttagtttttttctttaggttgtttgttttttttatctcggttatgagattagtagtgtatgcactcgtgtaacctttggctgcatatatccatttgtggatatagaggccagatttagcttagccgttaaaagctatttttaataaagagtaaaatacatggagggtcatctaaattgtttaggtgtgtcatataggtcactctacttctaaaatacacatctggatcaccaatgtgaattaagtgagtcatttagctatctaactattctcatgagcacatctcgtacatattgcgtgccacatatgattgaaaaaattgtttgggcatccgtagccgctgcctcttaggatttaacctgctttgctatttaagtttgtcatcgctgccgcttaggagtatgtttccgtcgctctttatattcatgacttgttgcctctgttgctaggttttatgacaagcgagagagaggattgagaactagaagaactcataaaaaaagcacaagtgaaataatttggcttctctaattttgtgtattttcaagtgctagtgctgtgagaaagggaaaaaattcacacgcgattttctgcacatgtccgggagcaattttttcaattataggtggtataccagatctacagggtttgctcatgtggatggttagatgggaaaatgactctcttaactcattagtaatctagatgtgcattttgaaattagagtgatctacctcatacacctaaataagttaagtgaccctccatgcattttactcttcaataaaaatcctaaatttcaaaattttggtattttgtgcgtacgtagggtctagtagactagtagcaagatctgaattaaaagtcattccttgtgacccaaaacctacatccaaaatgtatatctgaagtaaactctcgagattcggttcccttcctaaaaatttcaaaaccctgatgtaaaatttcctacaaagctttcctttgaccttcattcaaatcttcaccaatccatttaaatccttcaaattacccaagaatgagagcttcccttgaactctacccggagaattcaaatattaattttgagtttggaacacttctaagatcctttccttcatctatctacattttttctccagatcatctaaaattatccaaaaaatcctctcataatcccaatcaagcgttatccattgaaattcct

SEQ ID NO: 47174 - DNA, 1501 bp, Oryza sativa
cggtcgacgactgtggaccaacgacgaggactaggtgcttttattctgtattagctacagtttgttagtaactagtaaaacataagttttagttaagtgagcccaaattcttgattataatttgatgccatgcaatatggtttgcgattattctactcaagtatgggaatgggaataagaaagatagcaggcgacatagcaatgcggagtaaaagggaaagagagaattccattgcatgtagcagaggagcgtccgataattgttcgtttgatcgggcacctgtcgtagagcattctcaaaagtattcttctgatcccatggtagaattggcgccaactctcaccacctctcagcattttccctccaaaaggcatcggttgggagttagagggtaggtgaaaagttggggaaaattgagcaagaatctagaccatcccttatttgccggatggttggatgattggtactgccaaagttgcagtgactaaacctgatccgaatccttacttgaagagataatcctctatgtacccatgagaatttgttcaatcccttgtgtgtcctaaaatttgccttatcccttatatacccctgagtttttattttgatctcctctatgtccattctgttagttggccatgagttgaccattgaatgttttataaatagactttattacccctctcttatacttatgtgctagtttagtgataaaaacacaattcttatataaaaataaatctaaaatatttaaataaattttaaattaaattttatgaaattcgtacattgttttcatcaaactttgaacccaataaataaataattttggttcataatttctagctaaaactcttatatggattttgtcaaaaaaaataaatttgttcaaaaaaataaattttattttttgaattttacaataaataattaggccccgtttgattttatcatgaagtacaatttttgacgttgtgaattatgaagtagattgtcgacgggggatacccatagaccggatatagtgggtattggggtacgctggtacgaggatctacataatacgacatcaagcagacaaaaagcacagattatactggttcaggccccttgataggtaatagccctaatccagttgatatggtattatatgatggaaatcataggttacaaggggaacaatggaactcgatgataccagcgagatcgtaattgagttggttcgactaattctccaggtgacagggagtaatcgacaacaccgtgtgaagcccaacggtcatgagtgaatttaaattgaagttcgaaaaactgccgcgcgtaacggacccagaaatttccggcggccatctctttctcctttccttggaattcgcaccgtcagaaatgtatctatttaagaggattttggggatccaatttgaagtccgcctgttgtgaaaaagctcttcagcctccaagcgttcctcgtcttctccgctcccgccaaaccctagcttg

SEQ ID NO: 47175 - DNA, 1501 bp, Oryza sativa
gtgatagaaaataactgaagtttggatctaaactttaaatttaaacacagccttttttcctctctcttaattcttcgtctccattgagatttgagcatggctttccaaaaagctgaaattgataaccaactgatcgatcaactcagattataacctcgagcaaacccatccatgcaatgatgcaacaaacactactcagcctcgcgatcgttgccgccgaggccgcgcccagggaaggtgagctcgtcgatcgactcgatcgtcgtcgtgttcattgttgtccacgtccaggcgctggagacgccctcgtgttcttcacgggtgacgatcgaaaggcgtggcataatcctttccgttcctctggccggacagaagctagctacatgcatacctgaccaacttaccaaaatgtttgaggtgagattaccaccatctcacagtttgacagttaacgtgataactacaaggtatattatgattttaaaaattaaaaatgttagcgtacgtgataatcacgatgacctcacgatattataaaccctgctgccaacccacttcgctttggatcggaacacagcgcgcccgacacaatccaaccaaatcgccatggtcgccggctcgccgcagcgtaaatgttcgttttctgtcggggcaagcggccgggggagcggctgttgcgacgtgtgatctggaccgataccaaatgcttttacatgggccttgataggctaggctcgcggaatcgccagtattgggctgcacaaaaaggcccactataactagttaggatcagagaattaggcgacctttgaaagaaaaaaaaactggggataaacgaaccttgtttctatacgaaggttgatttcggcggttagatctaagctccgacttgctaagatgatcgacaaattgggtcacctttcaacagacagaaaaatgagttatgtgatccaaacgaagacgacgtacacaatgccatttggctatgtagcattccctccgttcttaaaaaaaaaaaaaggcaacaacgtattggaggcgatatttttttttagtacaacgtattggaggtgatattttctagtacaacgtattagagatgatattttctagtctatccagattcgttgtattagaaaatatcacatccaatactatgttgtttttttaagtactatgaggcaaacatcgcatattcacgcacgggcggctgccgctccgttcctgcagcaagatcccatcacagtgcggcaattcccaagcagccatatgtgtctgtttcgctccgtttttgttcattaacccggtcttcaaattgccaattttaccgtagctccaagcctccaatcctcgcatattgtcacggcctgaagaccaggcaaaagccggccagcttaatctgacaaagcgcttagctttataaaatggccgccaatttgtgcaaatgctgcagagctcagaagtcgtatcagaacgaaacccgccatggatggcttcaagc

SEQ ID NO: 47176 - DNA, 1501 bp, Oryza sativa
ataaataaaatgcaattaaccaaacaacctttgcatttagcagcttgattgtcttgatcccatgcgaaggaaaaaaaacatgcgcatgtatcttatttctattttctcttaacatatttaggcagtaaaacattaaaatcgtaattatattctatatgacaacggagtccagcatcataccattatatttatttctaaatgtgtgcattataacttgtcacatgttgtgagtatttccttattttatgattttctctaattcattatagtgtcatgtaatggttaggagcatttctaggatgcctaacaatagtttaggagtgttcgtaagatgtttgatggacttaaactttcctatgtttatttgcttggtaacggtaggataggaaattttccttcaaaattactatgacctattcgtgcaaaccaaattaaggatagtatagtcatgcaatcaataggaatcctaatcgcacactgttgtttgtttttcatataattcaaaggagctttgaattttaattgtaaatcccaaatatagctttgagctgaattcagattttttttaatggtgtattgttttcggatttcacaaagaaaactaaacaaaagagagggacgtggggcctgcgtgagtacgtacataccgtacctatgtgcatctagatgttgagacttttaaagataaatttaatggtacttttctaagatagatctaatggacggaaacaatgggtctaccagaataaataaaaacaacggttagatttttttctttgaatttctgggatttattataacgccacgtgacggtttaggagcgtttgtaggagtactacatcacagcttgagagcgtttataggaagtttatcataggaagtttgtaggaaaatgcgagtgcggacatctatttatttctaaatgttaaaatcttttatggttggtatcaatacttgcctatcattcgttgatgtttgcccacttttgtcctttatcggtacttgataatgcacgtgaccattaaatgccatctaataattggcgcgctatgtacggatgcctcataatgtaacttgacgattggtggatagtagtttttatatgaaacttatatacatagggattagtagggatatacgattgatatatttgactattcctgattgacatgatattttatatactatatatttagtaataaatttaagattgagttctaaagtatttatcagattggctactccctcatttatggtgagcatgtttcctaaactattgtgcaaagtattctaaaatatcaaataaatccatattcgagtttataatatttaatacttaattagtcttacactgatgatatgctttgtttcgcgtgtccgaggtaagctcatccaatgagctagaacgaatgaagcctaagagataaaaggacatccacatggtgtcaaaaaaaatatatgatcattaattttctaaaaatacatgactaaagaaacatat

SEQ ID NO: 47177 - DNA, 344 bp, Oryza sativa
aaatacgcagcaatgttcataaatttttgactgaacgtagtgatgcagaaggcaaatgttaagttcttatgcttctgaaagcgttctatcatccatgtgaatgttgcacgatatggtatatctagtctcaatccttttcgagtagtactctactatgtacttgcccataagaattatttccataacctcatgccgattttcttatcgtatatggagctttaccgtacatactggcatattctatattccacgactcgtacaccacccgtagtagaattttcagtatatgtcatcctattcgcagcactttcagctgttgccacttaattcgtaacaccttcaga

SEQ ID NO: 47178 - DNA, 228 bp, Oryza sativa
cagagtgcaacaacattgcgaagaacatgcaacctcttctccatggagcttaatcaaatcgacacacatcttctccatggagtgaatcccaaatttgtttctcagagtgcaacaacattgcgaagaacatgcaacaccctgcttgatcaaatcgacacttttgtggtcacttcagctcaagagtattttgtaaataaactctttgttggtattttttaacgtcacaga

SEQ ID NO: 47179 - DNA, 1501 bp, Oryza sativa
tcgatttcttcgtgggcagacctgtggcagcagttcgtcgtcaacttccaaggaacttacaagcgccacgctatcaaagacgacctacatgcgttgacacaaaacccaggtgaatccttgagagattatgttcagcgctttaatgagtgcagaaatacaatccccgaaatcaccgacgcttctgtaatccgcgctttcaagtccggtgccagagatcgctatactacccaggagttggcaacgaggcgcatcacaactacttggagattattcgagattgtcgatcgatgcgcccacgcagatgacgcactgagacgcaagaacgacaagccgaagaccgcaggagagaagaaaccagccaaggacgcacctgagtcaagcaaaaagaaaaatcacaagagtgggaaaaagaaagctcaagcggaagttctcgcagcagaatacgcggaccctcccaaacgcccagacctacaaggtagtgacgcgaaggaagcatggtgcgctatacacaagtcggacagacactctctggaagattgcctcgtcttcaaaaagtcgctcggaaagcacatggcatcggaaaaaagcaagcgagtacgtgtggtagagaaggacactgagacggctacttaggaatcggactcatcatacccagactccgatctccatgtctcgcacatctttggaggttccacggcatactcctcaaagcgagaatacaagaaagtgaaacgtgaagtctgttcgacgtggcagggggctacacccaagatgaagtggtctgaacagaagatagaattctcagaagaagaccaccccaagactgccgtcatcccatggcgatatccgatcgtggtcgaacctactattcggaatatcaaggtcgcacgagttctgatcgacggcggcagctcaatcaaccttctcttcgccagcacattggacgcgatggggatcccacgaagcgaattgacaccaaccgatcaacccttccatggaatcactccccagtcatcgtccgaaccattgggcaaaattacgttgcctgtgactttcggccaagcaagtaacttccgaacggagcagatcacctttcatgtcactgaattcgatacagcatacaatgccatcattgggagaactgcactcgcgaagtacatggccgcatctcactacgcgtatcaagtgctcaatatgccgggaccaaagggaacaatcactattcaagggaacgctaagctggcagtgcaatgcgacaagcggagcctcgacatggtcgagcacacgcccagcccacccgccacagctgagccactcaagaaagtgagcaaaacaaacaagacgccgaaaccagacggcgcaatcaggatcgttccactctccagtgctaaccccgacaggaccgtcaagatcggggcatcactaggcgagaaataggaactcgcgctcatcaccttcctccgcgacaatgctggcgttttcgcttggcagccgtccgaca

SEQ ID NO: 47180 - DNA, 1256 bp, Oryza sativa
attcgcttagtaggtttctagctagttcaaatggataaaccgtgtgtatgattaattctgaatttcgttctctttacgtcgcatgatttattatcgagaagaatatttatcccaaagagtcaggattgctaaaattatgggggtcttagtttcagtcacgtcatgtatcctatatgatactctactaagtatgcttctctctatctctctcatttcctcttccaagtagataataattaaattaattttactcctaattcttataaactgtgtactaaaaaacaaaaggtaaatattgaaacttataatgtaattatagtttatgttttgaaatttagcgtgtaattaactacaatgcaagtgtatgcaatatattgtagttacctttcggttttcataaaagaaaatgtatctccaaattaggctgctaaattatacttgtaaatgaagctctatatattaactgaaatacttgttaggaaaaattgatataaggactaacccaaacgaatgaacatgaacactgaacagaaagctgcaaactacatgtacatatgcattgcatacgggatataccgggcatatggaaaattaaatatagttgattgcattcagagaattatagatcaatatatttttatctgcttctactgtcattaaacaacttgtcaaaatcagaattgacaacttagaacttgcaagtttaatggaataaaaaaacacattcaatatgtaaaagatgatcagcaaatagttgatcattccaatcaaaaccataaattgagtgcgtcctaattaaatagactgctaaatatgtattgcaaattgaacatgcaaaccatgcaaattcaaaggaatacatatatatgtatattgtagatgcagcaatagatctgtagcagatgcagtgacggatgtgcaagtaattttttattttgtagcaaacttttttcccccaaaattcatttggttaaatttcgtttcaggttaaaatttattcaatctttatggagtaaaaacagtacgtcaaaccagagacttaatagggatgaacgatacctctggagcgatcactgattcactggaaacttttaacttctcctcgtgattgaggcaaattgtcgctgatcgggaccacagtctgggatcaaggtcgactgcagcctatgcatatctcgtcgccctcgctcacgtccttctcgatcgcgttcgccgtttctttatcgcttcttaatttccaatctgatttctcacga

SEQ ID NO: 47181 - DNA, 1501 bp, Oryza sativa
tggtcaaggtgtatcttgcaaaaacatgtggggttagccgacgccacaattttactctggccctgccattgcgtcaaaccaatcgcaagaaatgtgcgttcaggaattaaaatatgtgttattagttattgagcatccataatcagaggtcacgtttatgacgaaaaatggttgaaaaaaaatcatgaaatagtttgtgtgagttattggacacctcctacaaattctaagtacatgcaaattattggtgtgtcataagtgtaacatttttaatgtgcatgctggtttcgaacccttgcctttgggcataagagtaaagtttgccgttcgtcaatcacaagcgtccattttatacctacgattagattttgctggcccgtgcatgcctcctaacattcatcttaagagaaaattagttgaatttcccacgcaaaagctaagatagaattattttttgccatgcaacgtctctagtttaaaaacacaattgtactattcccaataatttgtactacaccttatcaatctaccggtataattcgatcccacatcacaatgaatatttcagatatggtagtaaattttagcccttattggatgagatcaattatctattaaatatagactaataaaaaatataattctactttcaaaactacccttgtatgccatgtgttctttattctactggtacaagacggagagcctaagatagagacaagaatcaaattcttttattatttttttctccggcgaaaaatcaaatccttattcttttcttttcttttcttttttcctttcccatccactacgtgttgagcttgatcaagcttctctgacgtagaaaaagagggagatgccaagatagagacagatatcaaagtccaatgcggcaatgcccccctccattaatctgcgaaaaaaacctgaaaagtacaaagcaaaccaccctccgaatcctaccttctccttcctggagaggaaggaagagagataatcggagcatatgatgaggagatggtggtagcaggagcagtggttggcggcttggcgcggccacagaggcatcccattcccacgcggcctcgcccaagaatcctcctctccggcctcgacgcatgctcctgtttttggaaggaaacgaagtgaagaaaaagatcagaaaaggcaactagaattccaacagcctgttcattgttctgtgaaaaaggggcagttcttttgcagtgtgtatccatttattcgctgtttcttttggtggtttttttggaggcggaaaaaaaattctgttcgggtgcctgttcctgcgtgtttcgagggtttgctcagaggaagcagaggatcgaagggggaaagattgtctctctttcttttttttttcgcatttgggttctgagattgttccgcaacagggacctttcttgcctgtgagattctgaatcgcccgaggctggaaagattgaaacttcacggcgaggtctgcatgtttggctgaagacgg

SEQ ID NO: 47182 - DNA, 1501 bp, Oryza sativa
aagctatgagcttccatatttggagtattgtggatgtaggctttgctatcaacggcacacccttgacggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacaagtgagtacaaggatgccaagcttcatttcgtcaagatccaatatgagacattctccatgttgcctcatgagagtgtgaatgacatgtatgggaggctcaatgttattgtgaatgatctcaaggggcttggggcaaactacaccgatcttgaggttgcccaaaagatgcttagggctctaccagagaagtatgagacccttgtcaccatgctcatcaactccgacaagtcaaggatgacaccggcaagcctcttggggaagatcaacaccaatgacatgtacaagttgaagaagaaggagatggaggaagcctcaccttccaagaagtgcattgctctccaagctgaagttgaggacaagggcaagggcaaggtgaatgaagccaatgaggacttggaggaagagattgcccttcttgctagaaggttcaatgatctcttgggaaggagaaaggagagaggaaggggctcaaactcaaataggagaagaaatagaagacccaacaagactctctccaacttgaggtgctttgagtgtggtgagaagggacactttgcttccaagtgcccttccaaagatgatgatggagacaagtcatccaagaagaagagtggaggatacaagctcatgaagaagctcaagaaggaaggcaagaagattgaagccttcatcggggaatgggactcaaatgaggagagctccgcctcatccgggtccgaggaagaaggtggtgatgatgcaagctccaagaagaagaagatggccgttgttgccatcaaggaggctctatcactcttcgctccactttgtctcatggcaaagggttcctctaaggtaacatctcttagtgatagtgagagtaatgataattgtaatgatgtttcctatgatgagcttgtgagtatgtttgaggagctccatgcttatagtgagaaaaagattgtcaagttcatggccctaaagaaggatcatgcttctttggaggtcttgtatgaggagctaaagacttctcatgagagactcaccatgtggatattatgggtaccccatacccatacggcatggttatccgactagtcataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 47183 - DNA, 1501 bp, Oryza sativa
tccagctttgctgcatgcagacatgaatgctcatgctccagtgcaacattatatctacgatacttctttttattatgtactacctccgtttcaggttatagactttctagcattgcctctatatgaatgtggacaatgctagaagtcttataatataaaacagaggaaatagattttctctcatgggaactttagttttgaaactttatctcttctcagattcttgtgtgttttctgtagtgtatttatctttgttatttttctgtgttttagaatgctctattttgcatatatatatatatatatatatatatatatatatatatatatatatatatatatatatatatttctactctcttgttttacaatttatatataatgactgtattgtcatttataaggtacttcctccgtttcacaatgtaaatgtaagacttacattgtgaaacgggagggagtacggtataaggaggtgtttttttcccgtataagctttaatatcatttgcttcaaatgtagtactccgtacatttcagtatgaatagtaaatcttctcctacgtactggagtagtaaagaagccttcaagtcaatcttccaaaagccttttggcccaaaagagtatcaccctggttactgggcactatactgtgttgggatttcggtattaccggttttgtaaatcaaggtatacgttacatgtattgtgatttagggacgaattttaaactagcacaagataaagaacataaaatgaacttattccttaatttatcgtgtaatggaccgatgatctcgactcaggtggcccattgaagaatagaagtctgatgagtcgcctggcctcctcggctcctcgcacacggcctagaaaacaaataaaaagcccagcctaagtttaccctgacagatgggccccaccgaccccccgagcccttatcccatcgtggaaacctgcgacgtatgcggtccacggcacgtccaggtcagagactcagaaacaacggtcgccgtcgccgccgccgcatgttttaaggccggatttctcccaccgacagcctgggcccacgcaccccccgagagaggggtgggccccgcgtctccacctcccggagccaatggcaacccaagccgccggctcggtcggtcgccccgccggcgttcctcctccccaccagctcagccctcagccaccaaccacgcgcgcgcgccgccgtctcgtctccggtcccctcggcgcgcgaccacccaaccacctcgaccctcggcggcgcgcaagggcggcggcggcggcggcaggcggctgaccgcgaatggagctcctcccgcgtgtgggtgtggccgcccccggtcccggacgcggcggcgcgtcgccgtccccgacgcgccgtcatcgcgcgccctctcaccccgtgagcacctcttccgcgagagcgcgagattgatcggtggatgatgctaggggctacagtcagcgggagtggaagggcacggtgtgt

SEQ ID NO: 47184 - DNA, 1501 bp, Oryza sativa
actaccaccagtattgttgccacctctggtgggcaatattatctctatattggtcgtcttgtctatatgccaactgcgtcagctaccatcaatggacaattgtgactacgacagaaggacaagctatatgctcaggggctcatcaactcaagcgtgaggattatatctccaatttggacttattccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaggcctaatatgtctgcagcccatattttcaggtgtggcctgtcacgttcttttagggacttaggcatttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatgcaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatatatggaatatgtaacagatcatgacttgggtattacgtttcctt

SEQ ID NO: 47185 - DNA, 1482 bp, Oryza sativa
aatcggaggttatggtgttaattttaccggaattgctaattttattagctttatgtttgtatgtagctagggtttctttttttgtgcgtgcaaattgggattttatctttgccttccaaattttcatctcttaagaaactcagataaccaaatacataagagaagcgatctgtttaccatattatcctgtccggaggtgcaccagttgtccaagtagcacacattttgctatgcgcaaaaccactaatcagtccagatctctaggagtaaaattctgtcaagatctgtacgtggtgaaggggctgttcacttcgacgtcattttcaacattaccaaattttggtaaagttgccaaaaaagtggctatatttagtttgctgccaaattttggtaactatataagaaattctgccaaaattttggcatagttgtcaaaattttggcaatgctaaaatttggtaaggttttttttcatcaaagtgaacaggcccgaaatgtcctttctttctctagaacaattaatgaaatatcctttcgtgcagtagcagaagtgatgaaatgatgaggaaattaatcgcaccatcctcacctagctcattgtgcccttgctcataggacactaatttcagactttcatttcatgccgcaataccaaaccatgaaaccagcattcctaattaaccacactgctataataaatcaatcatttttttctcctcagtttttatccatcttcgatttgtcagcgcaaaacttatcatgtggactagtgcatctctttgccagttgctgataggttgtcccataataccggtgcatttcttctgagttttggaagtttatgatgtctgtaactgctgcttgtggagccggtttgagtcagtacagtaggtttagattggagttcgggtagtctcgtaattgtagtttcaaactcttcattgtagtttcaaactcttccttttcttagcagctgaaagagagtgagacggcactatctaaagtgattaacagctactggaagatagtgaaaaaagaggtcggagttctggtagttgcatacttgcagtcctattttgtgaattattggttgtagttgcttcccttattggttactgacttcctgatttgtcaacaaatcaaacttaataagataagctgaattacatatctacctacagaccttctatatttccagctttgctgcatgcagacatgaatgctcatgctccagtgcaacattatatctacgatacttctttttattatgtactacctccgtttcaggttatagactttctagcattgcctctatatgaatgtggacaatgctagaagtcttataatataaaacagaggaaatagattttctctcatgggaactttagttttgaaactttatctcttctcagattcttgtgtgttttctgtagtgtatttatctttgttatttttctgtgttttagaatgctctattttgca

SEQ ID NO: 47186 - DNA, 1501 bp, Oryza sativa
cggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaactagatcgtcagatctatatacacccggcggattcaaatccccaaacaggagtagggtattacctttcattgagagggcctgaacctgtctaaatcctttgtctccgcatccatccactttaggtctcgtacgctaccctcttttattattgccgaattcatgtttcgacacaccatttctcctgagaagcttaaggaagctcatgacaacctcctttccactactcaacatgaagctctcattgatgttggcatatcttgtgatttgcttgatgatagtgctacttgccatattgctcatgttgcatcatctagcatttctacctcttgtgatgatcttgtggatatgtctagctctagatctagctcttgtgtttctatttgtgatgtctcacttgttgttgagaacaatgagcttaaggagcaagtggctaagctcaacaagagcttggagaggtgcttcaagggtaagaacactcttgacaagattttgagtgagcaatggtgcatccttaacaaggagggacttggattcattccaaagaagggtaagaaaccttctcactgtgccactcgttttgtcaagagcaatggtaagtattgctccaagtgtcgtgaggttgggcatttggtgaatgattgccctggtggtaagcctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgggtgcttgacagtggatgcact

SEQ ID NO: 47187 - DNA, 1501 bp, Oryza sativa
ggcccgacatacagcccatatggaccttctcagatttgcaccgctgtttgtaactcttctttgccatgatagaggagaacattgtcagacagattcgtttaatcaccaggcaagtttacaacctgaatatcaaaacatagaaaaccatgttagaattggtaaacagtacaaattagacatgcaaatggcgaaagagcttccaccctatcaactactcatagttggtcatgatctcttaccaacttctgaatggttgcagaatctacttacataactaatacagttgtccaagactaattgtaaaaccaaagtaaaaaaaaaaagagaggtaaaatttgaaagaaagaagagacagaaaccacattggaccccacaaatgcaaacatgtaaagttcaccgcattacggcattacatctaattgctttctaacgagaaacatgctataagaatttaatgaaacctaattaaattagagagacaaaaacttcttgtggccatacaaagaggcaaaaatgccaaatgacgaaactctgaagatttgaaagttatttcctctcttttccttgtcaagaaaggaacagttgtcctgtcggtgaacccagaatcctaggattaagaatagttccacttccccatatgcaaagaacggctacaaatgtccaaattgcattgtatagtatctgcaggcgctggctaatgcctaaaacagctcagtaatccctattggagtatgtcaaccacagtataacacaatcacccagatgaacaaaaggttgatattgggtaatgcttatgttaccttagttcgaagaacccagaccagatgaatacaggaaaaagcaaggtggcgcctgacaactgttcctacacaatgacctgctaaatcatctgaacagccatgtctgccccttttctttgacccttgagccgtgaacccaagtacccaacaatggtactagcttcttcaatctccagacaatcaaaacccaatctttgaatctcgagcaatcgcgaaccaagagaagataagcagaaacagatgagaaatgatccgatagccccaacagaaacccttgtatctgccgtgcttcctcggtttcctcaagatgccccggactcggaattcacgtcaaaattgagaaacttgacaggaaggaatatatctcatcaagacctgaacacgcaaaaggaaagaagattgcggaactgcatcatcagaccgaccctctgcttcctttatccccctccgtcttcagccaaacatgcagacctcgccgtgaagtttcaatctttccagcctcgggcgattcagaatctcacaggcaagaaaggtccctgttgcggaacaatctcagaacccaaatgcgaaaaaaaaaagaaagagagacaatctttcccccttcgatcctctgcttcctctgagcaaaccctcgaaacacgcaggaacaggcacccgaacagaattttttttccgcctccaaaaaaaccaccaaaagaaac

SEQ ID NO: 47188 - DNA, 1501 bp, Oryza sativa
gctgttgcatgcagaagcagacgaacccacgcgaaggaaacgaagccttccgtgccggagtgcgagcgtgcgacggcgacggccgcggccggtgtctctccggtagacgatcggttcacatcgcggctcccaaccacgccgatgcaacagcacacgaaatgcgatcgtgatgtcgtgtcgttgttattcaatccatccatcactcgactcaacaacccggaattgcataaaatttccttctcgtatcattatgctttcgtgcgacgtttcttcctcctccacgaacgcatgcttgatcggtgagaacacaaggctaatttgtttttataataaatttcattccggtatttactttacaaccggttgttacatgatgaacatataaccgcaaattacaaaactacagcatgattaaaaaaaatactaaggctatgttcgcatgagctcgatgggaacttttccctccgcacgaaaaacggagcggtccattagcgcatgattaattatgtattagctaatttttaaaaaaaaatagattaatttaattttttaagcaactctcgtatagaaatttttttaaaaaaacacatcgtttaacagtttgaaaaggatgcgcgcagaaaacgaggaagatgggttgggagaagaggttgcaaatacatcctaggctaacttgtttgcaaactctgacctgtttatttctgaaaattcatgtatttgggtaagtgaaccctctggctttatcataagtatatatgttgataaacgatataatcatatcaatagaactagccgaacggtattccctaaaaaatattcttacctatttattacaaagaataatctaaaagtggctttgtgatgttgccccttgcccgtgagccaatgtttacgctacaaggtcacgcacctatctgggtaggaaatttcccctccgttaatctgtactttggaaatgaacatctcaccagccggccattaccaaggacaagattgtcaccatctgtatttccgtgcttaagagtggaactggttgttagggtgttagcgttgcaggcttggctgacttgcagtatgtaagtccaaaccgaccccatgcaactgccaatctcctttcacaagtcaagagcacgcagcaggtgagctaattttgtcttatggcatgatgtatccttgcgaacggttcggcagtggttatctagagctgcagtgagtacatataaattaattctttccagctttttttcatgtcttgctcatgatgagatagtaactctcaaactaaactaaccaaaagggcaaggaatcaggggggaaatagactggtattgtagggttttctttttcagagtaacagtgcatggcatgctgttgcaaaatgtgcaagtgagctgtagtcattaaattcattatcggcaacttggcaagcatggtttcatgcctgccgtgatgccacctgacaaaatataatcaagcaatgttccatacgcacacacctaat

SEQ ID NO: 47189 - DNA, 374 bp, Oryza sativa
tgtaaattttaatcataattatttgggacatctgtagaagcttttgctatatcgatatcactgtttaccctgatcatcacatcaccatatttatgcactgtacaagataccaaatagtatgaatcaaggtgataatatgtttggaaaccgattagccatgtgtttccttgattgaatatattcgtatccaaccagagcaaaagcttcttttttctaacaaaatctcagaattccatcccccgcatttgttttgacaagatatacaggctatccttctccttctcttcctcgatcatgaatctttgatcttcttttccctaattattacgtgttagctttgctccttgttaatgatgacataaatttcttgcaga

SEQ ID NO: 47190 - DNA, 154 bp, Oryza sativa
gctcttaacacacggattgagaaccaggtatctcgtactagtaatacccagtcactatgagagcttttgtttctgtttaagcaaatgttttatatttgtattgttgcaaacttttatggtagtgtgacgaattatttggtgttctgctcccagg

SEQ ID NO: 47191 - DNA, 622 bp, Oryza sativa
atgatccacagtccacaccatgctagagctacaaaaccaccatatgggtgatataaactccctttcaggtttcaacaataactaccaccaccatttgtaacttctaatggatatcatcagcatatgcatctagtggtgtgttaccttgcacaccacacaaattgttctttttttagataatacgccacacaaattgttaatcaactatatacaaaatcactaaaaaaaactacacacatatattactgggtagtaactaacaataaatttatagggtttgccaattgccatcctagctagccaataaaaaaagtgacagcaacaagtgttgctcccctgccccatttggtaggtccatcttaccccctccctttctttctttgcctttgccaattcacccccactccacacacaaacacattcacattctctctctctctctctctctctcctcttcagctatgataaatatacctgcaatcaccaagccaaaaaccagacagcacttcacttgggagtgagatagcctagttgaagtagtaggagaaggcaaagccctctccttcatcccttctccttcaacatcgtcatcatcaccatcatcacaaggttgtgtgtcaac

SEQ ID NO: 47192 - DNA, 461 bp, Oryza sativa
atctgtgtgacttgccttgctgcccttggaactcttcaaattcttctccagcgaaaacgaactctccggaaacgtcagaatctaaacagaaaagagcaaaaacaccaaaacagcacataaacaagcatgaacagtacatgtggatatttttaacatgtagatctcaattttaaaaaaatttagagacttgaaccaactaaatccgagctaagatgaattagttatgaatttttagagattaaatcggattaaaacacttatatgggttttaattgaattatgacgcaataatgaattatttttgaaaaggaaaaaggggtttattgcgtcagcggctagggtttgcggtggaccgggtgcacggcgacggctcacggaaacgaacggccgagatcgatcctaaccaaaacgaacggccgagatcaaccggtccacggccggaccacgacggacggcaacga

SEQ ID NO: 47193 - DNA, 688 bp, Oryza sativa
cgcctgccgatctccatcctgctagcagaggtggcgccggcgtcctcctgctcccgccgcatttgcatcctaatccatcccatctggcctcggcctcgaatttcgtctcctcgcccaccgcttgcgccgatccccatcctgcgagcagaggtggagcccggcgtcctccttcttccaccgcatcgtcgttcgccggtgagcatccctctctacccatacctcatcaggtattctgcgttatccctcaaaaagtttgggggttagatctgcctctacccagctccacctactttcaagttgttaattttgatttccgtttttagctgatgtaatttggttactgaatctcatccaaacacccttagaacgaaaaatgtaagctcacatactttgtactcatccaaactcacataaatttcttaagaagaatctagaccacaaactactcatagtcacacaatatctttttatcaaggtatactcttataagaaattttcatttctcaaaattttctaaaggacatactgtgacacttggcattaatctaatttaacttttttttctttatcaggttataaattttctaaaagacatttgtgccacttggcatgaatctaatttaacattctttctttatcaggttataaattgacaccattgaacgtactttatctttctgtccacaca

SEQ ID NO: 47194 - DNA, 1501 bp, Oryza sativa
ctggagcggctggatccgcctaccaatgaagtcggcagcgacttcataccccgacaaacctcttactcagaggtcatcgatggcatcgatgaacgactgaagagaaggggtcaaggcgggtttggcggtccaagacagagtcttgactggttgttcctcaggaacaacaaagattggatctggatcctttatctgaagatagaaccacctcgcccgccacttgctacgagaagaagggcactggaaggggatgtagtgcgacttcagcccaacccaaagtcagaaaccgacgcatccagataccctggtggatcccatccaacgcaactcgtagtagaagcgaaagaggtcgagaaacggctctaccccaatgtaggcctcacaaagatgcgaaaagatactgaggaaggcgatggaattggggttcaaatggagcaaagaaagaccgtagaaattcaaaatgagaaggagaaactcagaaggcggggggagaaaaccacagagaatataatcctcaaccgcaaccatgcgacctaggacaggttcaggttcagtacctcctggttccctctccatggtcccgcgaccggggagagcaccctcctcctgcaacttcttcagggatgcactagtggaagtggacttgtcgaggtccattgccgcaggagatcgccggagaagggaccggcgataaacaagctagggtttggcgggagcggagaagacgaggaacgcttggaggctgaagagctttttcacaacaggcggacttcaaattggatccccaaaatcctcttaaatagatacatttctgacggtgcgaattccaaggaaaggagaaagagatggccgccggaaatttctgggtccgttacgcgcggcagtttttcgaacttcaatttaaattcactcatgaccgttgggcttcacacggtgttgtcgattactccctgtcacctggagaattagtcgaaccaactcaattacgatctcgctggtatcatcgagttccattgttccccttgtaacctatgatttccatcatataataccatatcaactggattagggctattacctatcaaggggcctgaaccagtataatctgtgctttttgtctgcttgatgtcgtattatgtagatcctcgtaccagcgtaccccaatacccactatatccggtctatgggtatcccccgtcgacaatctacttcataattcacaacgtcaaaaattgtacttcatgataaaatcaaacggggcctaattatttattgtaaaattcaaaaaataaaatttatttttttgaacaaatttattttttttgacaaaatccatataagagttttagctagaaattatgaaccaaaattatttatttattgggttcaaagtttgatgaaaacaatgtacgaatttcataaaatttaatttaaaatttatttaaatattttagatttatttttatataagaattgtgtttttatcactaaactagcacat

SEQ ID NO: 47195 - DNA, 1501 bp, Oryza sativa
cgccagaggtgaagaagccccgttcgctctacaacgctgcatcattggcgtacttgggggactgcatatatgaagtgagaaacagtttgactcaattgtggttatgcactgaaaattgttattatgtaattttattacatatagctcagcctatttgtcacttctatttgtattggattagtaagagataagatggtgcatataacgtgcacaaaactttcaacttcaggtctgtatactgtaggatgatctgataagaatggttctgctctttgattatgcagctttatgctcggagacatttcttctttccaccactgagcatcaatgactacaacaagcgtgtaatggatgtcgtgaaatgtgaatcacaggtttggatttggctcttcatctttctaatcaaatggatttgatagccagattcttcttattatctatctttttgggtctgtgctttgcataccttgatggacattgtctgctataagcaaaaatttactcaatgctttccatttttatggctgttgttttcaattctaaagggcagttctcttgtttgttatttttctgttctgtttgctacatgataatcacacaataagtatatcaaatattatttacattatttttggttattttcctttattcaggaccttctgctgaacaaacttcttggagaagattttctaactcaagaagaaaggtaaaccaataattctagccttctgccagatgtaaaatatatgctaatgataaaattcttatcaggaaattttatgctctagtgcccgtgtacatgactgaacttttatgggatgttagccctttagtgtccactgtccaggacttgtaaattcatctatctaggacttgtcttttgttgtaggccatctgttcttttatttttggatttttatagtgtttgatactatcttctgtgtccgatgctgatatcaatgtgcgcatgcttcagaagtactgaatttccttattctgcagggacatacttcgttggggaagaaatattgttagcagcaagacacgtaccagaaaacgtgctggaattgcagtttataatcgagcatcttcacttgagacactggtgtgttccactatagactaattaatgattgctatattggggaaaaatcaactctaagctgcaacttctgttgtactaccctcacactacttttgttgagaagactacatccttgcgttgttggttggtatttctattattagattggatatctttacctcacaaatttcaagcgcttggagcaattgatgttccagttaggatttacaagtggtgcttcctcacatcatattgcagatgagctagtctcaggctttaagtaatgcatcgttggtttcttgtcatgtaattaaggtatttcatcttgactttctgttactaacggataaccattggcaggaaaaagaactccacttctgtacaatctcagcaacaagcagcgcagtgaatagtttc

SEQ ID NO: 47196 - DNA, 1501 bp, Oryza sativa
atcagaagggaaagtgcgcgagctgaccggagatgttcttttcccagtgacattcacctgcatcacacagaagcctacgaagggcgagatcttagttggctctgtggataagatcctcaagcatggcgtgttcctcaaatctggaccaatagaaagcatcttcctgtcagagaagacactgagcgactacaagtacatcggtggggagaaccctatgttcatgaatgaccactcgaagctggagaaggacaccgctgtgcgcttcaaggtgatgggtttccgctggatggaagctgatcgccagttccagatccttgctaccctggctggtgactatcttgggccactatgaactgcttccacaggttagtggtgatgaatggatctgaaatgtattatctttaacctgctgtctgtagtttgatgtcatgatgatgatgattagaccagtagctgtgatgctggctgttgatgtaagtgacatttggccctatgtttagcatttcagcatgatgcgaattgtcatggccgtttaacctctgtttcctatcgctgctcacagttctcctatgcatatatttgctgcattcctttctgagatatttgcctttgcaacgtcgaatttgcaatatttctctatgcaattgtttccttgtgttacaatcagcttaatatgcaagtaacatcaaaataccccagatgttaccctgacaagcaaatcatttttgccacaaattagtctatgacagctagtagtagttggcacttggcaaatcgtgttgtctgcttcagtttgctctttgctacacactttttgccgagagaagtagaaagcttttaaattttacaaagaaatttctttttttcctatgttaattcaaattgagtcaatcatatggtgattcgtgaacgaccatctagcttcaggagaaattaacgatctgcaaccgggtttcagaggaagtttctctgcaaaatgcatctctgatttacagtggagctcgagaaatgaaatagatttaagtctgaattccaattaatctatccatagttggacgcagggctagtcactgattttggcaagtggcaactgattaatccggcccctaaatggcacagtgaattgatgttttttataccgaagggcaacaatttgtttagatgtacaataaaattatttacgacttgttaataatgtgaggcaataataaagcattcactgtccgtagccaacaatataggagatggacttcaattgtgcaatataattttgaagaataaatgaaagaaaaaactgtttttcttttctgaaagttgaccaaaagtcatcattccaagtcgttgccgtgtcgtgtctgatacatcatttttgttttctctatctatcataatcatcatcaatccatgtgtatctttagcatgactgaacaaagttcgccattaacaacctgacttgcctagagccatagcagcctgtgcatgttcatcccatacggtaaca

SEQ ID NO: 47197 - DNA, 1501 bp, Oryza sativa
cctcaaatctggaccaatagaaagcatcttcctgtcagagaagacactgagcgactacaagtacatcggtggggagaaccctatgttcatgaatgaccactcgaagctggagaaggacaccgctgtgcgcttcaaggtgatgggtttccgctggatggaagctgatcgccagttccagatccttgctaccctggctggtgactatcttgggccactatgaactgcttccacaggttagtggtgatgaatggatctgaaatgtattatctttaacctgctgtctgtagtttgatgtcatgatgatgatgattagaccagtagctgtgatgctggctgttgatgtaagtgacatttggccctatgtttagcatttcagcatgatgcgaattgtcatggccgtttaacctctgtttcctatcgctgctcacagttctcctatgcatatatttgctgcattcctttctgagatatttgcctttgcaacgtcgaatttgcaatatttctctatgcaattgtttccttgtgttacaatcagcttaatatgcaagtaacatcaaaataccccagatgttaccctgacaagcaaatcatttttgccacaaattagtctatgacagctagtagtagttggcacttggcaaatcgtgttgtctgcttcagtttgctctttgctacacactttttgccgagagaagtagaaagcttttaaattttacaaagaaatttctttttttcctatgttaattcaaattgagtcaatcatatggtgattcgtgaacgaccatctagcttcaggagaaattaacgatctgcaaccgggtttcagaggaagtttctctgcaaaatgcatctctgatttacagtggagctcgagaaatgaaatagatttaagtctgaattccaattaatctatccatagttggacgcagggctagtcactgattttggcaagtggcaactgattaatccggcccctaaatggcacagtgaattgatgttttttataccgaagggcaacaatttgtttagatgtacaataaaattatttacgacttgttaataatgtgaggcaataataaagcattcactgtccgtagccaacaatataggagatggacttcaattgtgcaatataattttgaagaataaatgaaagaaaaaactgtttttcttttctgaaagttgaccaaaagtcatcattccaagtcgttgccgtgtcgtgtctgatacatcatttttgttttctctatctatcataatcatcatcaatccatgtgtatctttagcatgactgaacaaagttcgccattaacaacctgacttgcctagagccatagcagcctgtgcatgttcatcccatacggtaacaccattagctatgttttcttgtgctttgtactactgcttttatgcctttatcatcctcctttctacctcccatgccgaagaattcatctacaatggattcactgatgctgatcagctaacactcgaaggtgaa

SEQ ID NO: 47198 - DNA, 1501 bp, Oryza sativa
tcttagttggctctgtggataagatcctcaagcatggcgtgttcctcaaatctggaccaatagaaagcatcttcctgtcagagaagacactgagcgactacaagtacatcggtggggagaaccctatgttcatgaatgaccactcgaagctggagaaggacaccgctgtgcgcttcaaggtgatgggtttccgctggatggaagctgatcgccagttccagatccttgctaccctggctggtgactatcttgggccactatgaactgcttccacaggttagtggtgatgaatggatctgaaatgtattatctttaacctgctgtctgtagtttgatgtcatgatgatgatgattagaccagtagctgtgatgctggctgttgatgtaagtgacatttggccctatgtttagcatttcagcatgatgcgaattgtcatggccgtttaacctctgtttcctatcgctgctcacagttctcctatgcatatatttgctgcattcctttctgagatatttgcctttgcaacgtcgaatttgcaatatttctctatgcaattgtttccttgtgttacaatcagcttaatatgcaagtaacatcaaaataccccagatgttaccctgacaagcaaatcatttttgccacaaattagtctatgacagctagtagtagttggcacttggcaaatcgtgttgtctgcttcagtttgctctttgctacacactttttgccgagagaagtagaaagcttttaaattttacaaagaaatttctttttttcctatgttaattcaaattgagtcaatcatatggtgattcgtgaacgaccatctagcttcaggagaaattaacgatctgcaaccgggtttcagaggaagtttctctgcaaaatgcatctctgatttacagtggagctcgagaaatgaaatagatttaagtctgaattccaattaatctatccatagttggacgcagggctagtcactgattttggcaagtggcaactgattaatccggcccctaaatggcacagtgaattgatgttttttataccgaagggcaacaatttgtttagatgtacaataaaattatttacgacttgttaataatgtgaggcaataataaagcattcactgtccgtagccaacaatataggagatggacttcaattgtgcaatataattttgaagaataaatgaaagaaaaaactgtttttcttttctgaaagttgaccaaaagtcatcattccaagtcgttgccgtgtcgtgtctgatacatcatttttgttttctctatctatcataatcatcatcaatccatgtgtatctttagcatgactgaacaaagttcgccattaacaacctgacttgcctagagccatagcagcctgtgcatgttcatcccatacggtaacaccattagctatgttttcttgtgctttgtactactgcttttatgcctttatcatcctcctttctacctcccatgccgaagaattcatcta

SEQ ID NO: 47199 - DNA, 424 bp, Oryza sativa
tttttcttttatcaaaatataatcatgcgatatcttgatgtaaagatttaattacaacgaatacaacggtatgatcggatcatagattgaataagtaacttaagagaaaaattattttgaagcttgctaaaatacatgcatgcatgcatgaggtggggagagagtagtagcaggtagtttcaggaattttgtgaaacacaccgaaggcacatattgaaacatatcactatcacgtatgaaacattttgttttaacggtttgaaacacatgtttttcttttgacataatataatcatgtgatatcttgttgtaaatatttaattgcaacgaatacaacagtgtgatcggttcgtagatcggataagtaatttaggagaaaaatatttaaagagatgaggaaagaatgaaaagaaacggctaggca

SEQ ID NO: 47200 - DNA, 1501 bp, Oryza sativa
cttagttggctctgtggataagatcctcaagcatggcgtgttcctcaaatctggaccaatagaaagcatcttcctgtcagagaagacactgagcgactacaagtacatcggtggggagaaccctatgttcatgaatgaccactcgaagctggagaaggacaccgctgtgcgcttcaaggtgatgggtttccgctggatggaagctgatcgccagttccagatccttgctaccctggctggtgactatcttgggccactatgaactgcttccacaggttagtggtgatgaatggatctgaaatgtattatctttaacctgctgtctgtagtttgatgtcatgatgatgatgattagaccagtagctgtgatgctggctgttgatgtaagtgacatttggccctatgtttagcatttcagcatgatgcgaattgtcatggccgtttaacctctgtttcctatcgctgctcacagttctcctatgcatatatttgctgcattcctttctgagatatttgcctttgcaacgtcgaatttgcaatatttctctatgcaattgtttccttgtgttacaatcagcttaatatgcaagtaacatcaaaataccccagatgttaccctgacaagcaaatcatttttgccacaaattagtctatgacagctagtagtagttggcacttggcaaatcgtgttgtctgcttcagtttgctctttgctacacactttttgccgagagaagtagaaagcttttaaattttacaaagaaatttctttttttcctatgttaattcaaattgagtcaatcatatggtgattcgtgaacgaccatctagcttcaggagaaattaacgatctgcaaccgggtttcagaggaagtttctctgcaaaatgcatctctgatttacagtggagctcgagaaatgaaatagatttaagtctgaattccaattaatctatccatagttggacgcagggctagtcactgattttggcaagtggcaactgattaatccggcccctaaatggcacagtgaattgatgttttttataccgaagggcaacaatttgtttagatgtacaataaaattatttacgacttgttaataatgtgaggcaataataaagcattcactgtccgtagccaacaatataggagatggacttcaattgtgcaatataattttgaagaataaatgaaagaaaaaactgtttttcttttctgaaagttgaccaaaagtcatcattccaagtcgttgccgtgtcgtgtctgatacatcatttttgttttctctatctatcataatcatcatcaatccatgtgtatctttagcatgactgaacaaagttcgccattaacaacctgacttgcctagagccatagcagcctgtgcatgttcatcccatacggtaacaccattagctatgttttcttgtgctttgtactactgcttttatgcctttatcatcctcctttctacctcccatgccgaagaattcatctac

SEQ ID NO: 47201 - DNA, 985 bp, Oryza sativa
gaattaattttagtagaaggttaaattggtctcttgactaactaaatagagaaaaaggacaaaaagtatcgatggcaaagccacaaatgtagattccaagtggtctttgatggcatcatggcagattttatgttggtttcattaatttctttcaggttgagtagcagtttttaagttactaggagttgttacgcgaattgctgcaggactggttgttccataaaacaatatgcattgcattaatgattagattacatattatatttatcaacgacctaaattattctaaaattaaaatgttaatggggaagtattaagataggtcatgtttatatttgtgaaatatggacaaagacatcctcaaatagacctcttgtataaaaataaatttcctatatgagataaactcaaattttttttaggtagcatataaatcgttggttaaattatgttttagggtggttttgatgtcagaaacattggttttgaccatatagagtacatatcagttaatccactcaaacacaatgaacctgaatttggctccaatactagattaacccatatacccgagatacgaacaaccctcagcttattggtgaagcacatatttctgttacctgtatttgttaatttcttggatcatcatatattagactaagacatgtaaatgttatgtgtccacacagaaaaacaaataaatgggaaggaaaatgcttccatacacagttagcattcatgaaaacaaattaaatcaatataatgtagcttttttcaagggtacatgtacttaacattttgattactatggtataggtgccaaccggtaataccagcgtatcaattcagtctttgacaaatatactttatctcatatcgacaactactaagaattattttaggaaataagagtaattattttaattttacatatacttgctacagttggactctttgatattcatttccatgtcatgtttatcat

SEQ ID NO: 47202 - DNA, 1501 bp, Oryza sativa
ttgccggggaagattcataatagagattacctgaactaatactttatatttacctctgtataatcactgccctttgcaggctaaccttggttgttttcactttttactgtgaaaacagggtagtgcatgattggtttcaacttgccagaaaacttcaaagaaaatccagaagctttcttccaaagcgtcaggccgtgagtcgttgctccgcagaaaactctaccggcagagaaaccagccgtactagcgccaccgaccttcaagactatggctgacaagaccctccgcgagctcgctgctccctctgctgacaatgtggccattgggccgcagatcaacatgggagatgtggatttcaacttaaagtccagcctcatcactatggtgcaggctagcccgttctgcggcaagcctaacgaggatgccaacgctcatctgcagcagttcctggagatctatggcacgtacactataaagggtgtcagtccagacaccgtcaggctgaggttgtttccgttttccctcctcgggagagcgaaacactggttttacgccaacagtgctgctgtcaacacctgggacaaatgctctatggtattcctcttgaaattctttccgatgggcaaaaccaatgccctacgtggaaagggacgagtccattcctgaagcatgggaacgacttcaggagtatgtggccgcctgtcctcatcatgggatggacgactggttgatcctacataacttttataatggactcactccaatgtcccgtgactacctggacgcggcagctggaggaacattcttctctaagacggttcgaggagccgttgatctaatagagaagatggtctccaatatgggttgagcgaggtatgcacaccgtcaaggagacggaattacttactgccaagctggacctcctcatgaaacgattggacgaccacgacaaacggccacaaggcaccgtccaggccttggattcacacgttacgtgtgaggtctgcgaccacacgggtcattctgggaatgactgcccagaaacccgtgaggaggcgatgtacatgggcaacaacaacaacggatatcatcgacaaggaggtcaagggtggaaccaaccacgcccgtatcatcaaggaggtaacaacaacggtaacttctctaaccaaccctccttgaaggatctcgtctttgcgcaagctaaaaccactgatacgctaagcaaaaagctcactgccaatgacaagatccttgaaaatattaatgttaagctagatggcttcgcttccgcttttcaaaaccagctgagctttaataatgatagaaacccagctagctcaattggcttcattagtccctgcaaatgaaactgggaggattccagggcaacccgacacctccgttgaaaatgtcaaggcaatcacgacgagggaaggtaagtccactcgtgatcctccatatcctaaccctgcaggaactaacgggattgcaagagaagcat

SEQ ID NO: 47203 - DNA, 815 bp, Oryza sativa
gtagtttctattataaaggagctgaacacaagagtgatatggcttttgtagtgaaatatgtttttacatctaggaatgccaaggtgtttagactgctgaaatacaaatggacatttgaataaatattcgggtgaccaggaacatatgttatccattaataacaactgtgtaatgtagtaaaatactttgaccattgatcgatgccatagcaaccaaagaaataatataactccatagtccagcataatgtctatagaattgctaagagttaaacaaaaagtactactcttcattaacagttaacactgcaggacgtagtaataaagaatccctatgttaatggcatcttaattgtgtaggagtgattataagataaggattcaactttgagtctcagccctcgttgaaatgatgaatgtctttgattctatctatcattcatgtaattgtaggctaaatcttattgatattaagtatggagaatttcggattgtgcattcatgttattaaataagttcattttcttgccttaaccttggtacaagctctttttgatcatttgatgttatattatttgcatatcatgtaattatctatttatttccatagatcatgcactgcccatttctttttttgaagaaagcacagtggaggaagcccccatggtagatattaatttcaaggtttatgtacaaaagaaaagaaaaaaaattacaaatggtcaatccatggttgcactgcccttttctttgttcgtgttcattgtttttactgttttatgctaagttaatgggttgatttatcatgcatgtagg

SEQ ID NO: 47204 - DNA, 1501 bp, Oryza sativa; identical to SEQ ID NO: 30466

SEQ ID NO: 47205 - DNA, 742 bp, Oryza sativa
aggattacaagatagagactttatccttacggtataaagctctacatatactttacaattgtaaccgattgggactaggggatattaccttgatacacaagttaacataatacccgcgtccttttatatacatattctatccacatgaactatcccctatagcagttagatagcatagccatgtgggtatatggtacccataatctccacagtagcccctaagaccttcatagttgacaaaataatcttctaccgagtcatctgtactaatataaaaagcaccagttcatcaaatccagatgttttctaacctttagatctaatcatccgacagctcatatcaagagttggatcaaccactgcgattaacgatctcccacgtctaaacagtggttagggatcgatcaaagcgaaaaagaaaacgaaaaaagcttctttgctcgccgcctcctcgtgcagtcgcgcgccctacctcgcacgcaccgggcgccgctgccgactccgggcgcgcgcccgccagagccgctcgcgggttcaccggcagaaaatcacgcacgcaatttgtcaccccgccgccgtcgcatgccatccttcgcacgtcgttgcacccccgtccccctccaccgctgacttcaccccgcggcgcggccgctacaagtcgctgcagccctgtcactccctctccgttccctcgcccatcgtcgcgcccctgtcccctccgccaccaacttcgccccgcagc

SEQ ID NO: 47206 - DNA, 1501 bp, Oryza sativa
cgccgcggggttcgcggagttcgagcccgcggcgccgatcgattcgtatccggcgggggcggcggcggcttcgttgggcgacgttcctgaggtgagtgcgctcgattccggcgttgattgttcgcctgacccgccgccatcgtcgtctcctccggtggattttgatgcgcgggggtttgaccccgtcgccgactccgccccggcgatggagtctccactaccgccgtctgtcgcttcctcggaagccaatttagacgggagaatgctcgattgtacgctcaactccgtgccatcgccacctcttgcttccccatatgaggtcggtttgggggctgaggatcctatcaaggattcttccccttcggttgcttggggaacaaccatggatgcgaaggatcccgaggtggatgctacttgtgcaaatggtacagctctgcggagatcacggaggatcatgaaaatcaagtcagcggcgagctccatgcctttgaatcagaatggagactcatctagagcttccaagcgacgagttgcggattcaaggaagagtagaagcagtgaagggagcaaactccctgcgttcacagggccaatttcagtaaacacagttgatttgattaacggggtgaaggttcaaggattgcaagaaattgttgccgtggaaaacgtaagttcctcttacgacaataatcagaaagcaggtggtctctacaatcaggttgtggtggctttaccagcagcgagtaatagtttgttgaaagacaaaggagcttctgttcttcctcgaaggaagactaggttagcctcaaaggtattggtgaattcagacagggtgtcagctatatcaccagtggtaaatggtggacctcctgtgcagaaatcagatgtttgtatacctactaaaaagcataagcttgctgttgaagagtgcttgacaagtctggatggagtggatggtggtggtattgtgttgtgcaactcaaagttgaaaagtgcaaaatcacgagtggtcagcaagacgcctcaagggagaggaagaagatcccctcaacctccaaagacacagagggccaggacgttgtcggttaaatacttggaaaaattaaagagggcagaaaacaataataataatggctcaatgtccaaatcaccaagagttccaatgataccagaaaataatggctcaatgtccaaatcaccaagagttccaataataccagaactgagcactaagcacgaacttgttttggacaagcacatggttgattcagtgatgttggaaacggacgatggttcctgtttctttgtgggggatgcagttcctgatgatgaggctaggaagcagtggcctcaccgttacgaaataaatgatcaaatcatgaaaaaggtatgcacgtgatttggctggtttgctgctctctgcatgacttcatcgccatatttctgtagcaatataacaataagatgtggactattgcagattagttaaatagatatacaa

SEQ ID NO: 47207 - DNA, 1501 bp, Oryza sativa
ttttgcaaaagcgcctctctcttgttcacattttgtttcttttctcccaacaaatcagtcagcttgaggagttgaggtcgagggtgaggcaaagtggttgcctgcctgacgaatcatcaacgaagtgaggggcgagggagacttggcagtggccggcggaagtgtggctccaactagcaatgtcggcgtggtcaacatacgggtggtaataagccccaatattttagcctacaaaatgtgagggctaggcccaaaacaattggtctaagatttaatagatattttagctaaaactattttaagggctgagattagttatgaaagggcccaggctccctatcccattatcacccctagggcaacgtagtggtgttgcatggagcctacaagcggtcaggaggcgcatgggtggggactagcaggaggccggtggggaggtgccaagtagatagaagcgaccaggtcgctgcgtgcggcatgcctcggtgcctgctttgccaagctagagtccggactatcggagccgaggagctgatcgagtaggcaagctctgaatcttcttttgatttgtgaagtacacattggcccattgggcatgcttacaatataccagaactttacaatttcaattacgcttttagtcggtggcaggtctgtttaagggacaagtggatccttcttatctctcttcctctctctcagcaaacctttccgcttggtccagatgacctcatgttttagctagttggaggcattggtgggcggttcagtggtggcttcatgtctaggcttggcggcatcagatcctgcttagcggcggtcgatgcggtgctaggtctttggtttgtgcaggtattgctggtgtttgatagtggttctgttattttccctgattgtagcctttcaagactgcagtcttgtaattttttcctgctatatcgatttgaaacatcgcacttttttgtgatgttcgtttaaaaaattactctatttggatgattgagattcgcttgtttgtcagatctgaattacagtcagtactaacacacatgatattaatctagaacattacgtgtaaactactgaatttcacctaataatttttttttaagaattagtgttgtttgcctgcagggatcttatatagtgaaagcagcaggttttcttgcacgagaacgtgccttcagaaataaggaaaactagccaaatcctccaaggcatgttcccaagaaaattgacgtccgatatggtgccttctcaaaccaatttcttagattattcttcagataattaatcgaagaaagactctaacactaaccctaacagtgaacaatttatcatctaattaaaataatggaaaagatggtgttcgcgaaaaataaaataatagaaaatagttgaggcattcacaagtaatccttgccttgtgctgtggcctgagactggcacagtggcaggggcgttggtgtctcgcgacgagagggtcgagccaaagtagaga

SEQ ID NO: 47208 - DNA, 1501 bp, Oryza sativa
gcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagagaaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgattacccccgagggggggtcgggttgcgcttgccccggccccgagggccgaggcaccccgacccccttaaggaagtct

SEQ ID NO: 47209 - DNA, 1501 bp, Oryza sativa
tcggcagcagccggcaactggttgcaatctctccgttcagttccgggaggtacccactgctctcccatttgatgtatgctaagtttatatgtttaaattttgggatttaaattttactccccaattgctcctcttctaatttctgaaattctgattttggggtttagggatccttacgttgcagctgtgcaagtgtgcgtctagggcagtgaataccagcagtcattttaattataatgttgaattgaatttagtatgaaataatttccataattacttactaatttctaaatttacagtgaatgttagaagaaatttttaaggtaagatatataacttaaatgtttttttatgcattacatttatcagaaacatcgttatattattatagttgtattaaagggcccatttttctagctttgcttcaggccactaaattgaaaggaccgggcctggccgactcgagcaacccgtacacaatcatttcccatcccacgccgcgggcggcagcagcggctgcgacggcgacggcggcggcgggcggtggcggcagcagcgacgacggccacgaagatggagggatccggaagctcgagtggatctagccttcatcagtcccagcaagcttcctccatcccgaggttgagatgtgcttgccaaaaacgtgcggtgaatagggtttgcaaaatgtcagcacaatatagcccacacaggcagaatgtaaacacatttaatatttttttttttgcaaattgtaagcacaatgtagcctcacagtcatgatgcaatcacatttgggcacaacatatgaaaagatttgcatttaacaaacataatggttctggatagccatacagccagcttgttctgatagcaagcatatttatgaagtcatagcttcattacagccagcttgttctgataacaagagcctcaaaatgatataactaggcacaatgcagtcttcatcaacttcatcaacttaagatagcagcaaaatgagcattcatgtgccattacagccactacttgtactgtcacttccatctagctacacaaaatagacatcctgaaacacgtagtcgccgtggccgtggccgtggccctcgtcgtcgccgccgccgccgtcgccgtggctgtggccgtcgccgttgctgccgccgccacagctagggttagggtttcaacgaggaagagagaaatggactgctgcatcagctcacggttggtataccgtatatccactcacacaagggcatttaggtcaatatgagaaacggttgcatttctcgtcaccatattcaaattaagcccgccgatattgtagcgcgtggtctgcatgcacattaaagaaataatcaagttgtttaatgtaatttgttacacagccaatgcaagtaagttcaaaatacagagatcaaggccagcatattgttgcagagacaccaacattttcacgtagttgcagtgctcggctagtcgtcgtcgtcgtcgatggcga

SEQ ID NO: 47210 - DNA, 215 bp, Oryza sativa
agaaggatatatatagcatttatccatttgcatccataaattcacgctacaaagggggtgggggattatgtgatggttgtgtcatgtccgtttgcttacatattagcaactcgaatccctatgtaatatcttctgaacgagtcttaccacttgctttcctgtgtttgatgtcaatgccgtaaaaatcatttacacagtcatgataccaaattccc

SEQ ID NO: 47211 - DNA, 251 bp, Oryza sativa
aattgaataatatactcgctaaatatatgacgcctgaatttttaaataatatttgataatttttttattcaaaattttcacgtaaatataaaaatatttatatcatgcttaaagattatttgatgataagtcaagtcataataaaataaatgatagttatataatttttttaagaagacaaatagtctaacgttaataaaaaattaacggtgtcatatattaaaatataaaagtagtacatatccagcaga

SEQ ID NO: 47212 - DNA, 1501 bp, Oryza sativa
ttacaattaatttgtacctagtagtaattataagttataattaattagtagttcatgtgatgtttaattttatatatacggccaatattatatgtaacaaatgaaaaaaaaactgaaatattaatagttatatttgtagttattgatattgatattaatagtattgataattattaaatatggtacaaaaattaaattaaagttgtaattaattcgtagtaattttaagttacaattacttagtagttcatgcagttatttatttcgtaagaaatggaaaaggtataaatattcgttaagtagcgggaaatatatggtgtgcttaaacatatgcttatatagcatattgtaggtagttacgaacgaacaaagaaatgcgcggtactacgaagaactttgaaattggaacttttatatgagcaaattggttgaaaagaagaaggcaagacaaggtatggtactataatggaagatgtagtaaattttttaatagacagtttgtattttatttggtattgtaattaaagtccagttatataaatttatgtcgctgcaactagttttatactataataaattggtagttatgattaatttgattgattatgtaattaatcaagtgaagttgaacttagttctattaatttatcatgttatgattaatttatagataattttgtactaactgatagttacaaatattttgtatttaagtaaagttacggtccgttagataatttatagttaaagttgtaatatattaaaagtactaatccaaaattgcaatagtagtattgtttcagaggtcatatctaagtaggtacaaacaatccgtagcaaagaatatgatgcggctcaatgagtgtcattgtcctagataaagaatagaaagagctaaccaaaatgatttttaacttagcttccgtcaatgtttcttcggtgcacgtagtcatttgttgtattaaaattaattgatatgtataattaatttgttagttaaacatatggattatgcagtgaaataaactttgaggcagcaattgttatacgagcaagctggttaaaaaggagtaggcgggttctgataaacgcaggtaaatattttgtcatcatatttatgtacgatatgctatggttgtgttgttttaagtattacatactcttttacttaaattaattgccatagttatgtttaattacgtgttttaatcaattaatttgtattaaatttattgtcatgtgtctattttttatgtcaaagttgtagtaaaattataaataatgaattgcattgtcatgtattcgtaagtaaataatttatgtttacgtaattatttatttataattttcttattacaagtacatgaattttttataaataattagttattgataaagatttttttatcaaaaaaagtatgcgtgtaaactaattttagttgtgaataggacacgtttgttctgtaaatcttccttacggagtagtctgtgttgtctgcaa

SEQ ID NO: 47213 - DNA, 1501 bp, Oryza sativa
acaccacgctcgccggcttcgcccttccgtcactggcctccctgccgctgcggatccgcgatcgccgcgtgcgtcgggcacgccgtccattgcgttacccctccgatctctccggttgccttcagtcacggccggccccgtcttctagtcacgttccgccatcgccggtctaatcgcgagcgaggtcgtcgcctccgcaacgtcctcgttgtcgccatcgatctcatcgccacgactgacgatctcctgtagatgtgcgatccccacctcgtgtttcctcctccacatgtcttcttgatccaatgttgaaaccttcagctctgataccacttgttataaaagttagtcaatatagcggaataacgactaatcttcccgatcgcttcagtcattgatcatccaagacatgtcaaatgacgacacagtaacacacaatatttgttaacgaggttcagccgaagcctacatccccggggctctgattatggacgctccttcctaaccaatataactaatagctagctgctatgagtctatggccacgccgccaccatctccctgcgtgtctacgctacattgtagtcgccatggtgacattgtggttccccctctctacttaagagagatgttggattacagagtccgactctaactcaaccccctaacacatattataactccaagtccaactgtagctaaataggactagtatattcgacacctattctaacactattatctttaaggcagttcacagcaaggcacttacgggacgttttatatactgtctctacaactaactagcggcataacaaaagtgtctctactgtgcaaagaaaaaatctctacgaaccaattctgttgtagtggggattgttagcatgatcgaagctggaactaggatggccccgactcgacaatacaacaaaccatctctaataagatgtttggattaagccgttttattattcgtctctattttcagaatcacgattagaattaagacgtagtttgggacactttgaaattgaagcatgttgagacgttttggaacaaactgagacgtcttatggatgtttcatttctatggaagaatataatatatttttagttagaattaagacgtagtttgagacgctttgaaattgaatcgtgttgaagcttatgttgagacgtcttatggatgtctcatttctatggaagaatataatatattctttaaaaaataaaagcaacgtagtataaaaggaggaattataagatattttatagatggggtaaaagagaaaaaataacaatgcaaaaaaaacaggactcgagctctcaacctaacgcacacaacattaccagcttaaccaagtgatctagaagaggaacttgttggaaagttaagttactcaatatactgcaggtgtgtcgatttttttttgtttcctcctttttagagcaggggtctccgatcagatccgattaagagggaaccgtaggtccttttggtggc

SEQ ID NO: 47214 - DNA, 1141 bp, Oryza sativa
tgggacgagctggacccagggtcgggttgccagttcggtctgaatcatcgtaggcctgggttaaggcaggttcgtgagggttcacggccttgtttaataatactgtgtagcgctaggatcgtctttataaaatggctttgggcaactaagtgacttttaaatgctgtttactgcaaaacttaaaccctatattattacccccttgtactcctttgcattaattgtgcatctccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgattgtcaggcctgatgcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaagggttactcttttctttcttcggatttcaactaagtactagatggtcagctttgcgaagaagaagatgtcgtcagttgtttgccgaagctccggaagactgcaggatccgccagcgaagcgaaggaagcagtgaagccagctgtgaagcaggagtgaagatcttggagaacccgtcgcagaacctaagccaccctctagggtagagtcgtttgtcgtgtgtttccttgcttgtgtgtgtagcgcgtggtttgcatcggtgggttgtgatgtaaccatgctaggttgtttgcttaatcaacttgcagaataagcaaaacaaacaacacatcaacaaaaagagttagttcctttaaggtcctgtccctagctctggtctattctttccttgtatgcttcccctctcaacctctaccttgtgacagatggataatactggtaacaaaggctatgggaa

SEQ ID NO: 47215 - DNA, 1501 bp, Oryza sativa
ctgtgtatcaaagagctacaaagtatcagcccgcctctcccttgttctgggcccctaatctggaaaggtccagtccaagaaaaagctctctctaaaatctatccccctctctccgtgggcaaggtcctccttttatatcttaaggggataccacatgcaccatcccccccttttttatggggacttaccctaccttttcataaatggacggagatctgcatggttgccgttcgagtcaccttctgatgggacggcctgcacctacctccactttcgccgggagcaggcgcgacgtagaatcatggctgtctgctggcgacatgaccggtgtcagaatggtcacaaatcggtcattcttgtccacctcgtgtcagcttagcaatctgcatgttggccctccttcacactacattttgcctgtaatggttaggatgaagcctggcatatatctgatcaggactaacgtgccatctctgggaggtaacacgctagctccagctggggacgagcgcctagaagccctcgtcctgacgggatggggcgaggcgtgcgtcagaccgcctgtcgccacctaatcccgcgatctgaccggtctgtgactggtcacagaccggataaatgagtgcaatgcactacattacatgcgtcgtgacacgctcagccaagccgcaataaatgtggttaggtgagccccactgtgctcacctaccccatacacgcggagcgaaatcccacgaggggtcggggcgcctcggccctcggggccgaggggggtgcagcccgaccccctcggggggactaagaggagggcgaacacaccaccttcgggcctgacgtcccccgagggtgccaggccacgtgggcgattgtgtctgcctcaaacctctagtcatgatactcccgatcccatgtcaccaacagtagcccccggcgttatgccagggcgatcgccctcctcaagggaaatggtcgggcgtgacgccactcctaaggcccggtgacaggtgggatcggtctccacaattgggcagaaaaccaacggtcaaaaatcacgcacatcggcaatggtaactcggttgtcaataatgagcggtctcttcaagactgccacattactcgagtagcacacgaatctggacatggcgattcgtttcatctgaagatatggtaacgtcgcttcggttggcgagcgtaattaacgcgcgcatgatatgatctacctcgaccgccacaaccgcatatccacctcatgcgccgcaagcgggcgaatgggattagtggaagcgtgggcgcgagaaacgagggggcgaaatagtgggcgcgagaaacgaggagccgggcacagcgttggcaagggtataaaggcactgaggaagggatttgcttccttcctttcgccattattccccttgtctttgccgcttgcgccctaactccttctttcctgcgccctaccctagccacacgcgctcgctcttaatcttctcttcctccggcgcca

SEQ ID NO: 47216 - DNA, 361 bp, Oryza sativa
tataatagaaaaaccaaactgcaatcagttcatattgttagaggtggcaataatgttttctatgaagggatcctcttgctctgcaatctaagagctagttgtactcttggtttgcaattttccacgtaacactgtttctttatgatccctgcatgctgtttaagttgacactccatcttgcaacctctgctcaagtttcatgggcattctaccaatacattattgttattgatctggatttattcctgaagttcatatctaagcaatactgttctattatatgcattaattggacaaatatgacttttatgaagtccatgtaacatcttcataaaccttttttttttggtgaattgttttt

SEQ ID NO: 47217 - DNA, 1501 bp, Oryza sativa
cccatccgagctcaccctgaggtctcctcgggccaccatgtactgcgaggctaatcaagatcagcttcgcagagatgacctcgactacttggaagagcgaaggcggcgcgaggccctccgagccgcgcgctaccagcagagcctgcggcgctaccatcagcgtcacgtccgggcccgatcactctgcgtcgacgacctcgtcctacgccgcgtccaaacgcgtgctggattgagcaggctctcaccaatgtgggagggtccgtatcgagtggtcggcgtcccccggccgggctccatacggctggccacgggcgacggcactgagctgcctaacccgtggaacatcgaacaccttcgtcgcttctacccctgaggggggagttgggtgtcaggtttcgggctcgggccaaccccgcaccccctcgggcgtgcagggttggccgggggctgccacacatgcactttcttatttctcttatttcagaatttcaataaaagcagtttcaatttcctaaaggttgtatctgtgctgttttttccttttgaagaatcttgacttgaaatagatcacttgcgctcaatcctgccctcgggggctcgggtcggctaaaaatcgccaaacggggcccagaaccgagccgtgcctcggggcgtggtgaactccgggggggaatcggcaaaaacccacaatcgggtcacccataaccctcggtcaccacgttcccggcctggccagtctcgacatgtggatctccctaggcactgtcacgtcctgataaattcatcccgaaataaaattcattttctaaaaggaataatagaattaattaaaattcgaaaagaaattggcaaacactaaaaatacgtacaagaaaaattcaaatgtggcccggagaatttttgttaaattccccttggtctaaaaggagccctcaaaatttacttgaattttcagagcaccggaaataattattaagcaacaaaaacaattaacaaagtttattaaaaagaaaaacctaaaaataatctctcttccttctttgggccaagcccagcccaaaagtctccctttcctccctctttttctctccctctccttctctccctccttctcttgggcctcctcccctcccggcccactccctcctccctctctctcccgggctgccttttcccccccctcttccctcccggcctgctcggcccaggccgccttcccctcctctcctcctgggccggcagcccggcccaaccctagccgcgcccccgcccgtgcagcgcgcgtgcgcgcgctgatgccgccgcctgaccggtgggtcccacgcgccaggccgggcgtcgtccccttcctcccgcccggccgtcctctctccctctcccgtgaaccctagctcgtttcctcctctaaatccgctcgattcaagcacgggattcccaaattaaataggggaaattaatccccattgactcctcttcatttccccctaatttcccccttgaa

SEQ ID NO: 47218 - DNA, 465 bp, Oryza sativa
aattcctgcagcccagcacgtcaacatagttcagtttgcagagcaatgcatcagtaaaaggatgctgctagttcagttgcttttgattttagatattgatgccatatgcataatatcactcctagtttattttcgttcgaatttagttttgtagtactacctaaatgccttctgatatactaacttctgaaagtgaagtgcagctccgaatctctgacgagaactataaaccattcaccctcttgtggtgtttacacactaaaattcactcgttctaccaaacgcttctcccaagtgacccttgtgagctcttgagttttacttaccacatagatatatcacataaaacacatgtgtccattagaaaactagcatggtcagtcaccagcttcataaatcaaaaaaaaaaaaaaaactgacaagagaacaggcagtaccgtgtactgttaccttctccttcccagc

SEQ ID NO: 47219 - DNA, 1501 bp, Oryza sativa
cgtctcgcggcgccgcctccgtcatcgtcatcatagcggcgtgttccacgtcatcctcgaccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcaagccgctgcagccccgtcctcgtgttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccctgtcctcgtcctttcagtgtcgcccgtgcccgttgtgcggttgtcggccccggtacccgtgtatcggcgtcggcagtcgttcgcttgtgcgcgtggtgaccgtgttagtgtgtccgctcggtagccgcgtggtttccacgtgtgcagtccgtgtggtgtctagtggagtccgtttgtcggccactcgcctcggttgacacacgggatccgcttccatcgacccgtggaccgtctctgtgtactcggtctaccgtggtcctttttgttgacatgtggggtccgcatgtcaacggcgcagccttcctgtcttttcccaggctagcgcttacacatgttttataattgcaaagcttaattataataatccgcaaatctccatataacagcattaaacttcggatgatcatatcttggtcatacgaactccgaatcgacccgttcaagtctcttaatgtttgttataacctaaagaacccggtgctttctttttatgtactgttattgcttctttataggcttgtagctttgcttgtgtgcttcgcgtagcttctgtcgttccggaggttcccgaagcgtggttcgcggtcgtcgccgaaggttcggaagtccgttctctctgagcaaggcaagtcacatcatccttgagcatattgaatcccagtttataaaattatgttgatttaaattaatgcattaccgctttatttaaattcccgcgttatcactgttttatttagccatgcctatttacctttgttatgaccttattattgctattgttattattattcccttgttcaccctagattaaacaaaacctcaactagtgggtactctattcatggttccactagtatgaatttaggtagatgcttcgctgtttgaattagacaacattaggtggtttcacaactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaa

SEQ ID NO: 47220 - DNA, 228 bp, Oryza sativa
atttggtcggaagatgcacttcagttgggttagatctcctcacagccgaagtcgttgagtagcttgttgttggagaatccatctcttgaacccatctcgtcgaaatcctgaagcaccaaagtccccatacctagcacgccactgtcgacatatgatgtcgcaattctggtatttgcatagtatggggatcgtcggtgctaggattatgcgagactgaggtaaaagaga

SEQ ID NO: 47221 - DNA, 486 bp, Oryza sativa
aaattatatcaacagctgtaatggaagtctttcctcaaagtcaatttgattatttctaatacactcatatatatacataaacaacaaagcaatcataacaccatgcgtctaccatgtaataatgtatagtatataatacctgtatttgtcattatttagtggactctgcttagttctcctaaaataatatcaaccagtgccgtactctgaacaggcacaaagtatacacacttaatcaacccaataaaaaaaacaaatatattaccgtggttttctcaatcaagcaaacgaaaatactttaccgaccaaacaaccgcagcaagttagcaacagcaagcaagccagccgcccacttggagacagctggcaacgcccgttgccacccgtccgacgtggcgtccccatcccacttacttgtgggcccccacacctccatgattccctcgcgcgtgggccccaccctcctcctccttccgtttataaagc

SEQ ID NO: 47222 - DNA, 184 bp, Oryza sativa
aggggacacctatgggtataaatacaaggccccttaggaggagaggggccacggacaatcgacgaccaccttaatcaacatccaccacaatctacggaacaacagaagccaatatacgccaagacaagacgccggatattgacttcagagataggcatggctagtcccctacggtgtctccaga

SEQ ID NO: 47223 - DNA, 416 bp, Oryza sativa
cggcgtcatctattaaaaaacggaggtaggatttagcagctgatgaagtaccgagacacgcagatgctaatgaccactagaggaagacagaactagcatattttacccacttcatccatctcttcagaaactttcgctgcgtcagatcgaatgatacgagacggaaaaaagaagaagaatggcacgagaattggatattcttttacatagatggtagatataaggtcagaaacaaatccatcaggcaactcctccttaacatgttcgtgtactgtctcacagaaaggacgggttcagatcctcttatccatcatatatagttgactgtagaatgtgtaggttggatttctttcgtgtgatcgctctgtaactgtgattgcgtcaaacatactatctgttttcttcttccccaaagt

SEQ ID NO: 47224 - DNA, 796 bp, Oryza sativa
atgaagttgcaaaccttttaggcacctaccgatttgtatgtaatcaccaaaataaattcaatagaaattttggcataacctcccctcttttttgaagaaattttgaagcttgctcgggcagctggaggaggaagaagacatatatataggggtgggactttagtcccggttggtagcaccaaccggggctaaagatcccggtgatctttagccccggttggtgctaccaaccgggactaaagtcccacccctatatatatgtcttcttcctcctccagctgcccgagcaagcttcaaaatttcttcaaaaaagaggggaggttatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtgaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 47225 - DNA, 493 bp, Oryza sativa
tcgtctcgcgatttctcccctaagtgtgcaattagttttttaatttatttatatttaatactccatgcatgtgtccaaagatttgatgtgatgtttttgggaaaaagtttctgggaactaaacagggccatattcaagtattccagcagttttgtgaaaattgaactcaaaacgtagttgcttgatcatttgctctgtgtttgataatgtatacgacagcatgtttatgttgtttaatgttttactttggcaagcaacacatatatttagctatccacaaggttctctttcttgcacgctttttatatgtttcactagtggaatgtggaattcatgctttgtgatgtggtcattggttaatctttgcatagatattttccgcagcacaattgtgtgacatccagctacaactggatataactgaattcaactcaacatagggtcatatgtgggcttaagtgattcatgcaactctgttttcaatcttttcagg

SEQ ID NO: 47226 - DNA, 1078 bp, Oryza sativa
ttcggtctgaatcatcgtaggccttgggttaaggcaggttcgtgtgggttcacggccttgattaataatactgtgtagctctaggattgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaaaatatgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagttccttttcctcctttcccgtgtgctatttgcaaaatgtttactctttcttccgtcttcaaatttcaactagtactagatggttagttttgcgagagaagaagatgtcgccaattgtctgccgaagctccggaaggctgcaggattcgctagcgaagtggaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacaga

SEQ ID NO: 47227 - DNA, 1501 bp, Oryza sativa; identical to SEQ ID NO: 27117

SEQ ID NO: 47228 - DNA, 989 bp, Oryza sativa
ttatatctcgaaaaaataataaaaaacatgggacccacatgtcagctaaaaataataattttaaaatggtggccccacatgtcagctactcctcccttcttccccctcccttctctctcatattcatcgtcctctcttcttcatgtgcgcagggggaaggaggcgaggcgaggcgacgggaccatcccccacaccgacaccacccccagcgcgccgccaccgccggcatcttcgtcttcctcctccgccgtcaccgcctgcatcttcgtcttcctcctcgccgccgccgccgccgcggcaaccgcggcaagcaggccggcgacgacgacgtggagatggccgaggggaggaacaacaaggtcgccgacggcggcagcgccgatgactcgacgaccagcggcaaggcggacaccaaggtgtagctctggcgtctcaatcgatccatgagcgatcgagtagctcagtagcatgcaatcggctaagatttgctgcatgtgttctagtactagaagtaataatactccctccatctacttttgatagtgatatttccaaatctgaaaattttatttttgatagacatatttcaatccaacaacctatcatcttaataactttctcggatttaatgcacgactctccattcttccacacatgattggctacatgagcattgaaaaatgtaaatattaatgaatcgtttatttacgaggaatgactagtagcatgtttaaatagatgataagtagaattacttatccttggtctatgtgcaaagatgaaatatgactatcaaaagtagatagaggaagtattagctatcctaaaaggctaaaacacataacgtgtatgaaaggaaagtactatcctaactgaataaaacagcttttacaggcacaagtttaacataatatgtctgctttgatctttatttggaagttgtaattaaccatgtttgtaataacgcgataattaaacgagagtatcca

SEQ ID NO: 47229 - DNA, 176 bp, Oryza sativa
ttctttttaataagcatatacgatatgtacatattctcatatactattatactgttattttcttaataagcatatgcgatctgtcgacatattcacattgactattatatagtaatatttggatcattgcttaaaagcagtttgtgcttctttttttttttttgggtgccatgtgt

SEQ ID NO: 47230 - DNA, 1081 bp, Oryza sativa
tacccaagttagtgttttaattcttaaaacttgcttaacaactaaaatgtggaatggttggcctgggttggcttaggacgagctgggacccagggtcgggttgccagttcggtctgaatcatcgtaggccttgggttaaggcaggttcgtgtgggttcacggccttgattaacaactttgcatagttctaagatcgtgtttacaaaatagccctgagcaactaaatgtctttaaatgctgtttactgcaaccctaaccctttatgttataattcccttgtactcccttgcatttattctgcatttgtgggtgtgtcttgttgagtacggtggttgtactcagtcttgctcaatttttcccaagcccagatgaggagttcctggaagatgaaggcttcggtgtctagctcgtgcctgccgtcaagcgcctgtggtcgtcgccctagtcttccgctgttcctcgtttgtcttcgtgtgttgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacagtgagtaaaccaaatctattcgaatagccgtgctcgcggttattgagcaccgggacatgtattacacttggctagactctgaattcttaacttgtgtgggatgggttatcgcatgatgaatttttatgctgttggagtcacttcctgagatgggggaaagtggacgtcctcagaaaaccataacgactcaatggcgggaagctatccttgggatcacaatggatggtggacataaccgtcattgtttaaatacaaacactggtactaaaatttgatcagttgatgctaggtcttaggcttgtgaaaagaattacaaaattggctttgcgcaaaagaaccatagccatcctttgaaatacccctttcatatgtattgttgctgtggtggcttgcggagtacggttggtactcacccttgcaaatataaaattaatcagaaacgggagatgaagcta

SEQ ID NO: 47231 - DNA, 294 bp, Oryza sativa
acgtcagagatgaagatccagaagcgcaaatgacaagccatgatcgcactccgtgatataatgtttgacagtgctgttttttcactttgtaccggacatgctagtgaagaggaacctttccctgtaattaccagctacattgtacaaattagtagattctgcagctatatgagctaaccctaaccattcttctttacctaattttgcatgttttgaacactatgtgaatgcaattgcaatgcaacatcgctcgtcatgataaggcaaactcgctcgctaacctacctcgtcagg

SEQ ID NO: 47232 - DNA, 364 bp, Oryza sativa
accgggatctttagccccggttggtataccaaccgggactaaagttacggttggtataccaaccgggactaaagatcccggtggggcctgacatgacctgacagcattcgaaccgggactaaagatgatctttagtcccggttggtaacacaaaccgggactaaagatcaaatatgcccgttacccttttgaaccgggactaaagatcatctttagccccagtttttattgcatccgggattattgtggaaatcggccgaccgacgaaagatggtttctccaccagtgttgcctacttcaatccctacgagcagaacaccatctccgattatatcgacgacaacgagacgaagttgggtcggaa

SEQ ID NO: 47233 - DNA, 196 bp, Oryza sativa
tcctgcaccccataattagtcattgacaccaaaaaagagacgaaaatatgcttaatcaaagtgtttcacacaatagaaaatcatctctatccatacttttcttttctagaacaaatataaactaattggataaaaaaagcgtaaaatgattggtggattagactccttttctttcctagggatttgtattaaaaaa

SEQ ID NO: 47234 - DNA, 371 bp, Oryza sativa
atactcctccgtttcaaaattagtacaattttacaccgtttgtctaatttaattttttttataattagtattttatttattattattattattagataataaaacatgattagtattttatatgattaatttttttatatataaatttttaaataagacggacgacacgtgtaaccacggctaggatggagatagtacttattaacacatggttcccacagatacatttttttcaagtgctacattaacgccatgtggtataaaaactcagtcaaacaaaacacttaggctgtgtttagtttagtgcaaagtttggattttggttgaaattaaagataatgtgactgaaaagttatgtgtgtatgacaagt

SEQ ID NO: 47235 - DNA, 239 bp, Oryza sativa
cacattctacgtagttggaaatttcagcagtttgtaaacttcacggcataatggccaacacatagtaacaggaaaacaaaaaagttgacggctttctttttggcttctgagcatgtgcctatctactatctttacaaaaagaaggcaaccaattctgcgtcattcgatcagaagcaacaaaaatttctgaagagacgaatgaacaagtggaggctcctgtagttctgtcttcctctaga

SEQ ID NO: 47236 - DNA, 231 bp, Oryza sativa
ccacgtgggtaaaaagtggcaaatagttataccacctctttatctttataaagaaaacccagaaatatatttaagatgggtatttgaataattgctaaatctaaaagtgacaaatggttaaattccccggacaaaaaccctcccttctcccccaaatcacacctgattcgggggcgccgcgccgcgaatcgctcctcctcctcctctccggctctctctctctttcctcca

SEQ ID NO: 47237 - DNA, 1501 bp, Oryza sativa
cggttcggccgccacgtggcgccgccgcccctcctttcccccgtgccgctgacccgtgggcccgcgcgccgccacctcctctctcctccccgtgccgctgaccggtgggccccgcatgtcggcgccgcgccccctcgctgacgtcagccctggttaatattgcgcaataaattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccgatccctccgacgctccggtgtacttcgagatagtcgccgaggtccctccagcagcagagcaaggcaagtcatgcctgtcacttgaacatgttgatcctatattgcaaatgctctactgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggagtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttcccccccaacctcaga

SEQ ID NO: 47238 - DNA, 478 bp, Oryza sativa
attcctgcagcccccgtttgagtttattttttatacggttggttcctatgttctcctaagtgtgaaaaaaatatcaaaaaaataaaataaaaataaaaaaattgcatctctatgtactgtttaacttatatatgtcatttcatgtggttatattttgaattagattaagtaatttcatatagtggtagagtgcattatgtttaacatgctgatcaaagggttttactaaagaaattatggtctaattttagtgaaggtgcaaagtagactaagtggtatgctagctattttcagacttagctaagtggtagttcgagtttaaattttttttgtggttggttgtatcgtgatcctgagtgtgaaaaaaatccgaaaaaataaaataaaaatgacaccgttgcaactccatacagaaaaacagaaatggaggcggcagcgcagccatgctggcgccctcctcccttgggcggcgccagca

SEQ ID NO: 47239 - DNA, 1501 bp, Oryza sativa
gcgcaaggagtcggataaaaattgaaaaaaaaattcgcacagttggttgctaccgtgtctcctcttttctgttttcgcacctctttttttccttttacgtaattagtttccagtattaccatctactttacttcttctcttttttactaaaaattaaaaattactttaataattaaaaagttataaaaaaataagctataccaaaattgaatactttcacttaagatttcgaaacttcaactcgaatttcgaaaactttcaactacatatttgaaattttcaactattcttttaaaagttttaactaaattatttatgtgttttttctattgaactttgtttttagtgaattccctacctgttattatcctaacttaccgcataaaaaaggaaaaaaaaagataaagcgtcgggaggaatttttttcccaagaaaaaagcgaaaaaaaaacaaataaagaaaaatgaatcaataggtaggagagaaacttaaatgggccaaagcctgtaataataagagtaaaaaggtgagggtggcgggaacgaaccctggtggccacaatgaagattttcttcactaaccaagtaggcaagctgctacttgtgatcacatgttacatcaattaatacatatcctatattaacctagttttgaggtagatccaaaaggatccatcccgactattgagcggattaaaacaattttagcaacatgattctgattcggatgacggacgaaaaaaccatacggaaaccttacgaatttttttattaggtatagatgtcattataaacttttttaaaaaaattcaataatatagtttatgatgtaatatatcacttcacaaacccataacattgcatgatcaaatttaactttctacattttacaaaaaaaataaaaaaaaataattttgaatatacgttaattagttatagtttgcgaaagaacatgtattaacctgattagcgcctcaagatcgtacgttcaaatctccatttgaacgaattttagattgagttatttgagagctaaattttcaatttaaacaattatatatatccggttagatgtacatatcggataaataatacccttttttaaaaaaggattagttgtagtttaatttatttttccattgtgatttataaaaattgaatttgtgaagtgaaatgcaaatggcgaaatgacatttcttcgtttagcgtgaagcaacggagagaaggaacggaagcggtgggacgcgcgcgcacgccacgcgcgtagcgagagcgaaccagctcatccaccccgcgatccgtttttgctgtgccccaccgcctcagcgcctctccctcgcttaaaaccaaacccacacacccacctcttctctctctctcatcgtctccgcgactcagcccactcctttttttccaccaccaccaccaccaccaccaccgcccgccaagcgcggcccgcccgacacagcagcagcaggatcggcggagaggaggggggatca

SEQ ID NO: 47240 - DNA, 1501 bp, Oryza sativa
ccagatgaggagttcctggaagatgaaggcttcggtgtctagctcgtgcctgccgtcaagcgcctgtggtcgtcgccctagtcttccgctgttcctcgtttgtcttcgtgtgttgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaagttggtatcagagccttccttgaccctaggacgagccgtagatcccaagccttagcaatattttcaaaaataaaaatcctttgttatttgtgaaaactgtctagtctctctctgtcttgctgcttcacttatcatcaaaatctggcctttaaaatgttgtttctctttttgtttttgtttgtagatggccggcagcgttacccgtcgtggtttggacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggagactccttccccgccgcttgccagaacgccgctctcctcgccatcggcactcttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacctgaagatcctggagctgcgtcaggagaacctgcagctcaagaaggacctcgacgcgttggaggcgcagctgcaccagctcaagatcgcccagggagagatcagccgtcccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacaccggtgtgtggtgtatctatgtcggagcctgtcttattttatttgcctaagcaacttgaacattaatgaaccaatttaatagcagtgataaatttaagaataatggtagtcgtgggtggttagttttaatcgtcagctccttctctgtttgctggttccgtgtggggttttc

SEQ ID NO: 47241 - DNA, 1501 bp, Oryza sativa
cgccaccgccgccgccggtgagccgtcttccccccctcacctcgcgcccaccgccgtcgccgcccggggaagcaaagagccgagagagagagagatatagaaagaagccgggagggagcagagaaaaagaaaagagaggaaaggaggaaggagccgggaggagagaaagaaaagaaaagagaaaagagagaaaaagaaagagaggagagaaaaagagggaaaatagaaaagaagaaaaggagaaaatagaagggaaatttggggagaaattagaggatttaggaaataaaaatggtcggggttaatcgtagattatttttggaaattcctcgagcgtaatagtatttcggtcgaaattccgagttaattataaaaatatgtttcttgatcagattagattaaaattagtagtaatttagatataattaataactaaacaattagatgaattcttatagattattatagattatttttggtaatctctaaaagtcatcggttcacggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgacaacaaaatatttatacccgcaaaatagtttaagtcgaaattgggtttgccgtagttcgcagatagtaaagtttataaaaaggaatcgactttcacattcgactttcatttggatttatttggatttttatttgaattctaaccgaattcaaatcaatttttgcacgtaactatagagcccgagggagttgcggatccaagcgaaggcaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaataactgttttcgactggggcggacggaggatttgggtggtatctggaaaaggctagtaccgtccccggtcaattaaggaccgagccatgaagttaagcatgaaacaacccccgtacaaccgcacttctcgtatgggtatagacctagcggattagatagccgagcggaggcagtatccctgcatagatggttcacccctgagtgaggcaggtgcgctacgatgggacagccgttgaggt

SEQ ID NO: 47242 - DNA, 1501 bp, Oryza sativa
gggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagactacgcctgcggggttatgatgtaataattcgtattagacactcgtgtatgtgcacttggtatttcagctatgaattcgtgtgtaccagactacttgatctagggaaattgtactgtttacacaattgattcctgttataaaaacgggggtccacaggggacgacggggatgggcgacaaacttgttaccgtagcctgccgcctccaatgtcctcggtgccgcccgtctcaccctcttcaccgcgcgcgcctcgccttccccgtggaggactcgtcgaccaccgcctgcctgagctgagaagagatagagagagagggggggggggaaaagggaggcctcactgccgtctccagggaagggagcatcagcggcgccgactagtgacgtcgacaatgaaccactcgtctcctcttgtgcttgttgctccgagtcctcgtctttgcatggatacaggaaagaggagtcgggagagagagagaaagagggaggcgacgcgtgccgacggcgctcacccgtgaccccgagatacctcagcctttccgctaaccacgccgccctcacctccgtggtcactggcctctacagccaccccgccgcatcacccctctcccccacccccgccatggctaccttctcgtgtaagtctggcgtcatccgccgctcccccgaccacaggaggacaaggcatatggtgagctcgacatgccagccatagcccgcgcgcgtgccgctcgttcttagcggcgagcgagcaacgggcgagagagatagaggtgagaggggatagagaggagagcgactatgacaggtaggcccaacattttttaaaataaaaaaatactaactggattgccacgtagggccaaaaccactccgatgttgagttagggggtgttttttcctgtattgaaagtttagggtgagcgatatctgcttttcaagttaaaggggtaattcggttcactgcgatagttcaaccagtaattcatactttttccaaaagaaaaaaaaaacaaacaactttcaggcgtttcccttccttcctgacgagtttttggtgttcgtcttccctcccgcgcccgcgcctt

SEQ ID NO: 47243 - DNA, 1501 bp, Oryza sativa
acacaaacgacaatgttgacatacagatccacgtcttacaaacattataaaggtcttacagaaatgcagcggaaaacaaaagataactggagctaagccttgacttgaactgcagcgggaacaccactccacaggcatcctcgacggcacggacgaagcctactcctcggagaacccgccatcggacacatactcgagctctgaggttgggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcactcccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacagtagagcatttgcaatataggatcaacatgttcaagtgacaggcatgacttgccttgctctgctgctggagggacctcggcgactatctcgaagtacaccggagcgtcggagggatcggaatctagcgacatacaaagcaaacattgcaaacaggctataagactactgaaacagagaacaaaaccatttttaatggattctacacatttttcttgatttactgagacttgaatgggattaaacggagctcggatgaattagatatgaattttagaagattcactgtgtt

SEQ ID NO: 47244 - DNA, 1501 bp, Oryza sativa
gtggggatctgcaatgtaatactgattgttattatctggtatatagaaatgcctgtatttataagcatacgtttgcacatgattacacttaactaaaataatattatgaacaaatatgcatggatggtagagcaactgtatctacttgcctagctcagtgcaatgtgcgcaagtgcgcaacaaaattcaatactgtataaactaccttgagcatataatctatagaatgagatttttatatatttttctaaccagacaaggactatctgttcaagcagaagattataacactttgctgactagaatcaaacttaagacatcatgcacaactaaaaagtaagagcagcaataatatctattgacctagctcagtgcaacaaattcaagcgagcctctttcaccaaaaatacgaggagaacatgaaaataaaaaagggaaactcctcacctgtagtaccagtcatcataatgatgatatcaatggtctcagtgttgtgaggaagctcatgtgtcaaagggataagacgtccgtaccggcctgcttgaacacagtactgggttgcctccccagcacggcttgtaatctcttcctttaaccgctgaactgatcttccagtaaattgaaaggttctccaatcctcggcaatggtcccattaggagctgctggcacaaaccggatggttcttatctcaggcccgtcctggcgctgaaacagattcgccgcaaattagttgagatagagagaacaggatatacgttgaagaatccaatgcaagacaacacgaacagcaacggttatgtgatgccaacctgcctatgaactctgaaaattagtaggatttggataacacaagaacagaaaatgaaagtgttttcaagaagttcctaaaagaacaagaatgttacacattttcagcacctcgaccaaaagaactacagatggaaccaacaaccactttcatgaactcaatctaccccctaagccaaaattgcacaaaaaatctcaccgccacaaactcattgcaaatgattaacaacaaaggacgaaatctagcaagaacacaacaaggatttcatcaagaacaatgcaattgatgaaactctgctaatgcgctaactctgacgcaagaatacaaccagaaatggagcttggctgcaagaacctaggtaacgcagtaatgggctaaagaatcgctcccctgcccccaaccaattcgggatgtaccatggaagagggtgtagcgtgctcacccttgagatcggtggaggcctgggtacggaatctgccgaggggatggcctcaaccacctggtccacccagagcagcatcctgctgtatctatcgtcaacggtggcgccagcgccatggttggcgcgtaggttgcgccccgtggcgtgccggagcagcacgtcatctcctttcgccgtccgaaccgcctcccacgacacggactcgtcgtccagccggtcgaggttgataagcgcgacacggtggccacgg

SEQ ID NO: 47245 - DNA, 1501 bp, Oryza sativa
attgagcatatgtatatttcgcttcttttttgaacgatatgtatatttcgcttctggaatgggtggatgatcggtttgcatcaattatcatgcacaataaccattcgaactaaaaaactaaccattgaaactaacagcgcatgtcagaacataaaattgttcaggcgcacattctacttagtagtttgaaatttcagcagtttgtaaacttcacagcaagggcatgtacaagattcttattaacgagctctttacgttaacatgcaattgaatttggttagatggaagagagagaagcaagaagagacagacattgttgctacggttaacaactgcttaacgactcttagcctctataaaatgaaaactttgttgcatgagtgtgtgaaccataataaaaagataatatttgtggattaatggtttagagtctttggtgtctctaccattgtaaggatatagtctttaataaacatgcattatctaagagtctatatgggctctacatttaaatatgacctacaaaagctcataggcgactcttaacatttattaaatgatattttgttgcacgggatagagaaaaggaaagaagagtaatatatttttttggggggaatcttagcatttattaaatgatattttgttgcacgggatagagaaaaggaaagaagagtaatatatttttggggggaattaatgattaaaaagttttgttgtctcaacatttttaaaaaatttaattgttgtctcaactattattataggagaatagtcactaagtgagtactccctatatcctataatacaaggtatagtcaaacttgacacggtctacaaaactaatttttatcttataatttctcatatataataaagtttgtagtaacaaaattataaccatatgaaaataaatttaaatgtcaattcaatgatataattttttagtaagtaaaattcaattcatattgtactaaatgttagtcaaaatattatgaagatgaaatcttgaaatgcatgggcgccttatattatgggatggatgaagtatttattaactaagagctcatatcagactatctcttagtcaacagctaggaaaaaaaatgaagtaacagctagcaaccgtaaagaagataactaaataacgaattctcactagatgtcagaaagaaaaaaacattctgatcgagccaccgaggtcggcggaccaaaagtccatcggatgatcggagccggttgaacccatctgcattcctatccgccgtgccggcccagtctcgccggactcggcccgttacatcctacagaaagcggcccaacacaatccgtgtcggattcaacggctctttcggattccgacgcggactccccattccgattcgtcgcttgtgcgcacggcgcctattatataaccgaactcccggtctcagctgctgcgtctcatcgttcgttccatctcagcgcgagtcgtcgtcgttgtcatcgtcgtcatcatcgt

SEQ ID NO: 47246 - DNA, 1501 bp, Oryza sativa
ttgtaagaatataatccttaggaatttggtaggatttattcctaaacaactaataatgcatatagaaaaaacctaaggtttcaattcataaaataatcatttgtaaattctttaaaccgaatgaacccttacagtgttttctgaagtgatcactgactggttatgctattgttgtaacttcaagaacaacaatttagcacccgttttttcgaaaaaaaaaacaattcagcacccgtgcgcagctaggaccatcaacaactagcctccatgctatccttttctttttagataatagtgatatatcctactctagttgtgtttttgtttgtaaaccttgttttagtagtttttttttagaaatcaccggaggaaagagctccctcacttgaattttccattgataatactccctccgtttcacaatgtaagtcattttaacatttcccacattcatattaatgttaatgaatctaaacatatatatttatctagattcattaatatcaatatgaatatgggaaatgctagaatgacttacattgtgaaacggagaaagtaacgagtttgaggttacgtagggcgccgtagcgataaggtcgcgccattacctattttaaagatataagaaacgggagaaagcttgtttttcaagcagatataacatatctaccaacgttgttcattcgttcagcccagaggctagcatgatcgatgcagcggcgaagcaaacggcgtaggcagggttgttcattcttaaaagtcacctcatgcctatggttccaaaggcacataagcatagcaggaagaagctgtgtagatgagcagccggtagggtagtattccctctgtttcacagtgtaagactttctagcattacccatatacttatagatgttaatgaatctaaacacatactatatatatatatatctagattcattaacatctaaataaatataagtaatgctagaaagttctacattgtgaaacggaggaagtagacaagtttaacctcgccaaggtcctgatgatgtctgtgaagcctgttttagcagttttaaccttgcaagacaacgaactcttttcctgctggaaagtcgaagcaacgtaatttggtactactaccatcaagaatctctgccagatagccatcatacatgcacgaaagcgctgtcagattgtcaaagtaattccctcgagaataaaaagattgtcaaagccaagccgagtgcctcccattgttctagataccaagacccgactttccaacggggaaacaaaaaattatgctgcttttcctcctccttgcgtgccagctatcaccgttgaactgatacattgtcatgctgacatggttcttcaaaacaaaaaccagaaaaaaaaagaaaaaaggaagaaaaaaaaagagtatatggccggtggttgttggcagattatgtattgttgctgtgaattttaatgctatctcgtgtgatgaagcggtgtttacgttggtgcgtga

SEQ ID NO: 47247 - DNA, 1501 bp, Oryza sativa
  unsure (1)..(1501): unsure at all n locations
atacgtgagatagaagaaccgaagtctcacgcattactctaaccggagtttaaattaattaagctttacttattttagtattcaaataagtgccaaatacttatccgcatgtaaagtttatttcattcacattagtaaatgtcgtcattgtcaagtgcttgtgacaatcatcttgtaactcaatcacgcaagtaattttactattagatcatgaactattgagttgcatgcaccgtacgtctccctcacgcgaggccccctcaagtctctagcgtggaataaaagtatgctgaaatttttatttaattgcacgccagccagaattcgaactcgagacatttagctctgatactatattaagttgcatgcatcgaccagtttaacccaaaagcttaagctgatgagtaaagacgggcaatttactttatattccaacatggaccgtacgtttaattgatatatcgagcacgatcaataatcaacaatgccacatttcggtcttgtttagttccaaactttttcttcaaacttccaactttcccatcacatcaaaactttcttacacacgtaaactttcagctttccatcacatcatttcaatttcaaccaaaatttcgatattggtgtgaactaaacacacccttcattgcatggtagagtatgtaattgaaaaaagaaactactcctggctaaattaaatcgacagcgatgggttacatatatcctaattacatactctaccggctgatcgtccgcgactggtgagttgggccacagccaatggcaccggagttgtcgtcggcgccacgacgacgagtaccaccatcgccgccggcggcgggcgtagctgctcgcaccgagtcgatcatcgtcttgatgacagcctgcgcggggaggatgacggtcaccctgtcctcccggagctcgcggatcttgtcggagagctcggcggcggtgtacgggcaccggtcgttgtcgatggcgtcgatcagggccaggatgtaggccttgttgccggcgatcgacttcttgttgctggcgacgagctcagagatccaggtgagccgcatcgccatcgcctgcctctcgtccatcgtggccagcttctctctcatcctcatctcgtcctcttccatggctggctaagctctggctgctcgtggcttctgcctgctaggctgctagagtacgtgcgtgcgtacgcgtggacgatgagtacgttgaggactcttgctgctgctgatgccgccgcgatgagaaaagtagacagccaggggtctggttatataggcagcaaggcacgcggtgagcngacgagccagtcgacgattcggagcgcggagtccgtgtcgnaaccgaaaagagctcggcacggattatgttgggctcgatctgtttagaatgtactgggctaaggcccgacgcccgtatccgggccgccgtcaggggttagaattttgaaaaagtatatactccctccatattttaatatataacgccg

SEQ ID NO: 47248 - DNA, 1501 bp, Oryza sativa
cattaaaatacggaaggagtacgaggttccttatcttgtcatccctcgactaacaaatccgggttagtctgtgttcctttgaaggggttgggaatccctcccctccgcacgtaaaacggagcgatagattaaaacatgattaattatgtgttagctgtaaaaaaaaacttttaaaatagattaatatgattttttaaagcaacttttatatataaactttttgaaaaacacgcaccttaaggttgtcagtatcccgattcgtattcgaatatcttacgatactacgatcctatcaagccgaaacgataccgatcacacatagaatcctaattttcataatatctcgatcctactattcattactacacgatccaacgaaatcttaggtagtatcccgatgttagggttacagataaggcataccttctatcctacgacttatggaatatacgaatatggtataccttcacgtatacggatcgttcccgtgtacgtggtagaaatccgttccaaattatggaaattatctctacgagtcaagcgatgtccaaagtcctactcggaaatgtatagagtttctgttataccgtaccagatcaaatatcctcgaatctttcttaggggtcaatacgatccacggtataaaagggaccctcaaggaggggtgtgaggacatccaattccatcgccaacacacccaccatagtttacgaagccggagtgcgcggagccaagtcgccgggagatctcgtcgaactcatcgactacgatcttatcggtatcatccgtttcgtctattctctttgtaatctgttctcaccatcatcaatctcatataaactggactatggctattacctgataaggggcttgagccagtataatccttgtcttttgtctgcttgatgttgtactacgtagacccctgctccaacgtaccccaatactcaactcatctggtccgcgagtatcactcgtcgacacccgattctacgatccctacgacactacaaaatattatttaaaataacatggtttgaaaataatgtaaataaatatgctcaaatttatataaaaatcagttaaatatatcaaaaccaacgtggtttttctttgataaatgtctctatttgcatgacatatatcattactacatttattttatatagaatggctatatataattaatataaatattaattaaacttaaaaaagaaaatctcatattattccgatactacgatacgatattactttaaacaaaacgatactacctagtatctcgatcctgacaaccttggataagttaggaactaggaggattcttagacggttttaactcggttttatctgatatagcagctgagtcagcgtggaacccacatatcaggaagaccacatcatcaccctctttctcctcttctctcccttcctcctctctctcactctcctctgggcaagtgaagtctgccgcccggcggggcgaggcggaactcctcca

SEQ ID NO: 47249 - DNA, 1501 bp, Oryza sativa
tgcgagattctttgttcctgtccatgctttgcccgtgtggtctatgcaactcccaggccttttcacccactttacccagcaatgccccaaccaaaaatgccaaactcctttccaagttgtatggacagtggtaaaattgacacgaattttgataaatgtccttcaatcagactgagataatgtttggcgctctacccttttaatctactgaaaagtgatggagctatatatgtatatcatttttctttcactcgtttacttactactgctagtgtcatgcccatatattgcaacgggacatgataaagggtgtgctcgacacgttttcccaactctcctctctcgtttttcgcatgcacgtttttcaaactgctaaacggtgtgttttttttaaaaaagtttatatatgaaagttgcttaaaaaacatattgattcaatttttttaaaaaaaattagctaatacttaattaatcatatgctaatggaccgctccatttttcgtgatcactgttactgttaggaaccgctccaccgaacacaaccaaagatagcctcactagggtgctctctaactagtagtagaaatcaatctgaaccgttagatctcattttattgaaggatacagatctatttataccatcccccagttaacggtagtagaaacgtggtgggacattattattagaaaaaaaaaggtatggagggtataatcgttatttagaagtgattaaactttttttcttttttttgctttttttgatgaaatatgagtgatgcaagcgcaatggatgatcgcagatcgatttagctaggggaaaaaaataaataacaaagtaactcatcattattatattagtaaattattaatttatctctaataatattgatagtataatattatgagtagagagcaccaaagcatcgtttaaagaaagatggtcaaatggttttacggggtttagttttttcatctttttttgatcaatttcgtgtgggaacgtctcgtttttttgtgagttttcctacaggcaggtttccttttcttttgagtgagagaagtgcaatggttgggaagaaaaataatggctccatttttaaggtaatagagaaatactagtacagctgataagtctgaaacatgaaatggcgtcgggccctcatgtcagccccgtggttccatactttcatggaagctgtcgagcgagctgtatggctctgtgtagcagcacaacctgttccatctttggactttgcgaggatcggctgtcccagtgtccccctcattggcgcctttgacaaacagccgcacgcttctaaagctttgtcctttcccacgcccatggctctcccttcgccttcgcttcctgtatatacaccccccacccaccgagctctccttccacggccacaccgatcaccagctgcgcccgccaattgttgcaagaaccgagccctttcagctgagcgaattgagtctctctgaccgggctgtgtgacaa

SEQ ID NO: 47250 - DNA, 1501 bp, Oryza sativa
aaaagatatgcgtattattgaattacatttttgtgatgtgctgtgacatttgctatagtctccattttatctgtatgataggaccgaccatccatacatctgctgaagtgaatttttaatgccaattgtaaatgcatgaggtaactctttcataacctggtcctgtgttgtcattcagaaatcaggtctgttgtgttaacatgcacagagaaaagaagggttagtaatctcggactgtccgacattagcttttcggtacaaaattgtctccccagaactacttttttttaaaaaaaaaaactctaacattatacatcaaaccttacagaacaattcgatactacctggaaatgaggcattccatgcttcttttttttaaaaaaaagaaataaaacaaaacagaacaactcctaaatcctaattacatgatcgcgagcaccatgggacgaagcgcgggtgaggatggctcgcacgtcgtcgagcatctccttgatcccgtccagcgcggcgtcgacggcccttgactcgcggaggtcgcggatctcgtcttggagctcggcgaaggtgaaggggcatgtgccgtcgtcgatggattcgagcaggtcacgcacgtagcctctgttcctggctatcaaccgctcggtgtccgcgaggaggtccgagatccaccccagctggatcgccaccgcctctctctcagcctcgttcatcatggccctatcttgaaatgaactagcagacgatgatgacgacgatgacaacgacgacgactcgcgctgagatggaacgaacgatgagacgcagcagctgagaccgggagttcggttatataataggcgccgtgcgcacaagcgacgaatcggaatggggagtccgcgtcggaatccgaaagagccgttgaatccgacacggattgtgttgggccgctttctgtaggatgtaacgggccgagtccggcgagactgggccggcacggcggataggaatgcagatgggttcaaccggctccgatcatccgatggacttttggtccgccgacctcggtggctcgatcagaatgtttttttctttctgacatctagtgagaattcgttatttagttatcttctttacggttgctagctgttacttcattttttttcctagctgttgactaagagatagtctgatatgagctcttagttaataaatacttcatccatcccataatataaggcgcccatgcatttcaagatttcatcttcataatattttgactaacatttagtacaatatgaattgaattttacttactaaaaaattatatcattgaattgacatttaaatttattttcatatggttataattttgttactacaaactttattatatatgagaaattataagataaaaattagttttgtagaccgtgtcaagtttgactataccttgtattataggatatagggagtactcacttagtgactattctcctataataatagttgagacaacaattaa

SEQ ID NO: 47251 - DNA, 371 bp, Oryza sativa
attcctgcagcccggtggactactcgagaaaaggttgttaacggataattctcgcgaacgtcgtcggcttgatcacccgacatgattgcgagcggacatccggatatgctataagttgggtatgtgagcaggggcggatctacagtagtatgagcggtgtcaggcgacaccgacgactttcggcaaaacctatagcgaaattgtttatctatatattataacactatgaattaagtataattaacatactatgacaccgatagacatgttatgacaccaacgaatcgattttctgggtcctccactgtatgtgagtcatgctggccacatgatatgcacatgtaatgaaccaactttagcgcccctatagg

SEQ ID NO: 47252 - DNA, 951 bp, Oryza sativa
ttggcaaagccaaaccgatcgaaatgacacgaccactccacacgccctacctgatcatcgcttctctctctctcccccttttttttggctgagtggagagtgacctaatgggccggcctttctggtgcgggagcaggtggttgcattgcgtcaacccctgcgtggagacagcgtgatggcgcaacgacttcggggagggccgcgacggggccggtcagtgccagcagcaggcggatttgccattactggatgcagattacagttattcctgttcactctccttcactgcttcacagggtttttctttgaaacgaacagcaccaatcttcttcacagggttgagtagtagttctactgtcctgcagggtgcacttttactctcttaggcccggtttagtttgcgaaaagaaaattttcgagtgtcacatcgatcgtttgaccggatgttggaaggagttttcggacacgaataaaaaaaactaatttcataactcgcctaaaaaccgcgagacaaatcttttgagcctaattaatctgtcattagcacatgtgggttactgtagcacttatggctaatcatcgactaattaggctcaaaagattcgtctcgtgatttccatgcaaactgtgcaattagtttttgtttttatctatatttaatgctccttgcatgtgtccaaagattcgatgtgatgtttttggaaaaaactttttgaaaactaaagtgggccttatactccctccgtccaaaaaaaacattcctagcattccaaaggagaattagtggagatagagaatgactaaaatgcctttaatcactgaaaaaatagtaagagtgatacgtagtaaaaggtattgaagggataaaactttccgtttcacgtgttgagggtaggtaggacggtagaaattgatttttgtgagacaaaattcaaactctagaagttgagt

SEQ ID NO: 47253 - DNA, 176 bp, Oryza sativa
ttggcaaagccaaaccgatcgaaatgacacgaccactccacacgccctacctgatcatcgcttctctctctctcccccttttttttggctgagtggagagtgacctaatgggccggcctttctggtgcgggagcaggtggttgcattgcgtcaacccctgcgtggagacagcgtga

SEQ ID NO: 47254 - DNA, 1501 bp, Oryza sativa
aattgttcaggcacacgttctacttagttgcttacagcagttcataaccttcagaacaacagtgaaacagaaggtttgacgctttccctttctgaacctatatcaaccataaaaaagaagacatccagttctctgtcattcgatctgaagcagcgaaaagctctgaagagattaatgaagaagtgattgtcactttgtcagaggttttgctcctgttgttctgtcttcctctaggcagcatcaacattggggtatctcaaccgatcagcagctgaatttgcaaaggaccaaacgaaacaataacataagttaatactgatactacaactcacaaaccgttcaatattcacttattcagatatcatctaaaaacatctggggtcatcctttaacaaaaaatcagacgacttctcttccgccggcccagcaaaaacaaaaaagagtacacacaatgcatctaaggttgtcttaaatcaaaaaccattattcttagactgaaaagagctgactgagatggtctgggcttaaatcccttaacactactaccaagacaaaataacaaaaggagcacgaatatgtatgcaactaacaagtcattgttctgaatcaatgacctagcttcaggatgcctaattcattaataaaagaggagttttacagggatgcctgaaggcactgaactagcttcaggtattttagcatatgtacaaagactgaaaatccacaatccaaatctgaatagctacttattttcagctgatttctttttcttatgtacaagaatttccagattatgactgatctagtgcagttcattagaaaggaatcagtacagaatttgtcatgaaacatgcaacagcattacgactgatgtagcgcagtgcaatgtgcacgagagattcaagacaaaaggaatgaacatgtaaatatgtaaatctatcactataaaaggatatctcaccactcgtcccggctgtgataacgacaatgtccaagttcaacaacatattgttgtgaggcagattagtaaccagaggagtcagccgtccaaagaagcccgctcgaacacacaaaatggcgtcggagggccttctgatgcccaactcaatcgacagcaatgcacttagattgcgcactgacctaccgtagaataagaacagcctccagtcgtttggggagataatcccatcaggatttgctcgcacataccagatgcggtacacaccggataaagaactgggcggctgcaaagaacacaccagtcattgcaagcactggctaaggactaagaacatatgagtagtaaggaaaaaaaacaggaattgtgatctcgccaatttcatgaactggagcagagcaaatgcagagggggcaagaactgaagaaatgacacatggaaccaagaactgctcccaacatacagaatggataccttgagctaaaatgctactaacaattactttcccatgaacgcaggatgtacgattagcaaatcagcaac

SEQ ID NO: 47255 - DNA, 1501 bp, Oryza sativa
atcaatatgaattcgacctgcataatgtattcaaattattttaaacttatgatagcattaatcaaatgtaactagaaagtgaatcgaattactcaaaccaagacacaacactctcaagggtaagggcaaaccttgtctacactatggcctagccttttgagctgatctatcctgcttctggcctgcacatatggattgtacctacaagtagacagatcagaaagttctgaaacccaaagggatgaagcagtcaaaataatggcgacaacttcatggctatatcgcccaacacaatctgttgctatagaactgccagaccaaaagatcactagtgggcattggtgtactttcttgtttcattagctagtgaactttgatcacagtaattaatgagttgtgcatcatttgtactcctctaatgcaagtcttcaatttcgacaaaataactaccccgtggcttgctgacaatcgactaattttcaataaataacagaactctgccttcacttgcagttcagcatacttcaaaacaacactagagaaagcatcgccgtgcagctcatctcacaggtggtatagtatttccaagtgacatcagtagccagtgaggtaaatcaccttgctcgaatggcgcgcatgctggtgggctcgagccggtgtaggactgggtgctgtactcgaagtcggagtcggggcctccggggcagtacacgcagatgttccccgtggtggcgatgtgggggcaccggtgcggcttcgacatcacggcgaccacggcaatgcccgacgccgtgcgcacgggcttggcgcgcagccttgggagcagcgcggcgcggtcggcctccggcaccgccgcgatcatctccaccagcttcggcgcccgcgccagcccgtacctccggcacgcggccgacttgagcgcgttcaggtccacgtcctcccctcgccgcgagagctcccccatcgccgacacgatctccgcgatggcccgcacccgcgcctcctcctccgacagccccgcggggagcaccactccccctctccccggcgccggcttcctcctgcgcggctgctcgccgccgccgccaccgccggcggcggctacggcggtggccatcggtggaaagggttttgggtctctcggtgagagctcgggatgtagcgtggcgtggcggcgcgggtcggaactcggaaacggaatggggtttggagtttggactcgggtcggtgttgcgctttgcccttgtacacgtgccgtactagatctcggccccccgcacagccgtcggatcgtggtacggacgtctcagataagaccacgtcgctctgcaacgtcgtagtagcctggaaatactctcccgaattaaaaactttggaggacgaaactagccttctctccttctctctcgtgttctctcccaatctcttcttgcggcggaagcaaagcgagaagcgaggcgactcttctccggcggcggcggcggcggaagcggcggcgaga

SEQ ID NO: 47256 - DNA, 195 bp, Oryza sativa
acctaataagtatatctgtccatgatgcttgtgtgttgatataccatcagttacagaacttagtggacagtaaatcaccacattagttcacctagccacttgctcaccacattagttacagaacttaagtgctcgtcgattagtattagaaacaagaaaatgaggttcatcactcagtatctttatgccttttgt

SEQ ID NO: 47257 - DNA, 1501 bp, Oryza sativa
gctgccgttaaatcattacaccagcttctgctcattatgctggtttctagatgagttatccgttttattttgctgttcattttcttatttcacaaaaaggtgacctcagatgtttttagatggtttctgaatattgaatggcttgtgagctgtaatatctgtaattaacttgtctcatcgttttgtttgtccctttgcaaattcagctggtttggggttgacgtgccccaatgttcatgccgcttagaggaagacagaagaactacaggagcagaacccctgacagtcacttgttcattcgtcccttcagaaaattacgctgcttcagatcgaatgacagagaactgaatgtcttctctctctctctctctttggtatcaactcttctgtttcccggtcattagatattactggccattgtgctctgaagttcacgaactgcattaagcaactaaggagaatgtgtacctggcaattgtgtgttctgacatttgctgtagtttctccatcgttatctgtgattctgtatgacacgagtgatgatcatccatacatttgcagaagtgaaatgttatgctcaagtctgaaatatagatcaggcaactctgcaaaagctgatcctgtatttttcatgcagaagggttgttttatgttttcccttttgtctgttgcaatgcatccatccacgtactgaaacttttatctgttaatgatatcggatttgcaccttgtttggtagaaaattgagccctcccagactcgagttatagagtcatctgggtgcaggttccaaattaattactaattaccgctgcagtgtatttcagacttgggagctgcagtatttgtgcttcccttcatgtccccagttttcagataggagtatgaatttactgttctgatcagttttcgcagtcttctttgcgatcatagaggatcacagcatgaaacattttctgtatcccagtcagaagtgaaatgttattctcaaatctgaatacatcaggcaactctttcagatatattgctctgtagttcctgtgtgtttgtatagaaagattgttttgaacttctgattttccccttttttttctacaccaaaaacgcagtcagatgaacaattggtggttggttatggatatcagcagctgcagtgtttcagactttggatctttgagcaaaaacaatttattttaattccattcacttagatacagtgcattgtacataagagtataacatcagaactaaaaaaaaaaaatcaaatcagtactgtactaagtgatacttaaccacatataacgcggctcatctggtgttgtgtcccgtcgccgccgaatcaccgatgccccttcctcaccggcggtgccactccaatcaccggcagaagcgtagtcgtcgacggcgcgtggaatgggccgaacccaccgactagtgcagtgcggcagcgctcgccgcgccggcggcggccgtcgtggcggcgttggacacacctgagcaa

SEQ ID NO: 47258 - DNA, 1501 bp, Oryza sativa
ggaaaaggatttgtattggccggttctaaaaagaaaaggactcacgtgttcgacaaccgaaccacgatcatgcagtgggtggtgttcatggtccaccgtacagtacatatatgtatgagaatcagggtttaatctggcggaaaaccgacaaatcccgaaaaaatttcgcggaccaaaatttgaatacaaatccctaagcttactgatatgttcacaaaagccggtcagcttcggcaaaattccaatagaaaccatcaaaatttcaataggaaaccaaaaggtaaaacgtgctgaaaactgtccggttttatcgaaaagccgataggtatcttcgaaaaaccgataagaaaaccaagtttgttttttgttagaaaaatatagaaaaaaatgtgataattgggaaaaaaaatcgtgaaaacgttatttcctataaatttgataacctcccatcgacatacccacgatatgtaatatatattcataaaagacagttcatatcactcaccaaccatcggccaaatagaatgcccatcaccaaatacataactctgtgaccgatatattgcaagaattaatatatttccagttgtttttcttccctgaagaagcatgtcatacaagctgctccttcagaagttcactattcgccgggcttcagaagttcactatggggtgcattactgacaattcaaatttgccgcagttaattttgaaatttggatttgggttatgaaatttggatcgtagttacatcatgtattttcttggacctactgaaagttgctctactgccaaagtgccaatgctggtttgggcctctctcagcgaagccttcatttgggcgcaattttgcaaatcccccaaccaagccatttctaccgccggccgtcgcggcgttggacacaccgaacccccgagccgccgccaccgtcaccgccgccgccacgcgaggtcggcacgtcgcagaatgtatctgggacgtcgacctgcggccgctgcctctgttgaggcctctactacagctgttcgccgtcgccgcgacaggacgaattctcatcttcttccgctccgttctactcgcgcatgaggtgttcgttgaaatgcttgggaatcgttcgcttgctaatctggttgttttttttttctgtcacagggaagcagacaatcgagtatgtgtatggctttccttctcctctacttaccagtagtcgtggacgacgaaactggctttttcgccgtggcgccatggaccttggtgagcgcgccatggtcgggtgcagccggcagctagctatcgttgcttccggcgcaacgagcacatgacgtcatcgagcatgtgggcccggaggcccacctgccagcgaacgcggggactgcggccccacctgtcagcgaagggggacaactcctttaaattgcggccgcgcttggcgcctagaatcccgagccgttaccgtcgcaacgacctcctctcctcccttcgctctcccctcgccggagc

SEQ ID NO: 47259 - DNA, 175 bp, Oryza sativa
ccttgaggatgtagattctgtaccatctaagatgtcgaacaaactagttaatgggaacaataaggtttgatctcgctgctcctataattttgcttttttttttctttgttggtttggcactaatttattttgttggtttgacactaatttatcaataactcactggtattgtagg

SEQ ID NO: 47260 - DNA, 1501 bp, Oryza sativa
cacttcttcattaatctcttcagagcttttcgctgcttcagatcgaatgacagagaactggatgtcttcttttttatggttgatataggttcagaaagggaaagcgtcaaaccttctgtttcactgttgttctgaaggttatgaactgctgtaagcaactaagtagaacgtgtgcctgaacaattgtgcgttctgacatttgctatagtttccatggaagtgcatgattcgattggtcatcgttttgcagagtgaaatgttatgctcaagtatgaatgcatatttctcatgaccttttccctgtattttcgtacatatgtactgctttgtgtatggcaatgtattcatgtgccaaaagaacaaggcttaattttcttggctttgcattttggtagagaattgagcctcaaatttcagagccatttgggtgcaggttttcaatttcagatttagagtaggcttactgaataccttacttttgcgtaggtatatgttctgaaaaaacggagcaactcttgtgtttcctggttgttagcttcaatgcagacatcaaatcatctgtttgttatccctggtgctgtttctccctgacaagaagctgtgtatgttttggcctttatgttatgaaactttcagactgctgagtgctgacagcattaggtactagaacatatgcctgaacaattgtgtagtggtattggttataattttcaccttcgtctctgtgactgatagcaagaacatatggctgcttgacaaataaattccgcagtcaatttttcgaagttggatttgaattgtagaatgtggatcgtagttaacatcatgtataccaaaagctcagcacagagatatcatcctgtgtatttgttgtcgttctagctacagtagtaacaatgagtattttgtccttcaacctgttgaagttgttttcagttgttcacaaataggccatatacatttgttgagaaaaaatatcatccgagggcgtttggtctagtggtatgattctcgctttgggtgcgagaggtcgcgagttcgattctcgcaacgcccctattttactttctttttcataatttcatttagtgctgactttgttgcaactttgaactttcatcatgtagaattttcctgaatcctgatgtctactcacaaattatcttacgagccagtctttgaaattcatttggatttgaattttacgcaattttatactgaatcacttcctactttcatttagtgctgacttgttgcaactttgaactactttcatcgtatagcattttcctgatgtctactcacaaattatcttattaccgtattacgagtcagtctttgaaattcatctggatttgaattttacgcaattttatactgaaccacggaatcagttcatctttttttagcattgaaaaagttcaggcctctcaagcttggactgccacttgctccacccaacgcgcgagtctgtgtgccgccgccgccgccgccgctccga

SEQ ID NO: 47261 - DNA, 466 bp, Oryza sativa
ctgcacccctacagcgtctacgccgccaccaaggcgtgagtgcttctcacttcttcacctttcaactcttcatcagtaacgatttttctctgcgtgttcttgcttactactactacatagacgaggcagaaaattattttatgctttcagtgagatttttggtacaagctttttagtttttgtgctctctcagatcagttgttctggcatggaccacggaaatggggactggcacagttagagtcaattaaattcatacttgattatatactactagtataaaattatgcttccatattgtgatttgggtttattgatcgagagttagtggtcatgtggatacaaatgtccaccaacattttcaggggttttcagctagaagcctagaatagagcactgaggtttctcctgggggtttatatgtagatggagaacttgttggagggtgtaggattatgtatatagg

SEQ ID NO: 47262 - DNA, 159 bp, Oryza sativa
gaatatcaagctaagtgagtttcttggtaatgcggctataggcgcactgcatctggattttgaatgtggaagggtgagtttgaaacttttttttttgttaaaaaggaaattgttttaggttagaatatcatggtttgatcattagctgtatgttgcaga

SEQ ID NO: 47263 - DNA, 230 bp, Oryza sativa
ctctctctctctcttttttttttttttccctttccttttcttttagaattcctttcggactccggagtccgggtccgattcgtccgaatatatcaccacaccacgctacgtctcaatctcatcgatcgacccctcgaaccaaccaccgtatcagccatcgccatcgtcgtagtcacggtctcatggacacacgcacacgcacgagctgacgagcagctacaaggtcgcca

SEQ ID NO: 47264 - DNA, 1495 bp, Oryza sativa
gttcaggggcaaggagagggaggacagtgaccacctcaaggacatggtgctgctccttgaggaccctgccctcaaggacatgaagcttcgggccaccctcgtggcccgggctaccatctagagcccgtatcaatcttttatccaagtctaggactagcccagcctggtccggcccatcttatcacgctaactgctagattgatcgcaccatcatccttcaatgaaacttgcctcaccggggaacgaaggaattaagtcagtggttgcgacggcggtgttgtgccatattggcgttgcatgcgcctggtcaaggaggcggtgaatacacccagacgcggatctgcattcggtctttgaaggcccgacatgcagcgatggcgccggcggcgctgcgttcagcgtttggcggcggtgctgagttcggccttcggcgtggtgggcggcggcgctgacggtgggaaagtgccgcgagcccgcgacggtcgtgcctcgggcgagaaaagtggaggcagcgcattcatcgttgctagggatgaagcatacggacgtatcgagaacgtatccagatttgtttttgctagtattttagtacaatatccatgtataagtcggtttttaagttcgcttgcttttgaaaatacatattcgtatttgagtcagtttttaagatcgttcacttttagtaatacagaataaatcatataagaaatctatttaaaaaactcgcatgctaacttgagacgattgaactcctaactgtagataaaccatatacccgtgacgggcatagtctattttaatcttattattgttatatggtttagttaagttaaaattcattgtaggagttcgcttggatatatatatatatttttagaaaatcataagctgcagttaggagtctgatcgtcttaagttagcatgcgagtttttttaaacagatttcttatatgattgtcttaagttagtattttggtacgtcattcgtgcatgattcggtttttaagttcgtttgcttatggaattacatatatgtatttgagtcggtttttaagatcgttcacttttggtaatacagatagaatcatataaaaaatctgtttaaaaaaactcgcatgctaacttgagacaaccggactcctaattgcagctcatgattttctaaaaatatatatatgcaaacgaactcccacagtgaatttcaacttaactaaactatataacaataataataagattaaaaaagactttatccgttgcaacacacatacatttttttagttattcaaaaattgtaaaaatcgccaatacgtatgggatacttatccgtatccctttgtgtatctgatacggatacgtcgttttctaatgtatgtaggaggcgtttcggtttataaatcagaacacaccgcgcccttcgcccgttccttgtcgccgaacgtatatacgtgcccgggttctccagcgaatcatcgaatcaagcgacgacacgaca

SEQ ID NO: 47265 - DNA, 705 bp, Oryza sativa
ttcctgcacccccagttgcacgatatccacaaacaaaaatagagagggatttggtaaagaaagccataaatgagggaataacatcacctatcaaaagcatccagttttttcacacatccgaagctggaactatcaacatcattgactgaccggtcttaaattgttttgtattatgttgcgagtttagtatggctgcaattgcaagttgtgcaatggttaccaaagaaacggcttcagtcaacagtagatttgatactcatgttcctgatatagtaatgtatatcattaatatataaaattcagtcttcttttcaaccttttcactatagttatatttgaaagtttttcacttaaaaaactatcgaatgtactcccaaaagaaaagctgtgaggctgttatgcatgtatatgtatagtgcaaagtaacgctgatggcctgaaatagtttgtgtgaatgcaaaatgtaaattgacaaaacatgagccagtagcccagaacatacatcctcgatgaatggcatggcatggtatgccaacctctcagattatatatgtcttatatgatatccttttgattcagaaaagaattagattaggatggattcttgtcatggttgattttatgagttaatttttgttccctgagtaaaaaactgttccttctccttttggtcactaaaaaaaaactcgaatattagggaaggac

SEQ ID NO: 47266 - DNA, 1501 bp, Oryza sativa
catagaatgccttcccaaagttaagttatgttaccaaacatgtatatattattcttccaggcaactgtttggtgagcacttcgtggaggaggactgttaggactagataccaacttccactcatttttctctacatcgtagcgataaagatcaccataaacaaaggtctgcagaaatagattgtggcgaggaaaagaaatactatttcagtactcaaaaacctctagaagcagaatagaggcaaaaagaacactagatgaacatatctcattcaaccagcagtgaaatcgtgaaggatatgtctcccaccttgctgccattgtagaactctcctccatacagaaccaattctgtatctttcaggggatttattgtaagctgcatttaagaaggaattaacttggtcagctggaagatcatatgcaggtttatttgttatagttaacatttagagggaggatctctgtacaacatcaaaaactttttccaacagttaacaaaaaaaaaaacaaaacgaacatctatcttttaacacattttgcccctgaattgtaatttgacatcacctatccggaactgaaaaaccaatcggttcagtatcaccaaaagatcatcatatttgatcaaattacttcataaaaaaatccatcttgcctgaagaaatttattaatcctactggagtatataaattctaagcatgcaaacatgaccaccacaagcataaaaatgatacctagtccacttcaagtacataatcacaagaataccgaaagattaacttctttagctggcacttgctctaaaatgtcttaccgagcaattggaccggggagatggtgcagggacattctcatctatatgtacctccttcttcttagcctcctccttttgtatgctcctctgcaatgaaaaataaccagagcaaatagataaatcagcaaaaaaaaaaagttcaaacagcacacatagcaacaccaaactcatctaaaatccatagctgctacgcaacgaaatgtgaagggaaaaaggtgagccagtgcgaaaatcgcttccaatttttcagccaccggagtgcatcacgagacgcagaaggtggtggtgagcaaacaaaaccgcacatggagacgccgatcgagctagagcgcactgagcgagcgtgaagagctgacgcagaggaggggggcgggagggagggagcacacgtacgaggatggcgtcgatgtcgtcctcctcgccgaccttccgggcctcgcggcgggcgcgcttctcctcgcccttggccgtcttccgctccgtcttctccttccccttcctgggcttcttctgcttcttccccatctcgccccgccgccgccggcttctgtctctctccccgcgctcacttgctgccggaggcggaggcggaggcggaggcgtgcctaaaaccctcgtggggagcagcagggacaacggtggcgccggcgttcgcaccgtgggccgacggcccatcttggacttagt

SEQ ID NO: 47267 - DNA, 731 bp, Oryza sativa
tatagggcgaattcgagctcggtacccggactagtctaagaaccacgtggatcggatgcgttgacaggtggatgggatggattcgatcgctatcgagtttttcgtcacgacttggctcattgctgattgggagttgtgaacacgtggcaaccaaaaacgtaggtgttgttgagattttagataaaataaacctttaccttaacaatgctatcaaaattttgacagaaatgtttatatgtagaccaaaatttggcaaaactaaactaaatgtgtacataactagataactttattaaaaaattgtatagtttaaaatgacatccatatgaacagcctcatagttgtctcgtcacgcgtttatcccccatcgtgtcacaacataaaccggagagcgtaagagcatgtctaataggccaaccaagatcggcgatagcgtgatcacgtcagtctcactgatatgctggaggagggaatggtagagcgagaacacgagtcgacgaaagaattatcaccggctgcaacacgcagtacaataaagaaaaagaaataagcctgatggagattggttcatgcttaaaaatatattatctgttactacaaatgatatgatagtaataaagaccattgctatatgagcagcctatactaacaggctatagatgatgtggttgtcttatagtcagcaagttgacgatattattaaatctgctttaacaagcgaaaacgttccc

SEQ ID NO: 47268 - DNA, 332 bp, Oryza sativa
ttgacagtgtcctttctctcatgctgtcacgttcgatggccatgcgatgcagccccgtctgtagacacatcttcataaaattgaggtgtctgtttgctctcctcgtaccatgcatgtcgtgtacgcttcttggccttgctgaatgcgatgtttttcttctctccttgatctgttgcctgttgctggactcccaagccaccaagtggcaaaaaggatttgcaatctcagctcctatttttacacgatcttggctggcagaaaggatgatatgataatatgatatgctcactctgaatattcagtgcatcttactactatctcatttctgcagt

SEQ ID NO: 47269 - DNA, 1501 bp, Oryza sativa
agtctatttcaaccgttttattgattttttttgtctaaaaagtatatgggatttttatttgataattgatagtattgatatctaatttggaactcttatcgggatgatggtcatatcatgtacattgctttcttattgcctgacaagaattctcaaccaattatgagtatgactctcgtcccaagttagcatgcgtgattttagaaaggatttttcttatacgatttttatgtatttttaaaagcaaacaaacttaaaaactggcttaaatacggacgacgtaccaaagtatcggtgaaaacatttttaatttttacaataggaaagctcaaagttgttggcgaggacgcatgagagagctgcctccttgaactcttgcagcggccgcagaggacaaagttgtgcaggcacggtctgcatcaccctgacgaatcgtccgatccatgcatgcgtcctcgtgccacgggttacgctcgtagccatggtctccgtcgcgtctatggcagtggaacgtcttggcccgaacgccgcttttaaacattggtggcggcggcggcagccagccggccaccaaaaaatcagcacacggtgatctactattacgttattatcacacgtcgctgcctctcggatatattatgatgatcgtatatcgtatcgagccttgcgttttggaatggatcctattccgtttctcacacaagaacgcgatccgattgaaaattgaatcgggtgattttgttcgacagaaatgaaaacgttccatgctttttaagtagtagagaagagaagatataaatataggtaatgatagaattagaaaccaattcaaatacggatgacgtaccaaaatctcggtaaaaacaacttcaatttttataatagtatagacagagattccggtcaaaaaaaaatagtagagatagggatatggtttagttaagatgaatttattgtgggagttcgcttgaatatatatatttttagaaaatcatgagctgcagttaggtgtctgatcgtctcaagttagcatgcgagttttttttaaacatatttcttatatgattccttctgtattaccaaaagtgatcgatcttaaaaactgaatcaaatacagatatgtattttcaaaattgaatcaaatacagatatgtattttcaaaatcaaacgaacttaaaaaccgactaatacacggatgatgtaccaaaatatcggcaaaaatatcttcaatttttataatagtagagaagagataggatgagatgagacattctagaatttttttttgtttttaatttttttattaaaagttttacaaaaataattttccattttgaaaattgacagaagtagtcgccttaaaaatcgccatcccaaagggcggcgaaagtgacgtggcagacggctgttcgctctcgggcgacggccgtcaacgaaatttgcaggcggcccccttgctgccctccgctagggcgattttgtactgtgcggggggccgcc

SEQ ID NO: 47270 - DNA, 179 bp, Oryza sativa
cctcccacctgattccccatcccccaccaccacccaaccaccgcaaccgcctcaacgccgccgccgccgatgaggacgacgagcagattccccccacgcggccgctctcctctcctcttctcctctctctctctctctctctctctctctctcgctctcgctcgctctctccggcgaga

SEQ ID NO: 47271 - DNA, 1501 bp, Oryza sativa
accctactcctgtgtttttgtggatttgtgtatggacaagttacaaaagattcacttcctttcccctctgccttccaaaagggaaaaaaaagttctctctctaaatgggcaaggtcctccttttatatctcaaggggataccacatgcacctctctctttccaaactggactgttctttttctctttaatgggcggagatcggtacggtttccatccgggagcccttctgatgggacagcccacacctacccccacctcccccgaagacggagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttccccagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagatttgtctcgcccggagatacggtaacgccgcttcggtcggcgagcgtaattaacgcgtgcacgatacaatccatttcaattgccacaaccgcatatccacttcatgcgccgtatgcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgtca

SEQ ID NO: 47272 - DNA, 280 bp, Oryza sativa
tgtctgtgacggtaacctggtctagcttgtattagtacagataaagtgaggattatattttatgttcttgtcataaacaattactgtaaatatgtggaagaacaatgtcagggaagaatggcggagtcgttaacactcatctttttatttgatatatggacctgcagccgcggctgcaaagacatgaagggatggcagcatacttatgtttataactgaatagattaatagatccaaagaaaagtttaatcaaaataataataataataataagccaaca

SEQ ID NO: 47273 - DNA, 419 bp, Oryza sativa
ctatagggcgaattcgagctcggtaccccaatgtatgaatgtatttggttgagaggttgcacacatctgatgagagtggctttgattaggactaggattcattgttgtgctgttgtaatatgacttgtgatgtgcctgcctatatgtttgaattgaagggaagggttttgttggaacaacagttaaaagttccttcttttgttaatgacttcacaacgaatggtaaaattaggtgagctttacctgggtagttagcctcatattggccatgttggcttattattattattattattttgattaaacttttctttggatctattaatctattcagttataaacataagtatgctgccatcccttcatgtctttgcagccgcggctgcaggtccatatatcaaataaaaagatgagtgtta

SEQ ID NO: 47274 - DNA, 1501 bp, Oryza sativa
ggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgtccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatgacggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcatacggcgcatgaagtggatatgcggttgtggcaattgaaatggattgtatcgtgcacgcgttaattacgctcgccgaccgaagcggcgttaccgtatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttccctggggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaagg

SEQ ID NO: 47275 - DNA, 270 bp, Oryza sativa
cagcaagcaatgaaagagagaggaagagtgtttattttttttaccacttcattaaggaatgatatataccaattcgatgaattgttgcaaatcctattggacggatacctgtgaaaataggtagaaaccaattgattaactaatagtccttgtcatatatcaggatgaagaaaaatctagcaaaatcaaccacctgattggaacatgtacaaagcaaaaagaaaacgattagtgagggttaggagcgtgcttttttttttccccacaagg

SEQ ID NO: 47276 - DNA, 1501 bp, Oryza sativa
aaaggcagcaaattagtctacagtgttcagatgtgcaggtaaaaatgttagtggattgactctatccttgggaaacagtcacacttaatgagttgatagtgcgcatcacaagtccctgcatttttagtacaaggatcttgtttgcttgactttgtgtggttaggcctaccctaggattgatgccttggtagaatacttatccaacatccatcgtggccctattgctgttctttcacatgtagaagtgttggatatgctaggttgttgatttgctattctttttactcaccatgctgagtaatgaaattctgcatgaggaatagtgtaaccttaagtttcttttacatattgtttcttgtgtcatcatatgcatttctttttagcagaggcatactatgttccgcagaaacttgtgctctgatgatttgagaattgagatactcaaggcctcaagggatgatatggataccacaatatacaacaaaaagttcgcatggcaattggatctccttgatgtaattggctgagatcaatataaagcttccattatctaaaaaaaatatactacaaaaaaaatcaacaactagatgatgcttttgaaaaactcatgatctcctaattctgaagtcatctacttttttttcctgttgttcttactctacgtaacattgacaatagtcatggtagccagatagcttggtatggtagctttaagatcaccccgtatgagtatgaggtataatgcatcttgttcatatggagataatcaatatgttgaaaacttggcactttgcaatttggcattgtaaaatccagtgctttcttagcaatattatatctagtagtacagtagttactaatgttaagatgtctttatctttttcttgagatattatgttatccttttgcagtcgaacaaaacatggaattgttacctgaaaattcatatacatttgcagtaatcttgcatcgcagagaatctattcttcgatgctgtcattcactgtaccagacataaacagtacagttacgaaattattgtcgctgggagctgagttggatgggcccatcaaatatgagatccatggaaaggtaaccaatagcccataactatagaacatgtctatttccattgtttcttcaaaaaaattttgtgatactagttttcttttttatacaggttgcagccgtacgatgcatcgatgggcacatgcttggccttttcgaaccagcgtgaagaacctacactgcaatgtacataatgaaaaaattatttcaatttcttgcagatggtatgttttatttctgtggactgaagttgttgttgacagaagcaactgactgggcctgtagtgtctgaaacactgatgaatagttagatgggcatctctttctgttaagagaaaccagtatgagaattgaggtgctgtagctctttcgccaccgtttgcctggtaattgcctgtcgtattgcaatcggtagagagccacactgtcatgg

SEQ ID NO: 47277 - DNA, 505 bp, Oryza sativa
acttctctcagatccgacggcccagaggcccagatctctcgccgcatccaacggcccaaagcttgaaaaggcccatcatagtgttagctgacaggtgggcccaactcaacggtccaggcccaccaatgaggcctctcaagtcagcaacgccaaccctaggcttctcactctcctcgaacgcgcgacgccgccgccagagtctccggctcgccgcacttcccgcctcgccgtcgccgtcgccgtcgccgtcgcccctcccgccggtaggagaaggtagctcggcgcctcggtgacttggcgtcgcgctctgcgcccctgccgctctcggtcggtaggctctcgtctcacgcggccccttccaccgcttcacgccgccggcagtgagcagtcagctgcgaggacccgctccaccgagagagctaacgccgccgccgcccgcggtgcgcgtagtgctcgagactgctgctggtgttgatagtgttatctgggatttttagtctgagga

SEQ ID NO: 47278 - DNA, 966 bp, Oryza sativa
aattcctgcagctttggcaatatcacaattcaatgacagaaaggacaaggacatatagaaaggataacatagttttatcgtggataacctggtaactaaagttggtagaaaaaaagaactccatacaatttagaaagccacctaactgcctgaatgaaatgtttcacacgtatgcccatcccaattagtttactgatgcggcccatattaactaagtgaatctccctctacaagaagtgaaccccaggtaagatcctatataaagaattaaacattactgggacagaaagggaaaaccgtcagatcgcgccaactgtacaacggacaaacaaatcgccatcagtcaagaagtcctacaactaagaaagaactaacaccaatctccatcagacaaagatgatttatttcctgtcagacgtggcaaccacaaagcacctaaactgctacataagatatgaggtttggttgataatatgctaacaaatcaatgaaccacaaaatggcagtcgttatagcttgtttgatactttgacataacatgacgcaaagattaaatatgtcaagagaagccaagacactctaaaagagtgacgcaatgcaggctacatggagaggttccatacgcttgcttagcattcaccgagcgcacgttccaaatttaataacaagtggtggttgtgtgattattggatttggtttggatatgaacatgaatcagaggggggggaggaacattttggataaggactaagactatcatcaaacaaccaacacaaccaaatcacagcagcgtaccatttgatcttctcctcgaagattaaactaatgagagcaagcatctccctctgcgaccattggggtgattagctcgatgattcccttccagagttgaaacatttgcaaattgcaaaatagtttgcattggatctctttctcttacctgcatcggcatgtcgtcatatcagt

SEQ ID NO: 47279 - DNA, 301 bp, Oryza sativa
cttatgtatttaaaagcaaagactggaaaataaactttgatgaaaaaaatctaaaatcaactctaaatttgaaagttgaaaatttaaatttcgccagacaagtatgtataagtagaaaaatctattgacggtctgcctacttaagccaaaggccagggcgggaatgcaaaccatttccttttatcataaaaaagtatgaaaaaacatttcaaattactttccttaagcgtagctgttggttgaatgctctgaattgcttggaaattgggaggtttccaatccaagcccatttgcaaggaaa

SEQ ID NO: 47280 - DNA, 800 bp, Oryza sativa
ctgtacatagtccatcagtccatctccccgtgaattttttttatttttaattttttttattaaaagttttacaaaaataatttttcattttgaaaattgacagaagtggtcgcctaccgccctctgggagggcgatttttaaaaatcaccatcccagagggcggcgaaagtgacgtggcagacggccgttcgctctcgggcaacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgatttttgcctccccctataaagcccagccctctctctgaaatttcattatattaagtaaaaatccaaaaaaaacgaaagagagagaggggagggcagcagaaggggagcggcgaagccctgctggttcactcacttcatcacaggtttgctcccatacatcttttgcatttgtactaatatgttatgtttgagtatatatgttgcgttttagttttagttccatatattttagcagatctgtagcacacagcacatatgtgtagatccagagcatagaatataatagtatgaattgagacatagacaatagtgttaattgtaagatgtagtttagtttgatctagagaatgtaacctacttttagaattttggagaacaatattgtagagaatgtaacttagggcgtagtacagaaatgcgaggttaacgcagttattgttttcatcaggcacaa

SEQ ID NO: 47281 - DNA, 201 bp, Oryza sativa
ctgtacatagtccatcagtccatctccccgtgaattttttttatttttaattttttttattaaaagttttacaaaaataatttttcattttgaaaattgacagaagtggtcgcctaccgccctctgggagggcgatttttaaaaatcaccatcccagagggcggcgaaagtgacgtggcagacggccgttcgctctcgggc

SEQ ID NO: 47282 - DNA, 214 bp, Oryza sativa
caagtcattttcatatggtatttcctggtccatgcaatatgtttgttcttgctttggttggtctggacatagttgatttacttattttatctactcctataagatatttggagctggtctgttgtatttcacatatccagcaagctcttgtgtttgcacatcgatgctccaaaaggcaataacttgtctcaacttcctacttatgtgatgcaga

SEQ ID NO: 47283 - DNA, 834 bp, Oryza sativa
tgagcagtagtagtaggaggaggaggaggaccaatctggtgttacacctttttcctaagtcagtcaaatccagtctgaatgcagtgggagtgactgccagtggggagggaattaggggataggagtactaggaattgtgttattgttggaaagttttgagattgactttgtgtgtgcatgttggacttggacctttgaaatttaccaatttaaagactgactaataggagtagcccactgttgtatttcctgcgtaggcctgaagtatcattttcagcttaccagaggcaacatattttttctatggttagtggtagaaagacagccacaggggaagtgaattagagaataggccatatcttcatagccagccctagaaaaactcagcttcttctgaagaggtgaattaaatttggatggtcataaatattccgttataattaaactagtggattttcccatgcaaatatgagaggagctagatttaaaattagagttatattttgtatagaatttactggtcaacctggaccgttgtaatctagacccaccactataataaacgggcatatatttatcttttttccccgattaatgtcgttattctaggcttctagattgaacgtggtggcacccttttgcaccctctttattataacataatagatcaattgatacttccctaaaaaaggttcatacaaaaagttgctcagatactgcttttgctgaaccatagactggttgacacaggcatacacaaatgcatgctcatgcctttttttggaagttttttcaaactaaaactgatccattttgtttgtatcctactgcaga

SEQ ID NO: 47284 - DNA, 334 bp, Oryza sativa
cctatctgttttaagatagaaagtaacaactgcagtggatacttaaatatatttgtagagcatctgtgcatgacttctatattactaaatcacatgcaaacctaaatattttttttaaaaaaaaaaactatgtcgatcctttttacctcttgatccaccctaacctaatccaggtggtataggtgtgtcatcactttattcttaatgcgtgaattgagcatcattcttaactcataggtgggaatgttgaaagagtcattgccttgtggtgttttctaatgttgaaaatgcattgttccctgtgtcaaaacttttgacctgattttctctgcat

SEQ ID NO: 47285 - DNA, 306 bp, Oryza sativa
aataaataaacaaaaataaaaaagttcagatcagcagcatgtgatttttttaaccatttaatttctaaattttaaattgaatattctcaaaacttatttacaatgctgaacattttgtcacgcgtggcgaaataacaccgctagctaatactctaacccctcgtgatgtggcgcaccgtacgtgttagcaacaactacgggtgacattgtgacgttgttttagcacgtcaggcgggataccatggtctaaaggttcagatttaaaagtaaattttaaaacagcttatttttaaaataaaaaaataa

SEQ ID NO: 47286 - DNA, 172 bp, Oryza sativa
cctttcttcctcgtctacggcgcgaaagcggttctcccatccgagctcacccagaagtcccctcgggccaccatgtactgcgaggctgatcaagatcagcttcgcagagatgacctcgattacttggaagagtgaaggcgacgtgcggccctccgagccgcacgctaccagc

SEQ ID NO: 47287 - DNA, 1501 bp, Oryza sativa
atatgctaatattccccactaagatcagagtactactatttaggtgcaaggagcgtacatgagacgaaacagtactccctctatctagaattcatgggggcatttagaaaattgctatgcatacgaccatgtataactctcgtaaaactgaatttggatcaatggttataaacggctatagtgcttatgaacatgctcggctttaattgatctatgattatacgtcgtctctagttgtacatgagttgtaaaaataggtcatacatatatagcggtactcactgtgtgaaccttgtaataattgactatagctcttgagcaaaggccggaatgtttcattccattacctaaataaaccgtatagcggtactcgggcatttaactatttgccatgggtccagtggtaagcatttcaaaacatttaaaattcatccgcatattaatacttattgcatcatcaatcatctctcgtttaaattttgtacatcttgttcctaaacaaccctcgtttaacgaggagtaccaaagtttttttttccttcaaccttagtcttgagaagtaggattgtttatatttttagattgaaggagaactgagtagttaatggtcctactaaaacgtgagcgtgaccgtccatcatgtagtagaagaatatgcgtgtggccgaaaatgataacatgcataatacatcgatgcctatatagctcttcctaggtattgtcggttttaatgcataataaatatttcactaaattttgcattatttttctccaagagaataaagagatcaaactatatgcaaagggatagataataaatatcatggttattcatgcggttcatgatggcgttttatctttagttgttatttttggcgatcctcacgtctatttttttaactatataattatataattgcaatgcttttgggtcaatttttctcgtaaactaatcaattctcttctttttaatctataggagaaactccgtgtcctttctagagtttgaaaaccaaaggaaagaaatatagaccaaatgcaatagctccttttcttttgcagttgcttctcaggctagccagccagattctgcacgattttgaagatctgatctaaagcctccagcagattcatgcatatggacaaatctcaccaaactacggggtacatgtgataattgtaatcaggccatgctttacgctgtgccaggatcattgcacatgtgacgaatttaatatcaaactctgatcaaggacaggcagtatcaatctctgacgatcgaggaagtacagacaaggccacctcctccctgacctgatctgttccccaagctactagtccacgtgtgcagtagttccctttcgctttcagctggtgataaaaacgattggaaactatggggtgtttagtggggctaaaaacttttttgcccatgtcacatcggatgtttggacgctaatttagagtactaaacatagactaataaaaaactaatttcata

SEQ ID NO: 47288 - DNA, 1501 bp, Oryza sativa
aatgcaaaatttagtgaaatatttattatgcattaaaaccgacaatacctaggaagagctatataggcatcgatgtattatgcatgttatcattttcggccacacgcatattcttctactacatgatggacggtcacgctcacgttttagtaggaccattaactactcagttctccttcaatctaaaaatataaacaatcctacttctcaagactaaggttgaaggaaaaaaaaactttggtactcctcgttaaacgagggttgtttaggaacaagatgtacaaaatttaaacgagagatgattgatgatgcaataagtattaatatgcggatgaattttaaatgttttgaaatgcttaccactggacccatggcaaatagttaaatgcccgagtaccgctatacggtttatttaggtaatggaatgaaacattccggcctttgctcaagagctatagtcaattattacaaggttcacacagtgagtaccgctatatatgtatgacctatttttacaactcatgtacaactagagacgacgtataatcatagatcaattaaagccgagcatgttcataagcactatagccgtttataaccattgatccaaattcagttttacgagagttatacatggtcgtatgcatagcaattttctaaatgcccccatgaattctagatagagggagtactgtttcgtctcatgtacgctccttgcacctaaatagtagtactctgatcttagtggggaatattagcatatacggtgttgatcagtaaccttgttttgggaagccaggaaactcggaaaatatactagaaaagcaaaaaaaaggaatgaacaatattgctaattacgtacgattatatacacccatgtggttccttttcaacgcatcgaaatgacggtacagtatgtacacaggtgatcgattaacaataaagcatctttgcaaattgcagctagctagctaagctaggaaggattaagatagcatgagcgctttactactactggagtgtgggctgcgtttagtgcgtcccaccaccatgtatgacgccaccatgctgatatcctcatagccagcgaggaatcaaccatgaacgacacaggtcattaatcaggtagctactgcatgcacagtggagtacataggaaaaaaaaaagctttgtatggtgcagtactgcagtattcagaagtggattccaaactctcgaggaaaaatccgcttattatttatatgttatctaaataattataaaaaattttaacaagaaagattaatatgtgataaatcatttcacaaatatgcaggttaaaatgggaaactgttttaaaatttaacttctacaagttgcaacggaaaaacagattaagctgtaaatatatgcttcctccgtttcacaatgtaagtcattctagcattttccacattcatattgacgttaataaatctagatagatatatatgtctagattcattaacatcaatataaata

SEQ ID NO: 47289 - DNA, 162 bp, Oryza sativa
ataccctatgtagataatagatactccctatatttcataatacaaggcccaactattttttttcagatttttcatatataatataaggcatttatgcatacatgcaattaattagcacctcttctccactagtccaccttcgagatcccgaattctattagc

SEQ ID NO: 47290 - DNA, 415 bp, Oryza sativa
taagagctcacttaaactctttcatacgcatatgttctttggcatttggatttgtttcagggaaaatttgagaattttcttccttggtttacaaggaaaaatcttgatcgctaattcgaatgagatatttaaaatttaggtcagtttagggtattagtaactttgggtaaatagatttggggtcaattggaatttcatttgatagttagtcgagaatttatttaatgggaggtatgcattaagtcatgtcttggttcgatgggatgccatctttatgcttattactattatctatttattttacgcattactttattgtttaatcagtgtcattagtatgtttatttgggtcatgtaaaatgttctgtgcatccatagagaaaggggatgatcttttccagattcagaacctaga

SEQ ID NO: 47291 - DNA, 160 bp, Oryza sativa
gattatcctgagcaagcaagtcatcattattctttgaacatgttgatcccaatgcgaaattattttgtttaccaataaaatgcatgcaatgatgaacatcctacttgtgattataccatgccttgattattgttcacctttaaatctttgtacccataga

SEQ ID NO: 47292 - DNA, 1501 bp, Oryza sativa
aacagatcctttaatcagttttaaataatctttctggactcagaaacagggtggatttgtagacatgttttctatctgttgataacttcagcagtttagtttcaccttcatcttcattggttaggaatcgcatatgcacgctgacattggacttgcgaacatacattatctgcagtatgcatgccatgcgtacatgaaaaaacgggtgatgcaagttaccttcagtgatcaaaaaccaaactatccaaaaggatgatttgatacatattgtgttaccatttattatcagatgaattagaatgaggtattgctatatatatccagcaaggataaaatggtgagggtaaaatggtggtagactggcagtgtttaacatcatacgaatcgttggcagtgatcgctctaattgtgtttttcatcagagcacgaatagtcgacaatcgacatgtagagaaaacgattggttttgtttgtccgtgcagttgattggatagttttccaatacccatcaaaccctaattattaaaagtacatacttgtctgaatatatttcttatgctgaacagttatttatgatggagaagaggttgacatcataaaaaaatatatttatcatactgatgttcagtttgaaccagtatatttgtggaaatgatttctgtaacttagcaggagaattgccaattaattaattacaagagagaagagttggcattcagatagagaaataaaatagaaatgaaatttctttggcttgtcttaagctgccaatgcttctgctaatatgtaggtccacattccgtctttggatttggcgatcgaagaacaacgttgaagctagacatctcgatggcagaaatcttttgtgtttatctgtttctttccaaaagtccgaagttcagcataccaaaggttgaaaaaactctttggtttgaaaaaacaatgcccctctacgtactatccagtccagatcgttgtcaaaatgatcagaaatggacatgttataattcctgatacttcctaaccctaagcgcgattcgtgaggtagcagtagtgctgggcttctggccatcgggttatgagagagttccatccattgcttcttaatttgattatatgtggtacgagatggtacagaagcacactatggaagcacatgcaagaccatatatatgctgagtttaattctatcaagaattatgtgaaccaaacaaggcattagatatttgtcctctggtgtatgtagaggagagtcaaatcatacaaaactgacatattcactccaagttgatagtacgaggacacaattaaaaaaaattgacaactattttctattataatataaacatagatatattgacagggcatccatgaggtgttgctatcaacaaggaatagaagggtcagggtacacactactacatacaatcttattggtgttggatagtaatggcccataggtgctagatcttccaaccgcccccctcccctccccattagg

SEQ ID NO: 47293 - DNA, 1501 bp, Oryza sativa
cgagaaccgagaccatgataaccgccacaaccaccatgaacgcgatgatcgcgaacagcggatgccgggcgatactggtcccggacgccgccatgacgatgacgatgatggagatcggcgccggaacaacaacggtgtacgacgagaggattcccgagaacccgggcgtcatcctcggaatcgtacaccgaagccgagtgacccatcgtcgtcgtcatcatcctcttcatcctcatcatcagagagacatccgcgaaggacatacgatcgccgacaacccgccgcccccagcgctaggtgtagagctttcaaccgttcgctacgtgatgtccgatggcctgagagattctgaccaggagcaatagagaaatacgatgggagcaccgacccagaagaattccttcaggtctactccacggtactctacgctgccggagcagacgacaacgcgttggcaaattatttgccgacggcattgaagggttctgcgcgttcatggctgatgcacctcccgccctactcgatttcttcgtgggcatatctgtggcagcagttcgtcgctaacttccaaggaacttacaagcgccacgcgatcgaagacgatctacacgcgttgacatagaatccgggcgaatctttgagggactatgttcggcgctttaatgagtgcagaaatacaatccctgaaatcaccgacgcctctgtgattcgcgctttcaaaaccgatgtcagagatcactatactacccaggagttggcaacaaggtggatcacaactactcgaagattgttcgagatcgtcgatcgatgcattcacgcagacgatgcactgagacgcaagaacgacaagccgaaaacggggggagagaagaaaccagccaaggacacacctgaatcaagcaagaagaaaagtagcaagagtgggaaaaggaaagctcaagcggaagtcctcgcgtcagaatacgagcgccctcccaagcacccagacacacaaggcaacgtcacgaagagaatatggtgccctatacacaagtcggtcagaaattctctgaaggattgcctagtcttccaaaagtcgttggaaaagcaactggcattagagaagggcaagcgagtacgtgtagtcgagaaggccgttgaggcaaccactcaggactcggactcggcacacccagattccgatctccatgtctcgcacatgttcgaaggttccacgatgtactcctcaaagcgagaatacaagaaagtggagcgtgaagattgttcgacatggcagggggctgcacccaagatgaagtggtccgaacagaagattgagttctcagatgaggaccatcctaaggctgctgtcatcccaggacgatatccgatcatggtcgagtctactattcggaatatcaaagtcgcgcgagttctcatagatggcggcagctccatcaacctcctcttcgccagcaccttggacgcgatgggaatcccatgaagcgagttgactcccacc

SEQ ID NO: 47294 - DNA, 1501 bp, Oryza sativa
aagcccaccagagtaaacgaggggaggggagggggggggggtcactcatgcgttgcgtggtgcggtggtgcctctgtagcgtgtataggtagtagggtgcgtgcgtgcgtgcgcatgtgctggttgaataatgtgtgaagaggctagcaggtattgctccgtggttctgttctcatggtcgtgtcatgtctgttagtcgtgataactcgtgagcactgagcaagtgagcaggactgcctctggctgtctggcccagccggacttgttaagtccaaatggaatgaacgaattgtgcgggatatggattttcatctttggggatgttcttcgttgctcatctaagtggttattattttttttaaaaaaatattaacaacataatatatgaaatatatcactccacaaatatacaatgccaaattcgacttctattagttacaacaaaaactaaaaggcaaattttgctacaggacatcgcaattgtgtggttttagatcaaggacactgcaaaaacagacttttggggaaagacactccataattgtggatatttaccgatagacatcacggagtctaaatgaaacttgccgtgctgatgtggcagtcgggagccttttttaacgtggtcggaccgaaatgcccctgcaccttatctcttcgtatggagctgttttggctcaattcgccaccaccatcgacgaaagaacttgctggtacgagaactcgcggcggttgtgtggcctgatgcgggcggccggccggcgacgtagcgcagcgcactcgtgcaggaacagcggccggcgcgaaggtggagcagccgccccgcgaaaacggagccgcagccggcacggtggtggtgcggcagcgcggctcgcggctgcaacagaagacgaccaccgccaccgtagacgacgacgccgtagacaatcgccaccgccgcctcctcgtggtgtccccgggctccgtctccatcgccaacccgtccatagcatcgtcgagttgtagggcaggctcttcaagcgttcaagcatcaagcaacaagcaacaacgagcacatccaattcaccaaatccaacaagcaacaagaagtagtcaagtagccagccgtcctctccgtcttccaatcttctccaagcagcagcaacaccaagcaactccagatccaggaacatcgttcttgcctcatccacacgcatgacgcatccatgtgcaccggtggcgggaaccccgtccaaaccatcagccctatcgtccctcactacgcgcggctagtcgtcaatcacagcgccgtcctcgccgcacattgcggcactcgtcaacgccaaccgtcgccgtcgctcatcatggcgcgcagcccctggtcctctccgctaatcaggcctagtcgtccgccaactgcaagccgtctgccttcgtgccggccgttgctcttgcacgattgcgctgtgctgcgtcgccggctgcccgcatcaggctacacagccactgcgagccgcgccgt

SEQ ID NO: 47295 - DNA, 1501 bp, Oryza sativa
ggagagatgtatgtacgcttcggtttcactggttggatgatacatgcggctgaggtttttttttttttgaacgtacggtatgtggctgagttgctcttccttttctttttccaacacgtccgtacgaacgtttaccaaatctttttttttacggtttttcctcccggttgattctcggattttcatcatccatcaccttgttatccttgttctcaactccgatatcgacatcaacatcaacttgctccatgtttataatggcatggttccaattttctcttactatcccacactcccactccgcgcacgagctgttgccccagtggcctcgaacaacgtaccagctacaatgatttcacggggccaattgacattgattacgtgctacatgctttatcgtcttctctggctgcagtaccatattgctcgtgaacatgaagttgagagaggtggtactctcgtcgtattataaaaacaaatctaatataaattgtgatatattctaatattgtaaatctgaatatatttttactcatatttataatattagaatatataatatttcggttgtagggagtatttggcatggttgtagcgttggtgacctgagtcattgtctgagcgacataaatcatattgcctactttctccgtaaaaaaaaacccaacctaattagagatgtgacattacctagtccaatctggacataggtaatatcctatccctaattagattgggcttttttcttttgtttgaatggagggagtacgcagtataacataccagaccacatgcagtaaaagaaaaatccatcagccatctctttccgtcgcctctgcgttcacccgcaacgaaaggtatgacactgtaaaaaataattagacttcttgttgccttcacctattttaacacatgtgtactttttaagtaattgaaacattgaattagtgagatgtagcaatgggaatatagaccctgtttagatttcttggcaaaattttataccctatcacatcgaatgtatggacacatacattgagtattaaatatagatgaaaaaaataactaattacatagattgcgtgtaaattatgagacaatcttttaagcctaattgcgccatgatttaataatgtggtgctacagtaaatatttgctaatgatagattaattagacttaataaatttatctcgtggtttaagacaaattctgtaatttattttgttattagactatatttaatactttaaatatgtgtctatatatccgatatgacacgccgaaactttacacacatggatctatcacgaagtcatatatgtattcgatacattaggaaagattattggcaggtaacttgtctcatcagtcgttttgatttgggaaagataatatatcttgctactttgtcttcttccaaccgatccatacgcaaaatctatcgtccttgcccaacagcgccaccttggtagtctgctactagctgcgccatgtcttcct

SEQ ID NO: 47296 - DNA, 359 bp, Oryza sativa
attcctgcagctgctgcagtaacctatgtgtttgaacttctgcataaatagcatccattaatctcacatcagcatatatagtggttatcatccatgcctgcagcttgtgaattgtgatgacttgtaaatggttatgctaataagcttagtgaaagaacatatggaacttgtagttcaataggtgacattgtccaattagtgttaattgctttgattgatagttttcacacaaccactacctctattttgtgttccttgtgattccttgatgtgatattagactgagatggctacaacatttcttttctttctactaggtaatgttagttgtttgtcatatcttgaatagtattcaatct

SEQ ID NO: 47297 - DNA, 331 bp, Oryza sativa
atccaagctatagtgtttggacccatctacttaaacgtggaacctacagcacttagcatgcatgtgctacacttaaacatttcagctctagcaatgtgcatggtttttataactaactcagtgcctagctaatctagagttaattataatggcatcagcaactagctagggtctttggatcagattgcattgcagaattaatccagagttaatttaatttgccagggtggagggcactgtcaaagtgcttggccaactgaaagctactaagtaggccaaaattcacacttgcagacacacatcatgcataaacattatcttaattactagg

SEQ ID NO: 47298 - DNA, 810 bp, Oryza sativa
ttacaaaggcgcttcaggcctggcaatcaaaaataaacagcagcggactagcgggcctacggctccatcttcacaggcgctcaactggggtataagccaggactccacctaagacaacttctccaaagcttctcttactgaagaggggaaagattgagcaagaatgagtacaaccacagtactcagcaagccacaccggcagatgcatgattaatgcaagggggtacaaggggtaataatataggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccttcttttagttgttaagcagattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacgaaagacgtgacatagttcccaacccatcctagccataaacaagagtaccgacccaaccccacctacggccggaacctccaggacaggtaggcaggattgagcccctagcagcaggacaccagccctgtgccatgacatctcgactaccgggccgcagctcgtgtagc

SEQ ID NO: 47299 - DNA, 257 bp, Oryza sativa
tgggtaccctattcatggttccactagtatgaatttaggtagatgcttcgctgattaaataggacaacattaggtggttttataactttagactttgggaattctcatatcatttggacattatggaattgttggattatggtggaattggacatacccctctcttcctctttcaaaacccctaaaacctgttttccagtggggtttgggtgcatgccagttgtgggaagtagcaccccggccactataaggattaa

SEQ ID NO: 47300 - DNA, 974 bp, Oryza sativa
ttgagatcggccggtccgctccatttcccttgggcagcgccctagccgcccgagaaaagtctacttctcctccctcttccttttcttttccaaaaaggatttaattaaatccttttcctttagatcaaaaattcaataatcctagaaattcaatatcttcccaaccgtaaatccgtttgactccgttcaacttccaaaatttcccaaatctcgagatctgtctagtggcacgcttagaggtcattaatagggctttattttcgccgtttgttgagttatcccgtttcgcgtgtagtttcggagcccgaagacccgcagtgcgaggatttcgaggatcaagctccagatctggagcaaggcaagccacctttgaacatcttgagcctatatttgaaatttaattatattgcttgcaaaatattatgcattgataggatcacactaaatctgttgtcccgtctgcaaggcagattggcggacttacctaacttgttgcatttgatccttccgttgttaattgttacactacgtcccctcgtaaccgaccagttgcgcctcgatattcgtgcactctgtgcgaatatcgacggtcgccttcaaacttaaaaatctgagtaacaacttgggtaaaactggagttttacaaaagacttggaaaacccgacacctgggtcggtgcttgcgaactaaatgaatttccaaaaccgcggaccggggaacgcaccgagtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcata

SEQ ID NO: 47301 - DNA, 161 bp, Oryza sativa
gtaggtcgtgctgagtggcctgagcctccgaaagctcaaccatgcgagtcagcactggctgagactcgctgtacggacaagggtacctggcgtctgagtggccagaaggaaggcgtggaagctgccgaaaggcggagcctccgagacggtggctgtagtca

SEQ ID NO: 47302 - DNA, 564 bp, Oryza sativa
ccctttgcgccagccgatcgacgtttcttcgactgaggagccgacttcaggaggcagccaggccgacgaggagtagaggaggcagtcttcagcagccgtccgtgtgttaggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccctcttctgggagtttagatggctagccgtccccgccgtgcagctcgtgcaccagcccgctttggttttgaggatggtagagttgagccagaagaaaatcatgagtcggctaatgaacagtcacaccacagcaatagttcgcaccgtactgtttcccgcaacgcagaggttgagcaaccccgccgcagca

SEQ ID NO: 47303 - DNA, 1501 bp, Oryza sativa
agcgattgactatacaagccatttcatattggcagtattacactgggatctatattctactctgttttttatagccttaaaagaaaacatattgttcataccttttccgtacgcaaacacgaatatacatgcatgctagctagggctgattttatggctagaatatttttatgatgtaggagtacttcattttatttgtgaaagaaaatcatgttgaaagttttcttttcttgacgaatatctatatattgttctgcagagacataatattgattccagggatgggactcaaaggcgattctttgccgaggtcatccatcatcatgataggaattgaaagctatagcccacacaacggaacaaaacggagcaaatacgtacgtacatcagtacatgtacatttcctacgtacgtactactgctatactcttctgcatcatatacatttctacatggagaattttaaaaagcatatagtccaaccccaacacgcatgagcattgcaactttagtttgtactctacacgcgcagatcgaataagttgaacaatcgggtataatttagcttagctaagtggcacccacttaattaattagctctcctgcacatgcatggtccctcactgatctcttatctctttctacatacatcgatcgagccataatacaaggcaaattaagatatttaatacatagacacagttatatataagtacaaaagcgccgtaacaaccaggaacccttgaataaaattatattgtattccgttgcctctcctctacacaacaccgcgactctatcggtataaactatttgcattacgtacacaaaacaacataattgagcatccggctgcatgcatcggtcgatccagctttgattaagaaatgagccctagtacgtattagttggccacagacctaagctacatgcctacaaagatatacatatagtactcatatatatatttatttatatatctaaatatcctatcatgcgtgtgcctctagccccggtagtaattaacaaatcaacgaggaagacgagcacataaaatagtgcaacatggagccgagacaagcgcaatctagacctcgacctgtctcttgtgacctctgtgtgtgtgttgcttctcctgttcatcacaagtactccaactcatactactactaatctctctctctttcctactttgcatcgatcgtccctctccctctaaagtgcaagaggccgggatataatattgtgtacatgctgcatgtattcaaatcattcacctgcctagctatgagctccatgatatatccattctcgcctgtgcaaatcctgcagctccaggtcttatatatactgccccttctcacctgacacagctccaacccatgcacatccatccaacttaatttgacagcaactcactgcagcttagctctctttctctcttagttctcttcttctgtagcaagtaccaccagtgccaagcttctacagtgtgctgctc

SEQ ID NO: 47304 - DNA, 277 bp, Oryza sativa
aggaggaaggaaggttatttttaggtttttctttttactaaactttgataattgtttttgttgcttaataattatttccggtgctctgaaaattcaagtaaaatttgagggctccttttaaaccaaggagaatttaacaaaaattctctgggccacattcgaatttttcttgtacgtattttagtgtttgccaatttcttttcgaattttaattaattctattattccttttagaaaataatttttattttgggatgaatttatcaggacgtgacac

SEQ ID NO: 47305 - DNA, 486 bp, Oryza sativa
ttaggtagtccgccaatctgcctgcagacgggccaacagatttagtgtgatcctatcaatgcataatattttgcaagcaatataattaaatttcaaatataggctcaagatgttcaaaggtggcttgccttgctccagatctggagcttgatcctcgaaatcctcgcactgcgggtcttcgggctccgaaactacacgcgaaacgggacaactcaacaaacggcgaaaataaagccctattaatgacctctaatcgtgccactagacagatctcgagatttgggaaattttggaagttgaacggagtcaaacggatttacggttgggaagatattgaatttctaggattattgaatttttgatctaaaggaaaaggatttaattaaatcctttttggaaaagaaaaggaagagggaggagaagtagacttctctcgggcggctagggcgcggcccaagggaaatggagcggaccggccgatctcaa

SEQ ID NO: 47306 - DNA, 161 bp, Oryza sativa
taatgggctaggcccaattaaatcctaataaattccattggcccacattaagtgctatgggtaataataccaccttggaaatctaagtgaagaggtctcaacttaaatacggagctagtggagagtctctgttgaccggttgagatggtgcgcaaacaacc

SEQ ID NO: 47307 - DNA, 230 bp, Oryza sativa
tactcaacactcaatggctctctttgctagaggataccacaagaacgtgtttctgctagaggacaccgcaaaaaaaaggtaattatttgctggacacctgcggtattattttattatattaggaggaaatggagagagaaatagcgataaaagtacgtacctgcccctatctccaccgccgcaccacctcaccctcccaacccagcttcgtcctcttgctctgctgcaga

SEQ ID NO: 47308 - DNA, 270 bp, Oryza sativa
cactaaatagtgaatactattgtgtttggctattattttttttaaaaaaatatttgttatgcaaatctaaaattacataagaatatttttttgtcctgcattaggatttatcaacaaccttactcttttaaacatagataatttattcaattggatttatcagtttgaggggttttttattccgataaattttcgttaccgtattcgcgccagttcgttttcgctccgttttcggtttcgataatattcgattccattttcgtaaccagg

SEQ ID NO: 47309 - DNA, 612 bp, Oryza sativa
atatcctcttcgccaagaccctggatgatatgcagatccctcgctccgagttaaaaccaagcaatgcgccttttcacggagtgattccaggattatccgcaactccactcggccagatcaccctcccggtcacttttggcacgcgggaaaactttcgcacagagaatatcagctttgaagtcgccgacttcgagacagcataccatgccatactcggacgcccggcgttagccaagttcatggccgtcccgcactacacttacatgatgatgaagatgcctggtccccgaggagtcctatccctacggagtgacatcaagcaagccgtcacatgcgacaaggagagttgcgacatggctcaaacccgcgagatgacgtctgcccgagaggatatccgactggctgcagccacggcgagcgaaggagaaatacctgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcatggaaaccatctgata

SEQ ID NO: 47310 - DNA, 1501 bp, Oryza sativa
gcgagaccgtagacggtaagccacgattcggggttagtggtaccgtcgtacttctctattccagtcggcttgaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcggcggtgatgctgaggcttggatgacggtagtcatgagatcggaagtggggaactcggctgccagtcggcgtgtggacgctttcggagttaactaggaccgaagccgcaatcatggtcttagtctggttcaagatgttgacgacgtggtcggatcgattgagctcgttttggttgaggagggtgtcgagaagggtgatcgcggcaaccgcattctgttgaggggtgcggaagaccggtgtcccttcgacatcttgctggccgatgagatcacgcactcggcgccctgcttccaaagctcgctgacgtcgatcctcagcctccttcgcggtccgctcacggtcctgctgctcacaccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacaatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagacgctgtcatggtggagacggccgctaaatcgtcggggagcttcatcaggactggtgggtaagccccatcatcttgatctggtgtcgttggagaagatgcgatctcggccgagtggtttgaagccggctcggttgagatggtcttgaagtagctttcagccgcgttcgggaatccaaacgggaccgaaatccggttctctcccgactggtctgattccgagtcgaggagagaaatcttgccgaagttgttggtgatgaagtcgaggctgccgaaccgaaacgtctgcccgggagggaagacgaggtcgtcgatgccggagacggaacccattgcactgatcggcgaaaagcttgacgcaacccctacctggcgcgccaactgtcgaaactagatttcgacaataataaaagggggtggctatcaagctaggaaagtgtatgggtttggagacaaaggat

SEQ ID NO: 47311 - DNA, 594 bp, Oryza sativa
cgtaaagacaataagaacactgaaattagtataactagttgataccccgtgctttgccgcgggatatgtaggtgaatacattttatatattatagaaatgtgtggagattatggatatcccatatctacacggcgatactatttgggctggacataggataccgaatatgtatagaatatcttatttgtatctcgggtttgtttcttaacttgtacaacaaggaaacaccttgagacttagttggttacgactgtattttgtctgtgtttgcatattccgttagggatatgtattctcttttgtaatacggactccttcccatatatataaggggggtctaggtgcctctaggggcaggggttgaattttctccaaatcatacaatcaataacacactcggcggattcatccccggacaggagtagggtattacttcttttataagaaggcctgaacctgtataaatcctttgtctccaaacccatacactttcctagcttgatagccacccccttttattattgtcgaaatctagtttcgacagttggcgcgccaggtaggggttgcgtcaagcttttcgccgatcagtgcaa

SEQ ID NO: 47312 - DNA, 1501 bp, Oryza sativa
tttgaagtaatcttgattcttgaatcattattgtgtgctgttttgccatttttgctgaatttttggtcggtgattgttctgcaaacgctcaagttgcgtaggagctggaatgctggatgtataaaatgatttttcaccttagaaacatgattagtggattagtagcatgcagtatgaaccatttaactcggtgtttaccccctgattgagtaattgcctgaaacgaatgggagtaattcttgcaatgttaaggaaaaaaaaactgtaactttcagaaaaaaaaactcactctgtattttcagtacatgggtctgataagattcagattagtacagagttattaatggataagtaacaggaagtatgaaccatttaactcggtgttctccccctgattgagtgattgcctgaaatgaatggagtacttcttgcaatgttaagagaaaaagaaagaaactgcaactttcagaaaagctcactctgtattttcggtatatgggtctgataagattcagattagtacaacgtgtgctttgatgagaaatatacacatttgttcggtatggatctgaaggagtgcccaccttgtgcctgtcaactggatccaatcccctttgactttgaaatagatataaattttgccagctgtggcaattgctggaattgatttgtaaattgctccctttgtttggctgccacgcagggtgtggaggagggtctgacccttcacttggtggtgtgatgtcggttgggtgcgccgatgaattgcattgactggtttcaccattatgtttttttccctgtactccactggacatactttaatgcagtaaactagtgatgcagcaagttgattagatagtgtagaactcactaactaaagaattttatattactaatgctgatgccagtttcttattgtgtggtcaaccaatttgttttcatggtcaagtggtactggtaaacggacatatatttgtttacacaacaatggttgtgacatgagactacttattacagtaactctgagtctctgactggttgttcctcatcaccaaaaaaaaaaaaaaccgttttgatgttcctctttcttctgcagatattcagcagaaggcacttcctctgtttgatttgcaaaaatggcttgctgctttatgtttgggaatgatacaaaacaaactagtgaaggtgaacaaggtgggcatgtcttcatttagttctatagtctcttctgtatacagaatgctcctcattctgatacatttgttgacttgcaacttgtttctggcggtttcaggagaaaaagcggtcaggattttttcttacaatgagctgagaagagctacacatgattttagtggggcgaacaagattggtgagggcggcttcggttctgtgttcagggtaatgtaccaaagcctttggtcgcttcaactaagtctaatatccattctatattacatcgacctcacttgcttaaaattcattttggttgatcagg

SEQ ID NO: 47313 - DNA, 1501 bp, Oryza sativa
aaaagattccatttcccagaaagaagctagataaacaacacgaaccaaacaaacaccaccaataattacccccaaaaacctaagaacagggaccaatcaacaataccaataatggaatttaaatcttctttctcgaaacgaatcaaccaacaacatcccaacacaagaaaatattccttccccccctctttctttctccaagaaaatcaataatcaatcgatcgatcaaaacgcatataagcatatacaaacctggaaggtcccatggctcgcacttgttgaggtcgacgtcgacgatggcgacgccgccgccgccgccgtacacccctcctccccggccgccggcggcgagcttgtgcaggaggtagtccagcaccagctcgtcgtccctcgggtggaacctgaaccccggcggcattctcgcctccaccatgcctatgaaactcatctcctcctccacctcaatcacaccaagaagaagaagaagaagaagaagaagaagaagaagaagaagagagaatagcaagctaatggcgagctcggcggctacgcgtggtagcggtattaatactactctcgccggtcaactagagctagaggctagtatatagcaatagcaactgatgggtttttcatggataatatgcaacttgccgggtttaatttgggagtgtgcttacggattaaggatttggatgtgagctaattatatgctactagtacgattctgttgctgaatatataaaccggtctaaatggttttcaatatatattgcttgttgtttcagggttgcattgcattgcattgcatgagctggagctgttaattagtagctatagctcagtcaggtcagaatggaatgtgcgtatgtcacaatccatttttatattttacatgatggtaattaataatagagagaatccactcagtgccactgagtttctaccacttctacaatataccactgactttgtcaaattgaataatatgccatcgagttttcccaaacgtctactgcgtgccatcgccgtccacaagccgttagggtgcatccgtttggtgtattgaattttttcttaatgactaaaatgcccatgactaataaaccctagcacctgttttagtaaaatattttggtattcatttctatatctatatgagctcagtgccatgcaccatgttcaaacttgttttatatctaactgtatggggttgattttttttttcattatgtacatttatttttttccgatatgtcccatttcaaagtcaacagatcactagttcactacgtctctaccaacgcgtgaagctagcaatcataggctgttatatgattcaatcagtttctctatatgtattcatataatacatatgtccctcggcaaaaaaaaaaacatgtacaatgagttaggggcaaataggtctttttacagctctaacagatgcccaactaacagcttctggactgtgatggcacgcagtagacgttcgggaaaa

SEQ ID NO: 47314 - DNA, 1501 bp, Oryza sativa
tttttacattattttaacatatacacataccattttgtcgaaactagatttcgacaataataaaagggggtggctatcaagctaggaaagtgtatgggtttggagacaaaggatttatacaggttcaggccttcttataaaagaagtaataccctactcctgtccggggatgaatccgccgagtgtgttattgattgtatgatttggagaaaattcaacccctgcccctagaggcacctagaccccccttatatatatgggaaggagtccgtattacaaaagagaatacatatccctaacggaatatgcaaacacagacaaaatacagtcgtaaccaactaagtctcaaggtgtttccttgttgtacaagttaagaaacaaacccgagatacaaataagatattctatacatattcggtatcctatgtccagcccaaatagtatcgccgtgtagatatgggatatccataatctccacagtagcccccgagacctttgcagtcaaccaccatagccttctcaaagatagcaatccgagtgcttcaaattattcatgccaaggcctgccgagtagcgaagacgaagactgtaaagggcgaaaagataaagagtatggtgcattgaatagacgcacctaattaggtgtagcccccaactatgtgattagttaacaaactaaacatatagttgagaacaatataatagcacaatcatgcatcatatgacaaaagcacacgcggcgcctaaagaggcattctagccgactgctttttagccataataaaagaaatccgagtggtttacactctaaaaggttcacgaatgaacacactggacaggcatccgaatataaaactctaaagattacccaccaagtattataaaaattatggtaatgagtaagtctaatagcctaggctatgactatttaccataatgaaaataggtatataacataccaaggaagcgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaaccgcgccggcgaactagggttcaccactccactcaaattcaccttcgaaaagtgcatcaaaatccttcccgtgatccaccgcctcaatccctcacttctccccggccatccctcgaatcaaatcaacgcattcgggtaaaatcga

SEQ ID NO: 47315 - DNA, 615 bp, Oryza sativa
cctccccccccgaggggatcaggccacgtgggtgagcgcggctgcccaagcctctagtcacgatactcccggtcccatgtcaccgacagtaggattttcagagatattagttaactttccatgatgttttaaaaatttcaaaaagcataaaccaaaggggcctacgattatcttatggtaatgtttacaaactttttacccctctgttatacctataacagttgtatcatcctgaaaggtacctcacaaaattcacccttggatttggtactgtgtttggatctgtacacatcctatcttactataaagttggtgtccactaactcctaaagctcaatatgcaagtatgccacatcatcacccactagcaattattatttagagtattttaaatcacatataagtgtaccacatcaccacccactagcaattattatctagaatatattaaatatcatgtaaataatatgcaagtaatgctaaatcattatctccatatcatttttacattattttaacatatacacataccattttgtcgaaactagatttcgacaataataaaagggggtggctatcaagctaggaaagtgtatgggtttggagacaaaggat

SEQ ID NO: 47316 - DNA, 222 bp, Oryza sativa
catatgccatctataattgtttgaagatactaatcttttaactaaagttcttaggttgagaagagaatcatgcatgttaggtgttcctttttcgcctcccggaaagagtgaaaaattcctgctaagatgtcaccatagagcttaaatacatgaattcttattcctcccttcctcctgtacgtgcccaacccttgtcatttcgtgtatggcatcgtttcaagg

SEQ ID NO: 47317 - DNA, 158 bp, Oryza sativa
acatcatataatcttacataagagttcaaaagagtacatgtagacatcatataagcagcagaaggaatattgagatatcgtatgtctaaaaacgtgaagcaaataatccgtggtaataatacggtgaataaagttgtaaagaacagaacggttggctg

SEQ ID NO: 47318 - DNA, 351 bp, Oryza sativa
tttacatgccatacattgcaagtatgcatcacctgcaatgtctgcaaccatgataaaaaggagacagggtcatagcatctatcttgtaaggccggacaatggaagcgaacgaaagacatgatagagaatggcaagtttttatttataccctcatcaagacagtaaaagatcagtaggaatgacaggcaatgggaattcaagttcaagatagatagcacaaaatagagcaaggtttccctcatcgttctcctgcagagaacatgaaatagcacccaagacaacactacggttcaatcgcattacaccagatgctttccgatgaagctgaagagctagctttgtgcttgtagg

SEQ ID NO: 47319 - DNA, 1116 bp, Oryza sativa
tgggggttagttttaacatgtttggtaacaaatatgttcttatgcaaaaaaagaactacgataacaaggaggcagtaaatattggtgtcaaactaaaggaaagatcatttgcctgcaaaaatcttgaagtggtgaatattagatgctctaaagatgatggaagagtccatatgttagcagaactctttggtgctaatgggttacctcttgagaagatttttgttcgccgaacaggcagcacctgtgagtaattctttctgatgtccttatgttcctttttacccatgtatttgcagtctttatgttactcgattacagtcttctagatctaagatattatgttccttacaagctaaaaagaaaatggccttgtttcgatgttgtaattatgcttaaattggtagatacaagcaagaacttaaatctcaaaattttctttgctctaataaatgtgctatgtgtgttgaaaaaagaaataaataaatgtgctatgttattccatctctatatatctgttccttgttgtgacaatctaaaacataagccgttggcttttacatgtttcttgcagaccttcgtaacatgaaaaaaatgagaaaaattgccagggatgagctgcgaaaagctaggtggttccagctgttaaatctataaacactacgtaagcaacaaaattacttgtcttttactttttgttaaaatgctttctgatgactgcaaaacatttttcttaatagattctaaggacctgatggccaacaaagttagacttcaagcacactgattactcgtccaaagttgtgatcgagcttacctcggcccaagaaatgttacaaaataactatgcgattatttaggtaaattttagtttctttcctcgatctgcacatttcttccacttgggcatcaacctttgatgggcatgtgttgtgctgtgtgctgatgcttgaacaaagtttgttttagtcagaagtttctcatgctcctctgggcatgatgaaaccgtgactgccaattgtaagcagctagcttcaggcagtgctacagaatggttggttttacttgtgtgtcatgcttgagcttgcattgtttgcgtaacatccctagattggtttc

SEQ ID NO: 47320 - DNA, 1501 bp, Oryza sativa
aggagcaggtgcctaacagcgaataagtagcataattatacatgcaaatatgtgatcaagtaaatggtgagcattcctggttaattaattatttcaagctctattgcatcaactttgcatagtcctattatttagttactcgctaacagaagacaatcagtcggaaaacaatggatgtagatctcagctgaatcaaatgatcctgaacaactgaatgaatctaactaaaaaaaccacccctttctaaatgggcagtttgtctttgtggaatgcggctaagtttttttttagcgattttgtccacaatgttctcctcaaagattgatggttctatgcttgatggttctgtgcaatgctctagctagcatgaaaccgttggccatgaagcttcaagaactagttgatcttcatcctctgaccaaaacatttgagaaaatccagattgttatgcatcatccatatccttccctgatgcctccctttccctgttggctctggtggctcagaacgtctctcatgctcctttgggtacgatgaaaccgtgaatacctttcggaatattatgatattgccgctagactgcatataattacaagcagctttcagttagtgctacagaatgattgatcttgcagttgatatagaggattcatctttccttttcctttcccgttttatcgaccaagtgttgatactcttcttcgattttctttctgtcctcctttggtcgcagcctccttttttttttgtttctagttttggtcttgtctggataactggatccctgtttctatgaagttttctttctcaataaaaagatgcatttacgtagtcctataataaaaaaaatctttgtcaccaactattttatagtgggtatggtgtgtcatgcgctttatgtcaaaaaagaaaaaaaaagcaaaggagtgccatgcgatcatagccataaatggctttggctgagattgcatctgaagctttcccaccatatcgagaagaacaaggatacattactgtaaaatcaaagtgcgtttgattcttattctgtgatgaacaattggcatatgagattattggttttgatatttggagattattggcgaagtgtttttagagatgattggatttgtaggtgatgaacaggaactgctgttttgtcgggtccggttagactgggcaggtgttgccggttagaccggtgtgtatcgtgcggtcagactggccagcccgcggtctgaccagacgacattgtgttggtttcgggttgtttcggccgacacttctagatggatatactatgcgtatgtaatactgttgtttgctaacaatgagtcaaattggagatagcttgatctcggaatatggtttctttgtttgattcatgtgtaggtgtcttgatgcctcgggagagtattgctgatgatggatcgagagtcaacttggagataaggtggcgttcggacggtcagatatcatgcgggatacttaggctaaagatcaa

SEQ ID NO: 47321 - DNA, 1501 bp, Oryza sativa
ttatcaatttagaatctttacttttttatatagtgatcaaagtggaataaagcagagaaacttagacttcttcaccaaaatatctataatacttaaaatgttagtatttttgtattcattcccacaccacctctgtcactaacagccggatctcacaatatatactaggggcatttgcaaatttgccaccggttttttcaatattgcaaggatgccactcgaatgacagttctaatggcatttttgcaattttctagtggcagttttgcaataacgattcaaagtagtggtaaatttgcaattgcccctatatactattatatcacctttcaataagtcataccctattgcactattggctcccctaaatttcaaaatcacctaactgtgttcaataagaaaaatcatttttcatagtactacttatactaacacagaaaatcatagtattacttatgcttaataagcgcttattatttgatttaataaactagtccctccgtttcgtattataagtcgtttgacttttttcctattcaaacttttgtaagttcaaccaaatttatgaaaaaaaaatataataatatttttagcaaaaaaatatatattatcatttaatgttagatttaatgaaactaatttcatattttagatgttgttaaattttttcaacaaacatgaccaaacttagccaaatttaactaaaaaagatcaaacgacttagggggtgtttagatctaggggtatcaagttttggcgtgtcatatcaggtattatatatggtgtcgcatggggtgttcgggcactaataaaaaaactaattacagtaactgtcagtaaaccacgacacaaatttattaagcctaattaatccgtcattagcacatgtttactgtagcaccgcattgtcaaatcatgaagcaatcaggcttaaaagattcgtctcgcaaagtagtcgtaatctatgcaattagtttttttagcctatatataatatttcatatagatgttcaaacgttcgatgcaacggggtgtaaaattttaaggtgtgatctaaacatgcccttataatatggaacatgggagtacaaactaaatttattttccattgcaaaacaccggctctaggctagtacttcctccatcctaaactaaacgcatctataagtttccgtgtccaattttgatcgtccgtcttatatgaatttttttaataattaatattttattattattagattataaatatgaataatactttatgcgtgatttatgttctataattttttttttaaaaataaaacagatgattaaagctggacataagattttttttaacacggagggagtccaactcaacctgataaactccccgcggcctatacgcatcgtccccttcttcttccctcacccccttttcccaccaaaaaccctagcctccccctcctcttccagattcatcgccgccgcgccgccccgagcccagagtagccggcgacga

SEQ ID NO: 47322 - DNA, 289 bp, Oryza sativa
attcctgcagcccctgaattgtatcaacttttggtgtaccttgcctcctgggacaaggattaatgcacgcacgtaaggaacgcccgttgggttatttccggtcgtgacaagttggtatcagagcccccttgaccctaggacaagccgtagatcccaagccttagcagtattttcgaaataaaaatcctctgttatttgtgaaaaccctctagtctttctctgtcttgctgcttcatttatctccaaaatctgacctttttaaagtgttgcttttctttttgtttgtaga

SEQ ID NO: 47323 - DNA, 228 bp, Oryza sativa
tttgaacagaatgtagcatatggctgtcgaaagtgtgcttatctaccttggtgaaagaatttacttcagtgagtcaggccaagccagttgcaaccaaaagtccattcttctgtctcctggaccattcaatcatgagactagtgtctttttataaaaccatgccatgcatttgaggatctgagctactgtctggctttctcttctggtttcatattggttctagagaga

SEQ ID NO: 47324 - DNA, 1501 bp, Oryza sativa
ttggcattaatatgtttgtgattaccaatcaacatcaatggagagaactaaggatttcatactgcagctacgagatggaaaccaacctcatatcaacatcgacgaaaagaattgagattccatactgtaattaataactacgagatggaaaccaacctcaagcccctggcaatatggcaacaacgtcttgccctccttctcgccgcttcggccgtctttgttatccaccacaaacatggagtaaccagcgcaggcgtacttgaactgcctcaaatcatgcccctgcgccgccgcctcttctctgggctcgtccaccacgtagcttgggactggagcaccgaaccaaacaacaacagtttcgtgagattctccgatcaatctgaacccgaaccaccagaaatcgatagagacaatttttgccgatggattgaaaacccgcacgccgatcgatcgcgcgctgcgattttttttttttggggggggggggggggagattagggttcgtttcgttttaccttgggggatggagcgcgggatccccacgcagacggggttgaatccgcgggatctgagcatggacgagtagtagaggcagcccttgcaggatttccccctcctcggaagcgccgtgcccgatggttttccggccgccgccgccgccgcgccaccgccggccgccggcgattcctcccccatatcgcgctctcttttcctctctcctctcctctcctctcgactccccgtgacgaagagatttcgtcgtcaaattttgtcctcccctgcgctggctgacatgtgggcccgccaacctcggcgattgggttcccgaatcgtacccgccgactagagggcccaccagtcaggtcagaggatcaagacaattcacgagtagttacgttacttctttggatttttaaaattttgatttgtactgtaggattaatttcaggttgccgtgatacttgtcacaattgggctgtgtttagttcacaccaaaattagaagtttggttaaaattgaaacgatgtaacgaaaaagttagaaatttatgtgtatagaaaagttttgatgtgataaaaaagttgaaagcttttagaattattttagtactaaacacggcgttggtttcaattgatcgaatcggtacgaataattcataaaaaaaaatcaaatggttgttaccaattctcaattctggcaaaagtcgaattatggtttccatttatactccttaacaagaccatgtacatacacagaagtgaaaattatatcagaatcaagacctgataaacagcaccaaaaaaaaatctgaaacgccaggttgcaagcagaacaaacagaagatttgaaatggcctacaatcccagaactgatacaagaatctcaatacagaaaagaagcaggacaatcaacaggctacatgagacagaattactgtgtacaacaagcatacatccagcacagtaaaaggttggagcatatcaccagggggggtgcttta

SEQ ID NO: 47325 - DNA, 1018 bp, Oryza sativa
tcctcccttttgttgtagttcctcagtagacatccatatcacatatgcatgtttctgaacttggtgcattgtagcgagttgcatctcctcagaattgtcatgtagaacagttgtagttataaatcatgtgcatcctacccttctgtttcttgcttcggaacaagcagtaatacattctgaataaatcctggtgtcaggtaggaaatgggtactaaagcaccccccctggtgatatgctccaaccttttactgtgctggatgtatgcttgttgtacacagtaattctgtctcatgtagcctgttgattgtcctgcttcttttctgtattgagattcttgtatcagttctgggattgtaggccatttcaaatcttctgtttgttctgcttgcaacctggcgtttcagatttttttttggtgctgtttatcaggtcttgattctgatataattttcacttctgtgtatgtacatggtcttgttaaggagtataaatggaaaccataattcgacttttgccagaattgagaattggtaacaaccatttgatttttttttatgaattattcgtaccgattcgatcaattgaaaccaacgccgtgtttagtactaaaataattctaaaagctttcaacttttttatcacatcaaaacttttctatacacataaatttctaactttttcgttacatcgtttcaattttaaccaaacttctaattttggtgtgaactaaacacagcccaattgtgacaagtatcacggcaacctgaaattaatcctacagtacaaatcaaaattttaaaaatccaaagaagtaacgtaactactcgtgaattgtcttgatcctctgacctgactggtgggccctctagtcggcgggtacgattcgggaacccaatcgccgaggttggcgggcccacatgtcagccagcgcaggggaggacaaaatttgacgacgaaatctcttcgtcacggggagtcgagaggagaggagaggagagaggaaaagagagcgcgata

SEQ ID NO: 47326 - DNA, 1501 bp, Oryza sativa
agggttggaataatcaaaccaaattcacccaagtcccctgttgccagtgcaagtgcttttgagagtgtagaaggatcagatgaggatgatgctaaacaaccgaatggtaaacttgaaaatggctacctgaagatgaatggaaatgttgtaagtttcagccatcctgttgtcattacagtttttcttgttatatagttcctaattcctttattaatcgcctatatttttggagttaaaataggtttggcatcaagttttgcacgcgcaatcagtatatcatgcacataaaggaagtgaatttgtggctatcattttcttaatctattgagcatcgattcttgtggttatctattttcttaatctattattgcattgttttatatgctgtagtttattgatttatcttcttgtcgtttagatttaccttagacaaaagacatcttactggctcaacaatggccacataaatctagctaggcaatactgctggcatgcattataaaaaggtactacacacattgaacactatctgtatttgctggctgcagattttgttagcctgcagattttatattactcaaaacctagtaaccggcaggagataaatgtgagttcctcggacagtcattctacagttagtgacttggtagaagaaatcatattgctaactttagctgtacaaccaatagcatttggtgctgatatgaataaagcgtctgctcagctggctgtgatgctgctgcactgcacagccgcagcaaagactaccaagtgcccaaatatgctgatatttctctctgtttgggggaaatttgctgattttcatttggtacaatggctgcgactgattctgtttttttttaatgtctgatcatatatgtttcaatcaggaaggagaacagaaaggaaacaaagtactggaaaatggggctgcagcgccattagctgcagcaagtttgattcggtctcatagtatatccaatgatcttcatggtgttcaacctgatccagttgctgcagacattcttcgaaaagaacctgagcaagaatcatttattaagctgttaactgctccacatggtatggtattagatcttacagaacagtaatattctccctgtatgaatatcctttaattttgttatacttccattttttatgagcactaccatttttgttcttaagaaaatttgtccgataaaatattcacatgctgtattttatggactatggagttctccatttctttgaactattaggtgcaagtcaagaacctggaatactagtaaaaattcatggagaccatattattgaaatgtatgcatgttagtttcatatttttcctgtcaattagtcagtaattcttttgtattttaatgcatataattttagtcggatacatcaaatttcgttgttagtaagagtaaatatttttgaattaattcttctcatttccctttattcccaaatccaaagtaatttctttcataatattatttta

SEQ ID NO: 47327 - DNA, 1416 bp, Oryza sativa
tttggacaagggcacggtcttaaaaaaacaactttcaccattattttttattataatatgtatataaatgttaacaaatatatgattttattggagtatttttttaagactaatctatacatatagtcaccatatttcaaagataaatatttttaaaattatttataaccagagatttaaaatttgacctcacccttgtccaaaacgacaagtattatcaacccggaaggagtagtatgtctttagaaaaatattagaagccatgtaaaattattaaaaaaaaaagtcgatcatcaacttgtaaggcaagtgttaatatgaatgggtgccacatcatttaaagatacacatacaaatagagcatatagtaggtagctattgacacaataatcatgaaacatattttaccaatagattttcagccaaatcacttcacacacactcccatatcctgtatgtaatgctagtatttgttagcggtgactctgacttgtgtccagattcatccctagcatttgaatttgtttttctagattcatccttagcatttgaatttttttataaagggagtagacttttagccaaatcccttttttcacactctactatatcctacgcattgttatttactataaaaattgctcgtgcattgtaacaggtgaaggctattttaattttactgttattataggtttagttaaggcaaaattcattgtgagaattcgtttggatattttttttctagaaaatcgtgagctgcaattaggagttcgatcatctcaatttagcatgcaagttttttctaaagagatttcttatacgactgctcctgtattttcaaaagcgaacgaacttaaaacccgactcaaatacacatatgtatttccaaaagcgagcaaacttcaaaaccgactcatatgtagatgacataccaaagtaccggcgaaaacatcttcaatttttataatagtttcactgtgaggattcgcttggatatatatttttttagaaaattatgagctataattaggatttaggagtccgatcatctcaagttagcatacaagtgtttttaagagatttcttatatgacttctagtatttccaaaagtgaacgaatttaaaacctgactcaaatacagatctatatttccaaaagcaaacgaacttaaaaaccgactcatgcatggatgacgtaccaaagtatcgacaaaaacatcttcaatttttataatagtagagacttgcgttggacctcactttcttcgagctcatgtgcaattagttaggagtactatttagtagccaactcaccctttctctcctcatctctctccttaggctctagctagatatgcaatgttatgtggtttccttataactagcccttttatcattatgagataatccaagaaa

SEQ ID NO: 47328 - DNA, 301 bp, Oryza sativa
atgctatggatcaaattttctcttaaatctacttcaagatttatgcattgtcttcgtctctagcgagtttccaactttggtagagaaccttgagattagcgttttggggttgagatgtgatggagggtaggggtcttggggatagtgaccgacggttttggagggatgcctagggtggtgaaagcccaatgataacagtggaggcgaggaaggaccggtgggataagggcatcatattgctagagtcagagaagaagaacaccgggagagggggggtgctcaacggtgttgttggagaaga

SEQ ID NO: 47329 - DNA, 499 bp, Oryza sativa
  unsure (1)..(499): unsure at all n locations
gatttaaaccaaccccaaggcccaaccaagaaaacccgagacccgacaaaattgggattcagagtcatcagccgatctgatcattgccattgggccaatcagatcgncggtgtgtggccggtcagaccggccttccataggaaacctgatcttctcccaaatttggcaatgtttttctatttcgtgtctagatgtcaaatttaggcgttaacacatacccctgcctttttggcgaacttgtgagccgaaaagcataggacatgtggtcttagggcaataatttttatcggccatatgaggttctaagtgtttagtaaatcaatctctttgtaatatcctaacaaatcaataatttcttacgaacgattcacacaacttggtatagatatttccaactagataattactcaccgagcaccttgcacttagacccaacaaatggcgacttcaagatgtgaggtcgtacctatcatcgttcgtgtctcctaatttccttaga

SEQ ID NO: 47330 - DNA, 231 bp, Oryza sativa
gctaatagcctgctattgtacctgctcttaatgaaaataagaccatgtaattaatgtaaatgtgagacactatttaatatcctggatctgcaaagaaaagtgacataaagtactaactccacacatttatatgtcctctaacctaggaatataaatgcaagaatctcatagaaattgtctttgtaactagccttcttcttaattatattgcttcgtacatatactaacagt

SEQ ID NO: 47331 - DNA, 1501 bp, Oryza sativa
attcgtctcgcggtttctaggcgagttatgaaattagttttttcattcgtatccgaaaaccccttccgacatctagtcaaacatccgatgtgacatctaaaaattttcttttcgcgaactagacacgccctgatactttcatctgaatatcttttagagatccgagctcaccatctttccaccacagctcctctaattccaccacatcttccccaccccccctctccctacgcactttcaccggagcttgagggggttagccagatatcatcaccgatgttcctcttctcgcggacaggtgaggtgggtgagctcaagcttaacggggctcgcttggccaccactgcttctacatgggcagaactggagctcaagttagacggagctcaccgtccaccgtgcctttccgcggatggcctcgccaaccgctgatgccacgctccctctacgctcaagcttgaggcttctcgtagaaagagggaaaagagggagacagaagatagaacgataactaatggatcattgaaagagggccatatgactttttttttctgactaagtcactgtgttatgtaggacaaaaccatcgtccaaccaacttttttaccttgctcgactatagtgatataattgagggatgcttgtatgatgtatctagctttgtgtatgagggacagaggtcagacttggtctatagttgggggagaaaatagacagttttctttgaactctttgaagtagaactagcaggctggatcttttgtagcagtaaaaggaataagttcaactgccatccctcaacttacaccgagtttgtttgacatcccttatctgcaataccagaaatcttcacccctaaacaatgtaaaaccatgtattttaggtcccatagcagtatatatgcctggtttcgctgacgtggcatcctagtcagcaaaaaaaaaatatggggcccacatgtaagtgagagaaaatcatgtgggccccacctctcttcttacttttctttttctcttctcttctctccttctcttttcgggtggcggcagatgtgggagaggtggccggcggcagcagcgggcgagctcgcgggaagaagctaggcggtggcaccagcgcggaaagaagctctcggcggcatcgtgcccgctccgcctgccgctgccccgcgctcacacactcctgtcggccacctcccccctccctctcaatcttgtgaagaagagagaagaaagaagatgccgtggagttgaggggcctcctatacagctactccaacgcggtggtgacacgcgcggcgaccgacgccacgggcaggatggtagagatgatgaagtagctgctggggaacgccacgtcgctggtggccgtggtccagggcgatgacctgctgccagatatggtggcttcccacggtcgcgcccaacagtagtggcgacagcatcagaacagacagcttggagttgaggaagttgtagtgcgtaggctgggcaagtggctg

SEQ ID NO: 47332 - DNA, 1501 bp, Oryza sativa
tctaacttgagtgcatggctaaaatggagttaatttatatatatagtataagcttgaatttatttatacatataacatacttatgtaaagttaaaatagagtatatatgtttttatagtttaatgttttcgtatctgttactggtttctaatctgtactgacatgtttccgtccgtattgctccgtttctgatttttcgatatttctgatatcattttcgttttcgattttactgtttttgatttcgttttcagaaaaatatggttatggaaatggtggtgtctgttttgccgttgtttcggaccgttttgatccccactcccggatatgctgctgcctacaccatcaattattgggggtggtttggattcggttcgtctggattgtatgagattcagtcaaatgggacagccgagcacaatcatggcggatgcatattcagcttttgcagcctggggatgcgatgctggaggagagtactctacctctaccagagtcgtcgcacaaggggagcgtccggatcactggatggatgatggattggatctactggtgtagtactactgtaccagtgctttttctctcccaggtgtacaacgtagtacgaacggattatgctgacgtagtacggttccgtgcgtagaaaacggtgtacgtgtacagtgcactgcccatgtgaggatcgagaggggggtgacgagggacgaggagcagttcggctgacgcaaccgcccaaccgcaccgcatcaccgcggctgattaatttgcctcgttcgcccggggcaaatcaaccgtgcgtgcctgcagcccagcacgtcgcgcgcgcgcgcgccatcgatcgatcgctgctgccgtggcccgtgctacggtgcgggtgcgtccgtttccagcagcccgcggggaaggggggacatggagatgcgtcggcacgggacaccgccacggctgcgcgtacgggcgtgtcacggcgtgcgcgcctctccggtttttacggggaggtgaggtagggggggggggggggcgcgatgcggtccgagcacgggacaccggtgccacggcgtcgcgagcgtggcttggctggcacgagcttggtatggattagtctaatcaatgtactcacatgtgattaggtttttttgacggaaggaatatatccatgttcaaaatgttataaattagcaccgcctccccctacttccctaacctcttccttaaggatccgctttctctctatcagcaccaccgtcgcctcatcttttctctctatggatgtggagggattagaaattgagaagtttcttgaggggtgaataagatatttcgcaaatgagagaatccaacggcttgaaacgtctggagtagaaatcggatggctcataattttttttgatgacgtggcaaattaccatttcgagaatgattagctcttccactattttagatatgaaaaagtacgaattacccctgttcccaaactattgtggtcgtctgaattaccccc

SEQ ID NO: 47333 - DNA, 311 bp, Oryza sativa
tggaggaacctcggcgactatttctaagtacaccggagcgtcagaggaaccttaatctagcgacatacaagacaaacattgcaaacaggctaaagactactgaaacagggaacaaaacaatttttaatggattctacacatttttcttgatttactgagacttgaatgggcttaaacggagctcggatgaattagttatgaattttagaagattcactgtgtttattactataaaagaaaaaccttaaatttattgcgcaataaatcccagggctgacgtcagcacggggggagaaggcgcggcgccgaca

SEQ ID NO: 47334 - DNA, 1501 bp, Oryza sativa
cgagaggtggtaactggctgcgcttatgtaggttcgtctcgagggtactagagttagcttggacttagctctcgtgcgatggaattgctgggagtttacgattgcgactgctgtggtttgacttgtggacgggtgccgattcttctgcggatgttaactatcaggccttaagtcgctgttagttcgttagactgtagtgcaatcaactggggttcaggtaagcatggaattctctcagcatcaaagctcaatagtacacatggccaaacagaacactgggtttcgttgattgtaattcagctgcaaaagttcaccttacacccagaaacctggtgctctatcacgagtggtgtattttgtatgtatcgccacgaaactttaggttatgcagtatactggggggctttatagaatgtaatgtgtaattccaaacagaacctactttggctatcatccaatcggtggcaaatgagtgtggtctttggtacatggctggaacctctaaactcagtgagtttcttaggtcgctaaccccggttgggtaaggtgtcatttaaatgtaagcgttgtatgtgtttgtggtgagtgggggcgtttcagctcccatcccgtgtttcctcttctctcttaatgaaatgatatgcaactctcttgtgtattcaagaaaaaaaaaacagaacctactttaggtttaggtgtatatgttgccttgtacaatatgcatgtgatccttcccatgtgaatgagcgactgaaccatgcacgcaggctatcactattggtgatacatttgaagttctaggaggcaccaccgattatgccgttgtgttttactgaaaactgtgaccttgacaactccttgagtgaagtttgaaacattatttatttctagcacagtgttatgccattcaaccaaaacatacttgatatattgcactcccatggatgattgatggcagtggagataatttctttatctaatttatgactggcttaaataagcgattggtgtggttaagcaataaaaaagattcttcttataattgtagttcattttgcattgagtttgcaatggttgcttttactgattaaagattgagttgaaagaataatcataaaacactcataatgctatgggcagtctgtttctggtgttgaatcacactaattacctaggaaaaacataaatggaataacccattgtttttatcctgcaattttttcattaatagtaaatgctaaaatgtctgttaccatatgtatttcagccttttgggggtaaagaaggtgcctgacaccaccttgtggtcatcaatttgtctgcttctagctccattgccagtgcattgcggaagctgggggttctatatgggttgttaagaaaatcgtgcgctacacatgttaatctgattggcagaatatggtaattatcagcttgaataacaccgtgattagtacctagccaattagacataccacaaattatttcatattcaatatgc

SEQ ID NO: 47335 - DNA, 1086 bp, Oryza sativa
ttctctcacgttgccaaacaaatataagggattttgattagatgtggtacatcaaaattttatatttagggacggaaggagtagtttattagtactagaaatgacacaatcacacaaactacgcgacattctgtacgatctgggagctatacgcttttgtgaaaggttgggacgttggtcgttcggtgacccaacccctccaaaccatcgtcaacccgggtgctagctggtgcttgacacgatcacacgcctccgcttgctgacgctccaaaggcgaccatgatatccctatcctttgccttcgtcaaaaccacctcacacccccaaagtcccaaaactagcccagacagtccgagaaaccgttggtcagttggccagtttcactccccccggccatctactcgcatccggccctgccgtcatctgcatgatactggcacctcagagcatattactatcaccaaatcgcagtggaaagcgtcgtaaaacaggtcgatctactggctgatccttttaaaacttggcgcggttaaaatgcgtcgagctactagcaaacaaccggcggccgtacgcgcgccattgaaatcacggcttcaattcggtgtgccgcccgccgatgcattgaatggcgtaggtgagagccgcagcgaccggcaggcaggcaagcgacgcgcgcgcactggccgcgccgcgccttcgatcgatcgacggccacccaacggcccctgccggcgatttatggtccgcccggacgctcgatatatactgtaccgagcatgcacttgcagctggagtagagtggcatcctggcaactctgtatatatatatttttcccttctgtatattaattgccatccatcgcattgcttctcgggcaggttctactcctatatatcgtctcgcttctctctctcgatctcaggtcaggggcgctagctggccactggcgactcacacagtcacacacacacacactctctcgtccttgctgctagctatctatcgctgcttgccccggcccatgcatgtgagctcacttattatagatcgatcgccatagcctagcttggtggtggtggtggtga

SEQ ID NO: 47336 - DNA, 1501 bp, Oryza sativa
gattaggaaggtgctttggggtaataaagaataagactcaagcgtgtgtcaagaaacaaaacgaacccctggatcacactagcttgcatcagcatactagtatttcttttttctacttagtcaaccacatctattaatttgaaaacgagtgcagttgaaattccatacggccttaccggcatacaaaaggttcacatattcttcctttttagttttggtttaacacagtgttccttcgtttttgttactaggcttcaaaagaaacaacgaaaagctccttttgttttctggactcgaagttaggtcttcacaaatatatattaattaaggacaaagaaagacctagactgagtttgcatcaagaatcatgatgaacccattcaggccttcacaccactctagtgctgcaattctgaaaaccagtttacttgttatatacaaccacagctgtttaatctgagaagaattgataactgaagaactgtaccggtcggtcaccaagggtacttattactgtactttcttaccttggactgcaaacaccacacatatgctagccttcaaaggaacttttgtatattgatatccgtaaagagaagaaaaaaaggttttatgacgtatattggagagaaacacatgaatggactatttccttagtttatctttttggcctcttttcccatggaaatgatctcacttcggattcatgcccccaacccatccgtgtgggcgacgaagtacactgaacttccgaatcgagtttgactctccggatgctttatcagaagcgcaatgcggcgtcccgtcacggcatatcggtccgaaatggtgcgcggtgcccgtcacggggcaggttggcgctgctgcgtctgctactctccctgctcaggccacgcgccgctgaaagagattagtagtggaagaggtggcatccgcccgctctctcgcgtagcgtagacatcagctgagcccctcgcccctagccgatcgacgcggggcgccaccggcgggcggcgggcgaggcggctccgggtgttagcgattgccagagcgcgcgtcaccgcttgctgaggccagaagccgtgaaagcacatgccaccatgttaataaaacgtctttttgagtcaagatagacttaccaggtcattacctccagcccatagttgattccgctctgagttttgtaagccggaatatcttctgggccggcttggctcgtcacattactccggcccactgttgattccgttctgaaaaggggcgtactttgttagtgctgcctgcgcctgattctgacgatgttaccgaaagctagtacagcatatccctcaagtaaaatggctattgctagatcaataaaagcacgtagtgctatgtgtttctacacctccaaagccgaataaaatcggctgtcgcaccgccgcaagtatattgtactgcctgcataaggtgagatagcgtgatcccgaggctttctttgaatcttcctttccctccggag

SEQ ID NO: 47337 - DNA, 1501 bp, Oryza sativa
atttctgaaaaggatcatgcagaaatgcaatgttagtttatgttcccacaagcgcacagccacatctggatcgaagctctcctcagcctgaacccaaaattcagtagtcgacctgcaagatccccattgacgaatacaacaataatctcgcaattcgaacgcaatcgctgacatacctggtgagcaattccgtcatctggcccaagtagtgctcgttgtacgcgacggtgtcgccgtacaccggctcgtgccggtcccacggcgagaggtacagccccagcccgataccttcggcgcgcgcggcggcggcgagctcgccgacgacgtcgccggcgccgcccttccacggcgaggcggccaccgagtagttcgtcagggccgagggccagaggcagaagccgtcgtggtgcttggccgtgagcacgacgcgcccgaaccctcccgccgccgccgcgcgcgcccactggcccgcgtcgagcgcggagggcgcgaacacggccgggtcggcgcggccggagccccactcggaatccgtgaaggtgttggggccgaagtggaggaagagggccatctcggagagctgccactggagctgcgcgtaggaggggacggggaggaccggcagaggcggcggcgtcggggccgcggagccggtgacgccatgggcgcggaggagggggaggccgacaagcaacccaagaagaagaagaagaatggtcgccattgtcactcggtgatccctcgatgagggtgttcagttcacctcagcgtggcgtagagttgactgctctatagtttctgttgttgccaacggctgattattgaagaattaagaacaccgtcaagaaatgattagctataagcaagaaaaaatcaggggaaatcttgtaaataatctgaaaacatggacacgagtaggggaatgaataattgtgtgtgatgtctagccggatttttaatgatgtgaagttaagaaagaaaaagaaaaagaaaaagaagaaaataatgcaatgggttaattaacagatgatctaatagatcacatacagtatatcactgcatataataccatccataacactaaatcattaattatttactattattacggataaatcgttatatcagctacatgtacattatattgatatgatgtggaacgattatataaaccataacccattgaaccattgttcaagtcaacttatgaaagaacatggagtacaaatagattagagaataatgctatatttttatattgtgggaaaaagaacaaatatattagagaacgttgctacagagtatttgttaatcgggttgttcactgcataacttaatattttcttcgagtaaaaatgttgctacagggtgataaatgatttaacttattctaggataacaattatggacaaaaattatattctattatcttaaaaaaattatggagagaaatttcaaatgatgtcgtcgttgacatatgaatcccatgcgatttacacat

SEQ ID NO: 47338 - DNA, 1501 bp, Oryza sativa
gcactaacaaagtacgccccttttcagaacggaatcaacagtgggccggagtaatgtgacgagccaagccggcccagaagatattccggcttacaaaactcagagcggaatcaactatgggctggaggtaatgacctggtaagtctatcttgactcaaaaagacgttttattaacatggtggcatgtgctttcacggcttctggcctcagcaagcggtgacgcgcgctctggcaatcgctaacacccggagccgcctcgcccgccgcccgccggtggcgccccgcgtcgatcggctaggggcgaggggctcagctgatgtctacgctacgcgagagagcgggcggatgccacctcttccactactaatctctttcagcggcgcgtggcctgagcagggagagtagcagacgcagcagcgccaacctgccccgtgacgggcaccgcgcaccatttcggaccgatatgccgtgacgggacgccgcattgcgcttctgataaagcatccggagagtcaaactcgattcggaagttcagtgtacttcgtcgcccacacggatgggttgggggcatgaatccgaagtgagatcatttccatgggaaaagaggccaaaaagataaactaaggaaatagtccattcatgtgtttctctccaatatacgtcataaaacctttttttcttctctttacggatatcaatatacaaaagttcctttgaaggctagcatatgtgtggtgtttgcagtccaaggtaagaaagtacagtaataagtacccttggtgaccgaccggtacagttcttcagttatcaattcttctcagattaaacagctgtggttgtatataacaagtaaactggttttcagaattgcagcactagagtggtgtgaaggcctgaatgggttcatcatgattcttgatgcaaactcagtctaggtctttctttgtccttaattaatatatatttgtgaagacctaacttcgagtccagaaaacaaaaggagcttttcgttgtttcttttgaagcctagtaacaaaaacgaaggaacactgtgttaaaccaaaactaaaaaggaagaatatgtgaaccttttgtatgccggtaaggccgtatggaatttcaactgcactcgttttcaaattaatagatgtggttgactaagtagaaaaaagaaatactagtatgctgatgcaagctagtgtgatccaggggttcgttttgtttcttgacacacgcttgagtcttattctttattaccccaaagcaccttcctaatcctacctattactttggttaactttagaagacactgactctaccaactaacatgtaagcaaacactagttgcataaccgttggttgagaagagtagacgagaagggacccagtctagtagtattcctctagaagattaggttgctgtagccatgactgtgagttgtgactaggttttttcagtgggcaaggcaacaccctacacatgaagccttgaagagttggt

SEQ ID NO: 47339 - DNA, 1501 bp, Oryza sativa
tcgctgtatagcaggtggtgactgctccatgtgtccgttgccgccgtagaatgatcgatgccatggaacgcacaatctgaggaggtagggaaccacacatcgccggcgacttccattgcctgctaggctgccaatgtgaacgaacgggctctgcacgttctttccaagatgaggtggaaccggttggttaatggttcagaaggcgccgtcagccatggccatcgcccatcggcgaggaaacgaggcggggatgaaagtttacgtcccatataaaagccaacgcaacctatcacgtgcatgacatgtggggtccacaaactattcaccatcggatcgcttatatgggccgcaaaggccctcatcgaatagctagctgtgagatggcccaagagggtttggagttaaaaatctaccacgtgttataatacgtgcagtgttttttttaacttttaccatataaaacgtgaagttttctaaaattcattcataaattttacacacacatgtatgtgtacactttagacctataaaaaatattttatatatacatatatatactttacacatacatacgtgtataaactttatatgtatacacgagttcgtacgtacacatggactctcaaaagtgattggcaactgacagctaaggactctttcggtaggactttaacttctaaatttagttttaggagctgggtctaaagtgaaattgtgaagcagcctaaaaacaactctataactttaactcattttgtgagagtatttcaacctggttcacctttttaggtggagctgaaatcgtttggttgggcttcactattaaaagagatggagttagcgaagtgagcctatctcaactggttaatttctttgcagtggaaccaatccacccgggtttaaatactatattttacacgggtgatcgtatttacagttaattaatttttcagtggttgacatacccatcgacaacgagtacttaggggtaaagtgtgcgtatatgcgtttataggagtgagtatatacacactgcagtgtttgttttttcaagaaaagaagatgtggagctgtagcggaaaatttgacacccagaacttaaatatagcgttttcgcggtttcgccgcgaaaaaccgagcccccggccccccgctcgcgtccgaacgccgagacctgggtgcaccgcgacgtggccagacgccccgctcccgcgcgccgtgccgagacgcagaccgcgccgcagccgaaacggatcctccgcatattctgccggatcccgcggcccccaccccatacgccggcacgcgttcccaacaccgcaagccatcctggccgtccgtctcccgtccccaaacctcaccctgatccaacagctctcgatctgatcgtccccacaccgcacgctgacctatttaaccccaacaacgctcgtaccatcacggcatcatactcgctcgtacgaaagttttacgaagcgaaaatctcgagcagaacagtcca

SEQ ID NO: 47340 - DNA, 1501 bp, Oryza sativa
tgtatctattaattaagatgttttaagtaatttccttagagatatgtttgggcaagactctgccgcaaagacttatggtatcttagagtttgttagagataatagtcgtgtccgttatggacgtatcttgtaattctcgggtataaatagacccgagccctatgtaacttgggacgaacacacacacgctcaatacaatttcggcgcatcgccaccctttttgctttagttttatttcgacgagttcttgatttcgggttgaactgcatcggtttcgatcttcaacaaaaggtaaaacttgttatgacgacttgtattctcgggattagtgcttccatctttatgatactctgatctcgtttctgtaattcgtcgagttatcatatatcttacataatctccggcaataccgctatttaatctacaatcggctaacatctgtcggtagagggcagccgattaggttagattgcgacgttgatttagattatataagatatctaccactctatgaaacttccaacggcttgattgtctagatattgttcttcttttcatacttaatgctgtatcagtttagtttgatctattaagtcgtgcttagaatatcaatctatagcatgccttttggttgccgattagggtagtattggagtttcatccgattttacctgatttaactatatttgccctatatgctttattgacatgttaaatctaccgtttattttaggatcttaatgcatttaagtatattaagcttttgtttgatgtattctacctgctttaatatcttagtatagagtggtatcggggtattagccgatacatgctagatctatctgatcgactatgctatgaacatatatagtcccattattaatatatatttcgatctaagtgatttatattgtctcggcatggcgaccgatctatcccaatcacttgatttaagtatatatcgatataaggagtatatattgttattatctacagccgatcgattagatttagttccttcttatttattcatgaatgccgatcgatacatatgtgtcatcggctcaaagataaatgatatgtcatcggcacctagccgatcgactatcatttatagatttaatcgcgatttctttgcttctatttcttgttgattacaggatcaaatcaactggcacgctaacactcgaaggcgagctttggacctgcactggagttaagcagatctcccaggcctcgtgttttctgtcaacacttatctctcttcttttctctttgtatcttcctccttccatgttagctctttgtctacgaggcgaggcggggcgtggaggccggagccatgttttcgctgctgctcccgacaatggccgacgcgacgtcgtcgacgttgctgggcatcaactatgctgcatcggcaacaaccatcagcaacgaacgtgctcgcgtagctcgaactcgacaagtagatgttccgtcaccaccacgcgcaacctcgcgc

SEQ ID NO: 47341 - DNA, 1501 bp, Oryza sativa
gtaatatctcccacggtaggatggcggaactcaagtcttgttgtgggtttccgtgtgtcgacggtgggtacccgtagaccggatatagagggtattggggtacactggtacgaggatctacgtagtacgacatcaaggaaacaagagacatagattatactggttcaggcccctcaataggtaatagccctaatccagttaatatgggattatatggagagaaccacaaattacaaagggaataaatggaactcgacgatacccacgagatcgtagtcgagttgattcgactagatcacccggcgacttggctcctgtaggctccggcttcgtaggctgtggtcgttgtgttggctataagattcgatgccttaggtcctcccaggggtcccttttatatcgcagatcaggtggtctccaagtaggacttggagacatcggaccctgcatgatatagtgatgacccagtcctatacgggtaggaacctttccattagtggacttcgtgatggatttccttagcgtatatagagaacgtccgtacgcgcgcagatgtaccatattaccgtatagcgtacatccaaaggtagagggtatagtttatccgtaatcctgacaccgtgtccaatgtatgactgttcgtcttattaaaaaaattaaaaaaataagttaggtataaagtattattcatgctttatcatgtaaaaacaataaaaataatattcatgataaaattttaaataaaacgtatagttaaacgttggacgtaaaaaatcacaaatacacttaaaactggacatatggagtcaaattttcgacacattttgctatcagcaacgggtttccggaggatctctgccccagaagtgggtcaaacgcacgtgagatcccgcgaagcacatcaatggaagaacgaaagcccctctccctttttcttttttcccttttccttttcttttcaagccgtaatgaagagatcgagcgagaggcccaaaatgaccagcacagtgcgccgccgctggtcgcggagatcacttccctccttccgagttccgagcagtctccggcccggcgcatgcatgccccgctcccccccacgcatatataatcctcgcccgcgacgctcccgcgcccgggtagcttagacgaccactgctcatcaccccgttgctctcgcgccgccctccccgccgagccaaaaagccttcctcctcgaaatagcacacctctcgccgccgctggtgcgtgcgtgcgtcgacgcgcgcgatcgatcgatgcctgtgtccctccggcgcgtccacccacgccagccggcgagcctcgtcggcgagtttcgggggcgctgattagatttgcccggtctcgatcgattgatcggtctcgccttcccgccgcgcgatggatccgcgggggaagggcagcatcacgtcgcatgcgtcggacaagtcgtcgcggtcgggctcgttcgacttcgagcacgaccaggacccggaccgcgacc

SEQ ID NO: 47342 - DNA, 334 bp, Oryza sativa
atgatattttgaataaccacatctgcatctggttgggaagtcattcatgatatggattgtatggttttaaataaatcacttatggtatgtaacttaggatcattagcaagtaaaggcaagttctccctaatcaattgaagcgcctcaaccattttttttttcaaaatatctttagatctggcttgtaaaaagtctgtctcttgccattttagtatatactcagatgctttcatttaggatgaacctttacatgttcaaaagtctatcatttcatccattacagcctagaaaagtaacttgttgtccagtccatatacttatttatgctagcttt

SEQ ID NO: 47343 - DNA, 298 bp, Oryza sativa
aaaaaaaaagcatggtcacgtctcatcaccaccctccctcatgcacatatgtcaacatgctcatgcacgtagctctacaagtacgtacgtacgtacatacatacatacccctccgtcccaaaaaaagatcaacctagattcgtaactaggaattcattttttttgacagagtagtatatatgtatatatacacaaatgtgtacttgtctactcaccttgaggacaagagggtaagagttggcggcggagtggtggccggaggcgacggaggggtgacttgaggtagtggggtggacga

SEQ ID NO: 47344 - DNA, 536 bp, Oryza sativa
cttgtttagttccaaactttttatccaaccttccaactttccatcacatcacatcacatccaaaaacttttctacacacataaactttcaactttccctaaacttccaaacttttccaccaactaaacacacccatatttacttaaaataattgcttacacccaaatttagtacctaggatcgaaataggaaaaattgccaaagtttggggctctgccgatttcctccagagagggccggtctgaccgctatatgtgggccggtcagaccgacaccagagggccggtcagaccggcgggagttcgagtcagacgccgtttttgtcgggtctcgggtttccttgctcgggaaggcatgtttcaggattccattggtttctagctcgagttggacgtggaggagggcctgtagagggcaagatcaacccctatttaagagacaaggccggttcaattgtaacccccgaacacataatatacttgaatcgctttttcttttatctttacttttagccatgttttttactttaccctagt

SEQ ID NO: 47345 - DNA, 298 bp, Oryza sativa
gagtcgcggcgagaagcacacacgcagccggcgcaattgtcgcacgtacgatcgcctgaaatcagtacaagtatatctatgcaggcaaagttccataaaccaatttatatgtatatataataatctcatttttacaacacactgttaaatgtaattgaatttacatcaaattaattagcctgtcgtcatgtcactgattgagtcatatacaaatcgatagcatcaagattggctactcgatcggtatttgttaagaatcagccccattgactcaatcaagtatgatgccgtttacagc

SEQ ID NO: 47346 - DNA, 178 bp, Oryza sativa
atttggcggggattgctagaataattgggctaggcccaacttataatattaaatctcaaaggcccataataagtgttgaggataataataccacctcaggatttaagcgagaaatatctcaacctaaatagggagttattggaggctccctgttgaccagttgaggtgggggtcggaa

SEQ ID NO: 47347 - DNA, 156 bp, Oryza sativa
agcatgatacaatatgacaatagcatattactgcaggaagtccatcttaacgtcagtgacatcgagttgcagtatctcagctctgcagcttaacatgacgccaacactgcaagagcagcaaggtcgttaatatatatgatatgatttaaaggaaca

SEQ ID NO: 47348 - DNA, 1501 bp, Oryza sativa
ccgacaaccaccgtggacggcgacgcggcggcgagcggctcggcgcccccgacggccgaggcatcggcggcgatttccgctccattacggtgggatctgcaccggtccgttcccggccgcggcaggatcacggtgttctcacgcccaaccgcagcaggaacggcgatgggcggactgcgagcctcgctgttgtgttgaatgcacccttctcctcgctctgctctgacctttacgaccggtgctggtggccgccggtaggcggcgagcagcaaggaggggggaagaagaagggtgaaattttgagaggtttgtttgctttgagattagtgttaaatcaggtggcccaagttcagatgaaggaaggaggtctctctctccataggactagtctgaactagaggggattaactagggtttaatcaaccgcgtcgaggaccatggcggccgcagcggaggtggatgcggaggcgaggagcatcctcgaacgcgcagcggcgtcctccttcccaccgctccacgccatccaccacctcctctccgtcggggttcgtcttctcagtcatgccctctgctgcacacttttcactatccaatccatgttcaacttcccccaattccgatttcacctattacggaaatatttttggatagcgtactgggtgttacgtattgttcgtgtattactacgattatgttgtgggatccatttcctcccctttactgaatgaacatttcgatgccatgctgaacccaatgatttttcagtttcacacacggagaaatttgtcaacatttttgcacaatatttgcaggtctgtgtgcggtgcatctttcggttctttggagcctttagttatgcagcaccatgcctttctcttacggcatcagttctgcattcgtttcttgaagagcatgacgattccgcaaaaagtgggtcttgttcatgtttgtcaaaagatgaggcgtactgctctatttgctttggagtgttactgcccacctgctatcaagatgatggtgtagaaccactccgtagtgtttctcctatcgataatgttacttcaattatatctgaagcagtccagagagagggtcaccaagtcgatgagttctccctagaaatttcactgcctgcagttatagcagctaatgatcgtgccattaggtaaccatctgcacctaagaatttttgcctcacttttttatacagcaccatgaattggtttgtgactgaagggggtgccacatattaatcatttttaaaagctaaaattatgtaagtggtgatatataatgcaaccatttgtaagtgaaaggtatttacatttttttaattagcaaaaaattcagagaaatgaagtatattcagtcttgatggataataattatacttcaacaatttactgtgtttgttctcaaccacagatggaactttctgttgtgtgcttatattaaatctatgatgacactgcactggcattttcataacgtgctggcattt

SEQ ID NO: 47349 - DNA, 999 bp, Oryza sativa
atgcatctgattcacttaatatttgtttatcatcatctgttgagccccttttactgcttccatctcttgattctgttgagacatcagacaaaacaataaaataaaatgttgaaaaatgaccgcccatcaacaatgcagtctttcttcattaatttctatacctgtttttcttttacgaccacggtcatttggcagaagccttagaagcttttgtgaaccttcatcatgagtataagttaagcgaattcgaaatgaattattaccatgtttcacattctgcacgaaattagtcaaccgttttgagataagtaaacaagcaatgcttgatttcaggagatattatcagaaaaaggcatttaccatttgtttttctactgacggtactagcaatattctcaaggcctccttcactgacattgtctgttgagaaaatattttttcatcgaaccaatttgcactgccatatttctctttcatatataacctattaaagacacaaatgccagcacgttatgaaaatgccagtgcagtgtcatcatagatttaatataagcacacaacagaaagttccatctgtggttgagaacaaacacagtaaattgttgaagtataattattatccatcaagactgaatatacttcatttctctgaattttttgctaattaaaaaaatgtaaatacctttcacttacaaatggttgcattatatatcaccacttacataattttagcttttaaaaatgattaatatgtggcacccccttcagtcacaaaccaattcatggtgctgtataaaaaagtgaggcaaaaattcttaggtgcagatggttacctaatggcacgatcattagctgctataactgcaggcagtgaaatttctagggagaactcatcgacttggtgaccctctctctggactgcttcagatataattgaagtaacattatcgataggagaaacactacggagtggttctacaccatcatcttgatagcagg

SEQ ID NO: 47350 - DNA, 1501 bp, Oryza sativa
tcaaaccaaagataagttcatctacagaatagtgcacataatttgtacaaactaatgatgaaaatgagcaagaacgcagattgactgggtgcaacgcttgagagcgtttctgtgtaaagtgaacttgccatgacagaagaaacggctccgacaaacggttgtgcacgttgacgatcaagttatcattcgtctggcagtcaatctccggccccggaaattgcccattgatcagaataccctacatgaagaaaaaaacacacacaaacaagtactaaaagaattagagaaacagcgtacacatcaaccctgaccaaagatgaacagcagaacagatccatcaaaatctacacctgctgctggacgccgagaggattgatgttcccagtagtaacctcccaatcgaaaaatctatacggatcttctgcccgtgcggaggagacgaagacgaacatgcagacgcagacagcggccagggctcccatgcttcgccgtgacgacatgacgccggtcgacgctagctgccgggagacggtggtacggcggtcaggcggcggagatcgatagcgcgcgcggcgcctgctgtggactctgctccgggtcccgtacgtcgcacattttatagatgagatctactgggacgcaaccgcaacagcatcgatgtacgtgaaaaaaatcatcgttattgagtttaggcagggtggtttagtttaggaggaattttaattctgttacaaaagagataagatattacaaggggattggtaacagaatttgtggtatgtctatggagcgatggacggtcgtaaaattcgtggtgtttctgttcatcttagctgatgcctttggggatagacgaacttccaagttccaatgtcttatctgccctttgtttgtccggttttgttcatgtccttatattttcaacgcggaacagttttatggatatctcttctacatgtccagcattgatacgacctaaattaaactggtccggaataagttttgtgacaaagttgtgattaatttacagaccgcgcgtgtactcatatgtatgcgtaaaggaaaggaacacgtacgtttgtgctcattgttgactgcattacaaggcagtattaccaccgatctcaacttggaaggcaaggttaaaaaaaaatacaagacagttgtagccaccgatcaactggtaaatttacaaggcaaattttgaatccgtatttgccagcaacgcggactatcatagctagtatttttgacttgaaagaaaaactggtaaaactcttgggcacttcaccatgagatcgtccaaatgggccggagctgcaccgcaaaagcagcccacgggctacaaagcacgcgcgtcactcgctctcgcggcaaagcctctctccctccccctctcgctgtccggtgggcccaggtcgtccccacacgacagcgctccgcctctccttcccgactccaccgaccccccgccgagctttctcgcctcccgcgaagtcgc

SEQ ID NO: 47351 - DNA, 348 bp, Oryza sativa
gtatgcatatagttttacatatttcacaaaaattttgaattaaacgaatggtcaaacatgtgccaaaaagttgacggtgtcaaatatttagaaacggagggagttacattttcaatccaagaaaaaattattatgaaaatatattcaagtttagtattataaatattactatatttgtctataaacttagtcaaacttatttcaaatttgactttgaccaaagtcaaaacgtattataacctgaaacggagggagtaattattattaaaaaatagttattaccaaatggaaagtatacagatcatatgccatcacaggaagtcaaatcttgatcacacctaaacgcaa

SEQ ID NO: 47352 - DNA, 535 bp, Oryza sativa
tattaatttgattttatcacactgaacacatgataaagcacgaaaatttaataggttacatatgcatgcttataataactaacaatttgactaaaatgatttgctaattactattaaatggttatatattatgatgaataaaagttttatgattatatttataacgctacacacactcgatgatataacggagggagtatatttgaatacctataaattttcataaaaaaacaagtggtcaaaatttaaacttgaatagtgttattaccaattattcgaaaacggagtgactatatatcatatatatgtatggaaaacggctcaacaacatcctaagcatgaaagcatccaaattttgctcggttacacatcaagtgatattataacatgtcattaataaagggcattatgcaactaatatcattttcaagctgggatgaaacttggtgtgatgggtcacgacctccttgtgcatgttaattttgtctctatataatcgagcaaagattatcttttttgagctaagaaagttcca

SEQ ID NO: 47353 - DNA, 295 bp, Oryza sativa
gcaggtcgactctagaggatcccccaaaaatataaagtacttactttagctaatactcctataccataaattttatggatttaaaaaagtatcttatacagagttatttggttcactaccaaagttttatggatttaaaaaagtagcttatttggttcactaccaaagtttatctcaccatgtcatagcttagattaggcaaggtgtctatttagtttgtgccacgcttatggcatgattcctccatcgtgacgtgggtccgatatatcattttgcatataaaagtgtggcaagg

SEQ ID NO: 47354 - DNA, 450 bp, Oryza sativa
agcttaaaatatgtcttaccaagccagcagttgagcatgatcacacgggttcaattttaaaagtgcatggtataatgagaacgagatgctgcattaggtgtccattttagagcaaaaggaaggattatgagagaagttgggaaaactaaatgatttccttggaagatagctaaacttaatttcaataggtggttacacgtacttgaattcattctatcaatcttgtatggatgtatgtaaactctaacaagttctcatgacccctgtggggctccttcacactccacaagttggcttctctgattatgccagtgaacaatttcatcacctatttgattgcttgtgtttgtcatgattcagcatgcacagcgcgtaggttaaatggtcatcatactgtacttattgagatctgtcatagggctcctcagttcttttgtttttgtatgcagg

SEQ ID NO: 47355 - DNA, 818 bp, Oryza sativa
ctatttcggttttgtgattattgaaactaaattctgtttcttggatataatttagattttatgttggttttattattttatctgggtgacattccgattctgaaaattttacatggctatgcaggtccttcatttgtcttgggggttaactccatgctttattttatttcagtatgtttgtcccacataaaaaatgttaccaagtacctgtaacctagtgataacatcgtatgtgttcatgattgtttcatgttagctgcaaaaatcatttgagtatatgcaaatgaaaacctttttcacatttcgtaacctaccttttcctaaaccaaaccaaaatttgccacccattgggcaatattaaccttgtctgctgagtgttgtggtttaattttaaccttgtctgctgagtgttgtggttatttgatagtacctttgctgccgaaattttgttgtgagatatttagtaagataaacggtggttgtttttcttgttctttcactgtgttacgtataaagtaatagagcatgctgctttgaagaaatcagtctcattattgattaatttgtacaggagacaggtatcatttcttatttagcatgtccatgtccaatttggtatcatgaacagagcttgtgtcaacaagaaagttgaatgtactatataacaataatatgacttgtctttgttctgtgtttttttttaatctgtttgcaagtttttcttgagtgaactgtctggttaatgttcccttcaaatcccttatatccctgtgttttggcattgtacaggtgagccagtcatccaagctctgtcaaga

SEQ ID NO: 47356 - DNA, 426 bp, Oryza sativa
cgcaatctggtcacgtggaggcataataagagagatcatgcttgtgccatttcctctagctgactccagagccttgattagcttcttaatcttccagatctcaatgttcctatcagtttcatggctgtcagacatcttgacagagcttggatgactggctcacctgtacaatgccaaaacacagggatataagggatttgaagggaacattaaccagacagttcactcaagaaaaacttgcaaacagattaaaaaaaaacacagaacaaagacaagtcatattattgttatatagtacattcaactttcttgttgacacaagctctgttcatgataccaaattggacatggacatgctaaataagaaatgatacctgtctcctgtacaaattaatcaataatgagactgatttcttcaaagcagca

SEQ ID NO: 47357 - DNA, 456 bp, Oryza sativa
cacgaaagggttaagcattagtgtctttgtgaaagatgcatctcgcctattctatccatgtcacaatctgcctactgatctcaccatggcctaacatgacatgaccaatgatgctacatcactgtttctttaaaaatatatttttggcaacagactgtatcactggctattcacaaaagtatatgtaccaacaaattaaaagttacataacaaaaagaaaacgtccatgtttcatcgcatagtgatactccagtccagtcacttgcacccacagtcccaggatctcagctctagaaacttaacatcaaccaatagaagcttatttggaacaaacacagcattgccatgtaatcatcggacttatggtgcacaaattatccttgttggaacgcattacatccagaaaatttgattatgaaagtaaccccccaccaaaaatataattgaatgtgacaa

SEQ ID NO: 47358 - DNA, 209 bp, Oryza sativa
aggaaaaagactcatcagctggacttggttgaggtggaaataatggacaaattaaatgggctgcaaacaagaaagaattaaattagaaaggaaaaaaaatcaagaatcccaattttgagtgggaaattgaagattcaatctgttaacatgatttttatttgatcattgctctgagactataatctgagatcaaacacgatttttttagt

SEQ ID NO: 47359 - DNA, 490 bp, Oryza sativa
  unsure (1)..(490): unsure at all n locations
aaacaaacatttttcacaaaatatgcctctccaaatacaagctgcaaaggaaatagggtttctataggcatgtatttcttttggccaaatgatcacaggaaatagaatgtttatctaaggctgtcaaaaaagctcgaagctcacaaactgttcgagcttggctcaaccaaagctcaacttccccccccaaagaaaaaaagggggggccccttttttttttttccccccaaacccccaaaacccggaaagggccccccgaaaggnccccgaagcccttctgtaagattcgcaagcctcaccgagccgagcttgaatagctcgtcgagatcagcactcatgcatggtagcattagtcctatagacccttctgctacttggcttaaattttttttatttgtctaaatgctatgctacctaacacacgtcacaacaaagcctcatgtatgctcaagtgctactagtacctactactatcctatactactgtagc

SEQ ID NO: 47360 - DNA, 1501 bp, Oryza sativa
gcgagaggatgcatgtcgatcagcgcggcgccacgtacgtacacggtcagcatgcgaattctctggaagggatgagacacaacggaagtaatggatagataatatgatgtacgagtaattaatagtgtgtgggatctggattacaataatagaaacgatggttgccactgattcaagtgtccaggagtgcgacgtggatttccggacgttccctcctttattctgcgtctagtagtactttttctaagcgtcgacggcattgcaaccactagtttcgttgatacttacttcatgttgacaagtcaaactagtactttttctggaaacactagaaacgtacttcctccatttatttcgcgaaaagaaagttcatgtgtgtcatatcggataattaatcagatattggaaggaacacgtataaaaaaactaatttcaaaacttacctagaaaccgacgaatttattaagcctaattaatccgtcgttagcacacgtgggttactgtagcacttatggctaatcatggtctaattaggctcaaaagattcgtctcgtgattttcatgcaaactgtgcaattagtttttcattttatgtatatttagtgctccatacatatgtctaaagattcaatgtgatatttttgtgaaaaaaaatttagaaactaaacaatgcctaaattttataaatcggtttttgataagttttctggctaaatttgattacttcctccactcaaatcgctgcgtcgatgggcgtcctgaacatgcaacagtgtgcaaccacaacgcagctacaccgtcgccgggacatggttgccggactccggccagcccaggaaaaaatgggaaaaaaatagatgattagacttgaccacgagaaacaatcaacttaagggtgtgtttaaccaaaattaaaagttttgttgaaaattagaatgattaaataaaaagttaaaaatttatgtatctcaggccatacctcaaatgaggaagattttgaccaaaatcaaacataaagtggtatgtcctcttttgactggtcaaaaaagaaagctaataagtttaagaaatgaaaggaatattttggaatagttgtggctttggtgatgcatctaaatttagatttatatctgaatgtgttaaggagcaaaatttggattttattgctattcttgagactagaaaaccatcattcacccccttcaaatcttaaaaacctttgtggtggaaaagattttctttggcatgagaaacctcctatcaagcaatcaggaggaatacttttaggagtaaatttaaatgtttttgatataggtgaaatttcagaaggggacttctatgtgaagtttcttctaagaaataaagaggatggtttcaaatgggttttaatggcagtatatggtgttgctcaacccgagttaaaagaacaatttttgacggaactagctcagacttgtggtaaggagtcataccctctattggtagggggactttaatatca

SEQ ID NO: 47361 - DNA, 1501 bp, Oryza sativa
tataaaattttagcattgttaaattttggaaagacactaaaccaaataccttcgtgctaatgctatcctgccaaactttggtaattttagaatttttcattcttaaattaaaattctattatcttttggtaagatattaaactaaatacaaccaagattattaaaatttggtagtaccaaaatatgtcaaaatttgacactatcaaatattgaaatggataaaagtggctacaatccgaacagttctgaaatcaaaccgaaaaaatacaataaacttgggaggaagacgacgtacggatgagctggagctggagctgccggagcggcggaggacgccgtcggtcttcttgtcctccctcgccggctcctggatgtggccggcgcccatcccggtgggtgcgtttccggtggtcactgcagggttgccgtgctcgtcggcgcggctgctggcgtggccaccatgctgcccctggtactccattctcgctatacctagcctgctcgatctacaacacaaaagctaatttgctccttcgctttgaaaagactctcacactgattacctgattggcactgaatggattccgattactgcaaggttttgctgggtatttatgctgctccggcgagggataaaatattgcaaccggatcatgtcagagacgaggacagcacggcacattgtgatccaggtgggcgtaaagctaaacaatgctgatcgagcatgatcagcgagaggatgcatgtcgatcagcgcggcgccacgtacgtacacggtcagcatgcgaattctctggaagggatgagacacaacggaagtaatggatagataatatgatgtacgagtaattaatagtgtgtgggatctggattacaataatagaaacgatggttgccactgattcaagtgtccaggagtgcgacgtggatttccggacgttccctcctttattctgcgtctagtagtactttttctaagcgtcgacggcattgcaaccactagtttcgttgatacttacttcatgttgacaagtcaaactagtactttttctggaaacactagaaacgtacttcctccatttatttcgcgaaaagaaagttcatgtgtgtcatatcggataattaatcagatattggaaggaacacgtataaaaaaactaatttcaaaacttacctagaaaccgacgaatttattaagcctaattaatccgtcgttagcacacgtgggttactgtagcacttatggctaatcatggtctaattaggctcaaaagattcgtctcgtgattttcatgcaaactgtgcaattagtttttcattttatgtatatttagtgctccatacatatgtctaaagattcaatgtgatatttttgtgaaaaaaaatttagaaactaaacaatgcctaaattttataaatcggtttttgataagttttctggctaaatttgattacttcctccactcaaatcgctgcgtcgatgggcgtcctgaacatgcaa

SEQ ID NO: 47362 - DNA, 495 bp, Oryza sativa
tatgcatcgcaaggcataactagtcttcctctattttggtaatattgacggtcgaaactgttcgctacggacggtcaacacagaccaagaacaagctattcacattcattcaattatccagcaaatatcatcaacactactggaacacccacatcacagatcaaaatcgtgctgccatggacaaaagctacacattcaacagaacaagaacaccaacaccatattggattcaccactgccgtcccagcagagacaacggcgttgtcattgatctccctcaagttgctgctgcatccatcatctccttcaagccacactggccagatgccaccacgcccaagctcatggtggccccgaacatcgagtggccaggtctgggcatggggagcttgtggcagcccctgagagtggtgtaggcgattgagagcttcttcttggcatggacattgagggggcaattggcagcagagatatgtggggtggtggggttggagg

SEQ ID NO: 47363 - DNA, 1196 bp, Oryza sativa
cccccgcccggtagcccgaagacaagtattctcgatcttataacgcaatataattatgagtggttggacaagaaccagcaggtcatcgacagcttccccggcgccaacacgtggtggaaccagctcaaggacaagcgggaattgaaagcacaagctggtgttcgtgttccacaagcgccaccgtgagctcatgcagagcccctacctgcgcgacataatcctgcgggggcacgagccaggaaccaagagccggctcagctgagagataggtggctcttcaccaactgtggcagtggtggtaatacgatgtggtcctgtggagccacatcccgtggaaacatgcacccagccacgttcgttccacactcgccatggaccccgccaagaaggatgagatcaagcacgtacgttgtttcgggaggggaagaaatagcacttcgacgttggaagcgtggcttcctgctgtacggtccatccggcagaaagtgcagcatgatctcggctgtatcccactccctcggctacgacgtctgtagcatgtttagttctaaaacaaaacattttcacgctgtcatatcgaatatttagacatatgtacagagtattaaatatataaaataaaaaaataattacacagattacgtgtaaattgcgagacgaatcttttaagcataattgcgccatgatttgacaatgtggtgctacggtaaacatttactaataacggattaattaggcttaataaattcgtatcacagtttcctggcggaatctgtaatttattttgttattatactacgtttaatactttaaatgtgtatccgtatatccgatgtgataactaaacccaaaaaattttcccaactaagggggtgttaagatccaagggtgtgtaaagttttgtcgtgccacatcgggtattatataaagtgttgcatagggtgttcgggcacttataaaaaaaaactaattgctgtaggatcacattgtcaaatcatggagcaattaatccgtcattagcaaataaatttattaagcctaattaatccgtcattagcaaatgtttactgtaggaccacattcgcaaattattcgcaaattagtcgcaacctatgcagatagttattttttagcttatatttaatacttcatacaggtgttcaaacaagaaccgggaataaagaggtttttttgtc

SEQ ID NO: 47364 - DNA, 228 bp, Oryza sativa
aatcgatggtgccacctaacaacatttgatttcttcaggtacagatattccaactggcaatatgggtagattatgcatatgagtcatatgtgacaggcaaatataatcaaattatgcgagttaatttagtttccttagaaaagtagagatgaacatatgctggcgatagttaataccactagaatcctcgagatatttcttgcttttatttattaagacagctattca

SEQ ID NO: 47365 - DNA, 1052 bp, Oryza sativa
agtgaaatatggtcttcaactgtaaattgagttataaataatctaaagatttacgctgatcagaaattagttgtatgattaagaagcttaattgtttaacacgatattattgcttatctaactaataaggcatgaacataggagaaggaataggtgggtggataaatgaattgaagtaagaggaggcgtacatacgtatattcgtttttgtaaaaaaaaattaacttatacatacaaagctctttggtaggcccgagtttaggaaaggaattttttcttgaaaattaatctaatgcttgtaaataatgggttcaccaaatttaatgaaaatatgttttgttattttagaattttaagaatttcactaatttattagagcatcagatgacaacttagaagcgtttggcgaattaggagcatttttggaagtttaatgggctttaagacatctaacctaatgttgtaaaacatcaattgagtccaccaatttaaatgaaaattgatggtgatatttatgtaaatttatagagtattatgtttcatctatttctatatgttactacgtgtaagtatatatatgtgttcttccggtgtttctctgatcatgtattacgtacgtacaggagtatgttctttccggtttatctgatcgtgctatactcacgtatgtactcgcatgtcttttttttgggtgaaacaatagcataaaaataggatcagaaaaaggagggaaaccggggatcgatggaaggggaggttcacggaaaaatttaagtctaaaatatcaggtccatcaatttaagtgaaaatcgacggttagatttaacagagtcacgtggcggcctaggagcatttgtaggagtcccacgtggcggcatgagagtgtttataggaagtttaatggacttttagtatataatataatataatataatataatataatataatataatataatataatagatggctagattttttttattaacgtgagagctcctagaaagtgtccaattagtatataggtatagaggtatgatagatagataga

SEQ ID NO: 47366 - DNA, 164 bp, Oryza sativa
aatttctgaaattttgaaaacatagtttagttgaatttgaacaaatattaccaaaattcatgaaaagttaaaaaaattcggccaaaataatatcatatctgaggggtccgaaatgatcgaaatttctgaaatttccaaccttgatttgtacattgcgtttgaaa

SEQ ID NO: 47367 - DNA, 1501 bp, Oryza sativa
aagtagatctcaatctttagagggcaatatctctcacattatatagtatttttctaatctgtctgtaccatgatgtttgtaaaaaagtgcttaacaaaactagatatatcatgactaattttcgatgttgttactgcgagaaagttatcctgttactgcacgatgaccgtcatgttactgcggaattcctgcgagacgtgaacatcaaagtggttggcggggagggagtgaatgtgcgtgtttgacgtgggtttgaccggcgggatggggtcacacgcgccaccaatttcctggcgcgcctccgcccgtcctgtccttgttttccgttttttttgccagcgaattttctagcgcttctaaccgccccctgccacgttccccatcccctgcctgcatgtagattgaggtggtgtttagatccagggacttaaatttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctgagtaaaaaatttactcgtgaaataaatccacatatggaatatttcttgttaaaatttcacttgtagtgtagtttcaagttatcgtacactcttaggttagagttaaaaaataacccatagacatcggtgcagtaagtttgaacatagagtgttttgtgatgagtaaaattttaatttaaaggttatttgatgatattttaatcgtggccggccctgattttccggttttttgggtccacctgcagctttccacttctctcccctgtggtgcaccgctcctatagagagttaaaaaattactcatctctgtcatctattctcagttctaattgagttgtcctcctgaacacagagtaaaagaattattgtgccttcttaggaaagaaatcgacgtctctgcctcagtgaaaaaattacgttgtttaaccagtatatatataaatggtagttttatcaaggtatacatggcgagacaggcgatgcgcgccagctaaaccgtggcgccactcagcgagagcccgcatccccagcacagacccgccaccccatccccatcctgcaggtgcaaacagagtaaaaaaattaccgtggggcaaatcagttacagtggttggtttatgagagaaacacgtgattatcgaccaccctgcccccccccgcaacagacaactgagtaaaaaaattactcattatgagatttgacttggagcgggcgtaattgaagttaaaaaattactcataggggttgattgccgtggta

SEQ ID NO: 47368 - DNA, 1501 bp, Oryza sativa
cctcgacttaatatccgtcctaaacaatgccgacttgcggaagctcttccttgatacgaccgacaaatccatcatcgttatcgaggacatcgatgcgattgaggtcgagctcacaaccaaccgcaagggcaagaaggcagccaacggcgacgacaaacatgtggtgatagggctgtccgacaagaatcacgacaaaagtaaagtgacactgtcagggctgctcaacttcatcgacgggctgtggtcggcgtgcggcagtgaacgaatcttcgtgtttacaacgaaccacgttgaccacctcgacccggcgctgacccggcgtggaaggatggatatggacatcgagatgtcctactgccggttcgaggccttcaagatgctcgccaagaactacctaaacatcaccgagcactcactattcagtgaaattgagggactgctgagcgagaccaacaccactccggcagacgtggccgataaactcatgccgaggaacggtgaaatcggtccactgctcgacgagatcgacgaggaaccagtcgatcgtgatagcatcatgctgcgctacaaccggaagagacatgctgatgaacgcttggaaagtttagtggaaacactgatcatgaagagggccaagatgaattccgcaacatctcctatggaagaggccaaagaggaacaacctaacgcagaagaaagctagacaagggccccggtcggatatatatgtcatggtgactgggcttttgtgtgtggtggaaaatggtcagctaggctcctttttgtgtgttgctattttacctgattttcgtgtttgtttagtcacttacgcttgcataagtcataccctaaaatgacacaatatacaaatgtttagcacagaaaaataacaacgatatgtgtggggtgccagtataactaagtacataaaataaacaaaaaacatagggaacatgtgcttcattaatctcaaggttcataaatacaaattcccaaggtaatatgtatgtatgtatgtatgtatgtgcactctatagcttgtcgttggatagatctgaacttgaagaagtggtcctctggtttctgaggtctcgaaagtctcccagttaattacctccgcaggcctaggtcaacagaacacctccgattaagctgcttgtggttgtctcttcatattcgcttcacgttttgcatgcatgatgaatattggtgaagatggtggatatgtacgtgggcgctgacaatgcatctacggccagggtttgcagtttcgaaagtgtgtattttgccaggggaggcgaaataactgcaatcgacaaaatttcagaaatttcaaaaattttcatccgaaattttttgaattaaatttgaaaattttgtccgaaaaatccgaaatatagccgaaaattccgaaaattcggggacaaatcattttgcaatcaacagaaggataattgaacattcgatcaatcaataattgccaaatactcattaattgtcc

SEQ ID NO: 47369 - DNA, 1501 bp, Oryza sativa
  unsure (1)..(1501): unsure at all n locations
tatcagttggaaggaagtgaacctcntatttttncattaaatcctccaagcaatctctaagcaattactacttttaattaccagacgtcatgtctggtaattaaaagtagtaattgcttagagattgcttggagagatatctagtaattaaaagtagtaattgcttagatatcgcttggaggatttaatgaaaaatgaagttcacttccttccaactgatatacaacaggcaaccctaacagggtagcatttctttccatctctttcacggttaattccagcatttgaattccgatcacatggcattacatcagacaagtccagccgagtaatgccaaggaacaacagtgttagttgttgccaaggaatgagccatcatacaacaatcttcaatgtacttaacaccctagttaaatgcagtttttactacttaaactatttcttagatgtacttaacaccctaaattattatttttctcaatttacccctcagatactaatatgactctcactccaaatgatatttctatttgagtgagtcaaaacggttctaaaaaataataaataatatgtgatgtgagagatattattgtttaaatattagaattataaaagtttacctgtactaagcttgctactatgtatctatgtatatttgtatagacaaagaaaaacacttttagcacttgtgttaacttgtgaccatgcatagtatcttttagcaaagatactatgtatggacaaagatacatatatacaaagatacatagtagcaaacttaatacaagtaaacttttaggattctaatatttaaacaataatatctctcacatcatatattgttttttagaaccgttttcaccataatactttaaaacgacgttacagcgagacaatagtcctgttactatatgatgatcgagacaaaaattcttttataatgttattactgtggaaagtagtcgtgttaccgcacattgattgtcccattactacgccgttctagatagacgagaacttaaaaaaaagtagatctcaatctttagagggcaatatctctcacattatatagtatttttctaatctgtctgtaccatgatgtttgtaaaaaagtgcttaacaaaactagatatatcatgactaattttcgatgttgttactgcgagaaagttatcctgttactgcacgatgaccgtcatgttactgcggaattcctgcgagacgtgaacatcaaagtggttggcggggagggagtgaatgtgcgtgtttgacgtgggtttgaccggcgggatggggtcacacgcgccaccaatttcctggcgcgcctccgcccgtcctgtccttgttttccgttttttttgccagcgaattttctagcgcttctaaccgccccctgccacgttccccatcccctgcctgcatgtagattgaggtggtgtttagatccagggacttaaatttagtccctgtctttagacactaatttagagtattaaatata

SEQ ID NO: 47370 - DNA, 175 bp, Oryza sativa
cctagaatcaaaatctaacaaaaacaagttcaaattcagttcaacttgctttaaactagttagtaaagtagttaatacctaagtaattgaaaaagtttcatactcatttgaattgggtatatactcaatttcaacaatggtgcccgggcaccatggagcaccaaacaaatttaat

SEQ ID NO: 47371 - DNA, 1501 bp, Oryza sativa
tgtataatattcagaataataagtttgaggattcgaaaaatacattttgagattatatggacgacacaatacaagcttaattgatccaataagagtacctaatttcccggaaaaaaaacaataagagtacctaattatcatagtttcacatttaatttttgtgctgttcgttacaagggaacatcatatattatattgttcattcataacgtatcctggttctaataatatcataaccccaaagagaaaaaaaatgatacgagaaggacctgatcagcaatatttttttctgtattttcgtaatgctaagttcctttccataaaaaaaatctctaaaccatgttcggctaatccccgtgagagagggattagagaggattattttcatgcctaaataggtataaaatcatttctctctaaatccttctcaatcatcttttggatggtattaaccgaacaaggcctaaggagttttatggatttttctgaatgtttattaacttagtgtgaaccaacgaataggcctgagcaattgcattacatattgctaagtacaaaaataattaaatttgagattgtacaaatatattgtacactgtaacgtatacaaatacgtactgtataattgcataagcaaagcaacatgcacatttgtagagaccacaagctagatatataggccaacagtagcagatccagaaaatcgattcattggtgtcataacgtgtctatcggtgtcatagtatgctaattatgcttagaatatgatgctataatatatgaataagtagttttgctataggttttaccgaaagtcatcggtgtcgcctgacaccgatgactatactgtagatccgcccctgtaggccaatataatccgaacgaagtaaaatatggagctattcaattcgagtacaagacgaaccctgaatcatcacacgctgagcacgcacctatacatagatttggcttcagagttcagacgattcagtaacacacactagaatgcaaaaatctgcataaacgctcacgaaacgttgctacattagtactatagtactaccggcatcggtagatcttcaagcaacccctctgcggcaagttggacctccctggcacgcacgaccgagcgcacacgggctgattcggaatgaagcctttgtaggtgaggccgttcggcgccgccgcggccatgctgccggccgtgagcacggccgccattgccaccaccaccgccaccgccacgccgaagacaaagcggatggcaacgcggaagcggccaatctgccgctccggcgccattgatggatatcaaaccggtcattctggtgcagactagatgtctagattcttggttatttatgcgatgatgggcagcggttggtgggaagagggtggccaacagtattgctatggtatgtacatgcttatcatttacttcctccgtcctgtaaaagccaatataatattggatgtgacgtattttagtactataaaatgg

SEQ ID NO: 47372 - DNA, 1501 bp, Oryza sativa
ctcatgccaaagaaaatcttttccaccacaaaggtttttaagatttgaagggggtgaatgatggttttctagtctcaagaatagcaataaaatccaaattttgctccttaacacattcagatataaatctaaatttagatgcatcaccaaagccacaactattccaaaatattcctttcatttcttaaacttattagctttcttttttgaccagtcaaaagaggacataccactttatgtttgattttggtcaaaatcttcctcatttgaggtatggcctgagatacataaatttttaactttttatttaatcattctaattttcaacaaaacttttaattttggttaaacacacccttaagttgattgtttctcgtggtcaagtctaatcatctatttttttcccattttttcctgggctggccggagtccggcaaccatgtcccggcgacggtgtagctgcgttgtggttgcacactgttgcatgttcaggacgcccatcgacgcagcgatttgagtggaggaagtaatcaaatttagccagaaaacttatcaaaaaccgatttataaaatttaggcattgtttagtttctaaattttttttcacaaaaatatcacattgaatctttagacatatgtatggagcactaaatatacataaaatgaaaaactaattgcacagtttgcatgaaaatcacgagacgaatcttttgagcctaattagaccatgattagccataagtgctacagtaacccacgtgtgctaacgacggattaattaggcttaataaattcgtcggtttctaggtaagttttgaaattagtttttttatacgtgttccttccaatatctgattaattatccgatatgacacacatgaactttcttttcgcgaaataaatggaggaagtacgtttctagtgtttccagaaaaagtactagtttgacttgtcaacatgaagtaagtatcaacgaaactagtggttgcaatgccgtcgacgcttagaaaaagtactactagacgcagaataaaggagggaacgtccggaaatccacgtcgcactcctggacacttgaatcagtggcaaccatcgtttctattattgtaatccagatcccacacactattaattactcgtacatcatattatctatccattacttccgttgtgtctcatcccttccagagaattcgcatgctgaccgtgtacgtacgtggcgccgcgctgatcgacatgcatcctctcgctgatcatgctcgatcagcattgtttagctttacgcccacctggatcacaatgtgccgtgctgtcctcgtctctgacatgatccggttgcaatattttatccctcgccggagcagcataaatacccagcaaaaccttgcagtaatcggaatccattcagtgccaatcaggtaatcagtgtgagagtcttttcaaagcgaaggagcaaattagcttttgtgttgtagatcgagcaggctaggtatagcgagaa

SEQ ID NO: 47373 - DNA, 1501 bp, Oryza sativa
cttggcagcgacaacaaggtggtgtgtcgaagcggcaatgaaggctgtgggagtcagcggtggcgggttctcaatgttggctccttgaacacatgccgacaacacggtggatggatctggcctaatggccaaatcaccctctaggtgacaaaaggttgttgcaccaagatggcctaatagccaggattacgataggtaggttgtcaatgctggctacaaatggggcataacactagatctggggcctaagtgccactagatttgagatgtctatgctcaaacccattcatgtgcggcaagctgcgttggacgggcttcttctctagctgttaatagtgaaatttggtaagcccggagtagtcatcggcttagagtcagcatcggctttgaagtcctgagattagccgatgagagttgccaagtcgtcagttgtcggattcttgctatattcggttaaggaaattgatctactaaaggaatcttatccagaagagaccaagttcaaagagaatgcggcatggcaagttatgtattaattaggaatagtttgttagtttcctgttatctttagaaaagtgtgtttagtgtcctataaggactttatcttttccttttatctttaagaaagtttctttcttgtccgacaaggacttgtatcaactcatgggtataaatatgtatacccggggtctatgtaatctatcgttacgatcaatacaattcggcgcatcaccaccctttttacttctacttttgtttttacgttccggcggaacttggcatccgacgcggggctgcatcgtcttcgatctctggcgaagggataaatccaatgttccgccggtccaagcaattgtatcgtctacgtcggtgttgttcaaggttgcatcaggacattcaacctcttggattactctggtttggataatatatttgcttggctatttattatatgtctatgttaatctagtcctaacatctcaatttagctctatcggctgtttctcgctttagggtttctgccggtatcagctaattcgccttgctagattagattagcctaggcatctaccaccctgaaaatcagtcaacggcttaattgtctagatattatatttcttttcatacttagtgctgcatcagttaagttcgatctactaagtcatgcttagaactataatctctaacctgcttcttgattgccaataagagtttcatcggggtttcaaccgatgagttatctagacgttgcatcggcttacaaggattgcatacatattggatttagccgatcgcagtaaaatttaattgtttaatataatcttgtggattttatgacatcagacctccagtcgatgtatgctttaaccttcggatcagtgtttattatatattgtttctagtcgattggtttctactcgattatattgttattttattacatcagccgattgcctttatatcatcatctatattggacatatagccgatttcttaaacc

SEQ ID NO: 47374 - DNA, 1501 bp, Oryza sativa; identical to SEQ ID NO: 33928

SEQ ID NO: 47375 - DNA, 564 bp, Oryza sativa
atgctttttttagccatttggcaaggcaagcattaaagttacaaactaatactcatttttttccatgtatatgctactactcccgctgtcaatgaacacgaccatattgtgcttgtcaatcaataacaaaattcatctttaattggatttactactggtggtattgcacgttctcttatttatggatcatgtgaccatgtttgcaaaacaaattaacatagagcataacttcattgcgaacaacccacaaggcacatgttttatgtgctttgcaccccctaaaacaagatgagtggcttgtttgagcattttacaatatgggtgactaaattgcacccacctcacaagttgcggtactagcgttgcattttactcattaaacatgctttgctcatcgtgtggtaagtatttttttttaacaacagtatactaatcctcaagggatagcacatattattatactagtgtaatattgttttcaatctatcgtacacttcagcatgtatgtcaataagttcattatcatcccaagttacaataagtatttttatgttatttggtagg

SEQ ID NO: 47376 - DNA, 716 bp, Oryza sativa
aacttgcctactctgctcccttcaccaaattctattcagactttcagactaatcagggtgtattgtccgtgtctgttagttactcatccgtacgtaactttaccacaaaagaacaacagtaggataaaatggatagcaactgactgatcagtatgttcttcatctaaccatatgttaattcaccctgattgtcctaatcaacttagtgtgatcacactattgtttttaaggattggtttagtgtaagatatccatatgttgccatcaattgcaagctggtcaacttctaacgtgtgaatctataatgcagcagcaattttgcaaattagcaatcaagaggttgcaaggaatcagttggcttcttgcttaattagttgatatcttgataagtacgtgttgaacatttgaccaatcataataaggcagcgcaaaatccaagcatatatgcgcactagtatcgtgttgacatgtcaaatacaattttttttttgtaaaaattgattttgaaatttgctgacgttgatcttgctttttgaacgagaatttgcggcaagtgatgctatcagcgtagactttggtaaagattacgcaatccaattgaacgcagataccgggtgagtcaagaaatcggcggaaattatagctgttctgcatatttttcaggcataaatctggcccatttggccattaagtttcttcacttttgccttttcagg

SEQ ID NO: 47377 - DNA, 1501 bp, Oryza sativa
taaaaagtaccctgctagtctagtacactgtcatcagatgaggatagtggaaggcactccctgtgctcccactagccacgtccgatgtcacgatcgatatagctctgataccacttcttggcgtaggttctcaatcaaacaccttgatggcctactgtagctaatccggcatggcacgactcacatagctaaaaaaaacagagctaagaacatgagtacgctaaagagatttgtgaggcaattttctggtttatgatagtgcttatatttctcgatgcaaaatcattgataacataggcatataaattggatccaacatagccttttctatacaaaatggtggctaggctattgaatctttcttgtgacattgctgatctcatatagtttttcaataatctcaactctgaaaagattctttcaaacaaatatttctaggcaaagatgacagtggatatggattaaggaacaaataacctggaatcaagaattgaccttcagatgtagcaagttcagccggatatctagaataagaaccaacacatcacagactgttggaatttcctaacgatattactagaaatataattcccagcaatggcgcagaaatactcctgatatattatggttacagagttcatccgcaagcgcacggatataccattgtagcatttcacccgagagtattcgaagggtatcatatttgtttaatcctgtggaaagatcatagtagagagaaccggactaataatttatatattacttgtcataatcatagtctaagcaggggttaagataaatcaaagggtagattgacacacaagcagcgagctactcattctcatactaaaacatctaagctaagtggaaagaaaatataaagagaatatattcctatacttctaatatacatagtatacatacattctacttatctaattaactagctaataccctctttctgatgccctcctagtacttcgagaagccacccctgcctgccaagtttcttacgacagcccgtcataaccatacaaccggggctaaatacggaggagtaccctccccaaaaaattaacttaggactatatacatgcaggaaggaatacctgtactaagctgtcaccatcagtggcccacctctcatccacagcatataaccccaaataatgatatcccgtaatctagacaccacacataaactaccagatactaatctaatatcatcgtcatgacatagagtaattgcataagtaaacattatactcgtaccgatgtatctcccaaataagctagcggtataatcagtataacatgatcatactgtaaagttggcattcatacactcggaaagtatttcaataccataaatgtataaagaatagtattctaataaaagtacaaagcttacaaaagaggaaaggagagctactagagccatacccgaactcttccgaaggcttccggactccgatttctactctattcctactccattagc

SEQ ID NO: 47378 - DNA, 679 bp, Oryza sativa
  unsure (1)..(679): unsure at all n locations
cggtgaatacgtacactcaatcaattaattgtatcttacactcagatcgtagtacggttaagaacggtgaagcgtcaaagcagactcaccgtagcatactaaataaaaccaacccacggaattcgttgtcgcatctaacattactcaaatcaaactacgaaacacgatcctaccactacctcatgactccgtcgctcgaaaatcaatcattcataatagtaccaaagagctacttcctgaatcttacgtctatgtacatattacatctttnaaagacaatgtaagtgagagttaatagggtgatgtaaaaagntcacctgctagtaatatttctctgcaatttgttgattgttttgaaatacattctgccataaaaatgtaaaatttgataaaaaaaaattaattttgacacaactaccgctgacataaaaaaagttatgtcgttcttttgcattttaccaatgacacaatagctaccttggaacataggcatcagatgcattaggaactttaggtgatctatgataactaaataccgcaaacataactagacaagtgtctctgaactaacatctgtagtacataatcatctctaactaatagtccatcagcactgtgtgcatcagcattaccattagcgttgtgtgcacctcagtttggatggactatcagctagaga

SEQ ID NO: 47379 - DNA, 223 bp, Oryza sativa
  unsure (1)..(223): unsure at all n locations
ttagatatatagaaatnnctatatataaaaaaaatatttgaattcaaattcaaatttgaatcggggggggggaaaatttttaaaaaaattttaaaaatttttaaaaaaaaaaaaccccctttttttttttggaaccctnttaataaaactttttggtctccaaactttagaagtataaacttgaggtgtataaactttaagtatataaatttactaaaatagg

SEQ ID NO: 47380 - DNA, 1501 bp, Oryza sativa
atcaacaacaaactaaaccctagatcaaaccccaactacttaaccaagatcatgttgcattgcataaagaaccaaagttaattactaaaattcatctagatgaatgctggagtacaagaaataggtgggcagtactcatgatacaaacgcatcggttaaccttccccatgaagttgaggtccatcgctcatcgccgtgccgatgatagagccccaccacacgtcacctatggtgcagctcgaaccaccgcctgaagcactctgcattgttgatgatttcccgttccaccacgaatcatcgtgtttgggggagaaggcgagggaggagaggaatttggtggcttttggggtatccctgtagcgaaaaggggttaaatgcaattttcgcgtcacgctatgctgcagaggggacgaacacaaatttggtgccaaaatggagagccgcatcaacaaactaacaaggccaaacgacaaatggacctattgtgctacattaaaccaataatatagacctgaatgtgtattttgcaaattcgcggattctaagtgacaccatcgttcaactttaatgattgaccatatattacactcataataataggagcatggatttatctaaatgcaaatttcattaggctcaccttttccataggacaaggtgatttttcgtggaactctgaataggatggatgattgaacatcatgtccaaaagcttttttcttgaccactacctgatgtgcctcgaagaacaatgtattcaatagaagactagtgtatatagtcgtgcgaatgcacgactttaaccttcctctataccgaatgtcttcacatattattcgtaataaaaaaatatactctatctatttttaatagatgatacagttgaatatgatgtttgaccattcgctttactaaaaaaatatgtaaatgttatttattttgttgtgatttgttttatcattacaacaataataatcaatggtaggatgcctgatagccataactattatgtgcaattcgactttatcattttggtaaggtgaaaatggtaggctatgtttagttaattaccttgtaaatttgctaatgtttattttattttattttattttagttaaactaaatttataataatttagtttagaatatgtgttcactgcaaaaaaaaaaactgagatggtttaacttgtatgctaaacaaaactggagattgagtgtactttatacaatggtaaagaaaattagtaaagaatacaatttcaatagtaagacttgaaacttccaaggtgtttcatgtatatgtggtttttattatagataaagtatataaaaagttactagtatggaaaactcaatctctaaacctatacatctaaagagaaatatttatagggttaaaaatgaaaaggtgccattggtgtgacagactgataggttcctaagcatgtggccttgggatcatgggatatctagcaacttccttgccattaccccctaaacc

SEQ ID NO: 47381 - DNA, 160 bp, Oryza sativa
  unsure (1)..(160): unsure at all n locations
ggaggcaatcaagaatgggcgacgacagttcaagagaacgccttctggcacccctcctgcgcgaaaggagttcgcggaagcttcctcctgaagttcaatgcccgttctatatacccgcgacacagcttccaccgtttcacacggccgcngctgcctcagt

SEQ ID NO: 47382 - DNA, 207 bp, Oryza sativa
gccgccagccacctgctttcccgtgcgctgccgccgcgtagggaatagaggattgagaggtggtggtggggaaaaggataaggctagggtttcattgagtgaacactgtatatacaaatgggctaaatggctattgggcctcgaggggaggttaaactactgaaggtataaaagatatacatgggctaaaaatttttgggtcggata

SEQ ID NO: 47383 - DNA, 1501 bp, Oryza sativa
cgtagtacctacagaatttcgtgatagaatctacgtgattttaaaaaatattattttagtaaatcatattatcggcagaagttgggagtttgttccatctcgtctttttaaagcttttttctgttcatttctgaactttttttgctgtgtgcctacggaaagagaccggagatgtaacctatttctattatctataaaaagtactacaaataggctgcggctgtgtttggattccaacttttttcttcgaactttcaacttttccgtcacatcaaatatttggacacatgcatggagcattagatgtggaagaaaaaaaaaaccaattgcacagtttgcatgtaaatcgcgagacgaatgttttgagcctaattacgccatgatttgataatgtggtgctacagtaaacatttgctaatgacgaattaattaggcttaatagattcgtctcgtagtttacagccgtaatatgtaatttgtttgttattagtttacgtttaatatttcaaatgtgtgtccgtatactttaaaaaaaattgaaatgtaactaaacacggcctaagaggctgtttagttccccaaacactttttccaaaaacatcacactgaatctttggacacatatatggagcattaagtatagataaaaagaaaaactaattgcatagtttgcatgtaaatcgcgaaacgaatcttttgagcctaattagtctataattagccataagtgttacagtaacccatatgtgctaatgacggattaattaggctcaaaagattcacctcgtgatttccaggtgagttatgaaaattttcattcgtatccgaaaaccccttccgacatccgattaaacgtccgatatggcaccaaaaaatttttatttcaccaactaaacaggccctaactcatgttctatcgaaattaaaaaaaaaacgcatgttgcccgtccctatcgcgacaccatcgtggtggctggtgtctgtccaatgggaagacatgtatatttatgcaacttttattaaaaaaaaattgttcctctgtttttaatatatgatgctaactttttatatgacatgtgatcgttcatcctattaaaatatttatataaatgttatttatttgttttgatatgttttaccgttaaataaactttaaccatggcttatattctagtatattgaaaaagaaaataacatttacatataatgattcggcaacttccatggatgtaacttttacataagcacgcgagatgatcgatcactcgctacgctcaaggctaggctagagcccaatgacgaggacacgcacaagaacgcgatcttttcactagctcagctctcgcccagtgaatgggagatgtttctccaaattatcgggatggatataagaaattgtgatcgagctcctatcttcaattcttcatgcgtatagccataaagttctacgaggaagaaattaatgtgcttatgtaaaagcatcttgttactttcgttaagt

SEQ ID NO: 47384 - DNA, 1403 bp, Oryza sativa
aagtctaaacaatcaagtaattaaacgcttttcaggatggtggatgccttagctaatctaatatagtaagacaatttagccgatatcggcgagaaccctaaagtgagaactagctgatagggctaaagcgagatactaagactagattaactaagacatatgatagcagatgggtcatgataaaacatctaaagcgacataatagctccgatagcacaagccatcgagacttacctcttgttgagagaagtcgccgaaaagaagaacaaatgggtggcgatgcaccaaagttgtattggatttgttgtcttctattacaatgatctggggtctatatttataccccgaatacaagcttagggtgtgtttagttccactctcaaattgaaagtttgactaaaattgaaagtttgaagaaaaaagtcggaagtttatgtgtgtaggaaagttttgatgtgatgaaaaagttggaagtttgaagaaaaagttgggaactaaacaagggcttagtccattatagacatgactcaaactttcctaaagataaaatacaaacaagaccgcatgacggtctcttaccatatctctaacaaaaactgacataaataccctaattaatatatacaattgccttaattgagctctatctataattggcgatggcggttattccaaactaggccaaaaccgagcccaagtcatatcgtatcagtcattcgccatatcggctaagccaagtctgtactctatttccagccgatacaataccagccgatgcgtagtccgattctaaatctaattcgatcttgcaccaaatctgcttcgattttgttccttcctctctgagtttgatgcaaaattccgttgttaacagtcattcatacaaaatatatatatgggcccacatgtcatcctccctcctttctatctttgcctcgcgccatcgcacccacgagctcggcggaaccgcctctcccctctctcttccaccaccgcgactgcctcggatggctaggcggagctctcagccatggaggtagccgttctcctctcccccaccacctctccctctgcccctcctctctacgacgcccgcccattgcctctaggccaaccctctctcctcacctttctctggccgccgcctctacccgtctcctagatgaagtgcacaggaggaccaccatgagcttctccgaaccgtcgagctagctccacaccaccccgctgagccatgcgaggtgaagagggctcgtggttgcgatgtcaacgcaacataggatgaaaacccgatcaacaccgtcatgtaggttccacgtcagccaaaaccaccgagggacatagtttgcaccggttttgatagttggaggagtcgatatacccggtttcacgtttagagggca

SEQ ID NO: 47385 - DNA, 1501 bp, Oryza sativa
tcaacctactaccctgtttttttatgattgagattcagatttaattacctctatttacttagcccgcttttcaaactacttaaaaggtatgttccatacgaaaacttttatatacaagttgctttaaaatatcaaatatatatccatttgccaagtttataataattaaacttaattattatgtgctaatgactttctcgttttacatacaccaacttagtatttcctcttcatcaaattcaaatgccaccatatatctatcaggtatccttgtaactgcaaagattggctgtgtttgaaaagagaggaatagagaagatacacaaaacaaggtaagctagattactgtgtaattaattaagtactaattattttaaacttgcgaagtgagctaactcatctggttagctttctgtgtttgaaaagagaggaataaagaagatataaaaaacaaggtaagctattagtgcataattaattattttaaacttgcgaagtgaactaactcaactggttaggtttcttgtggtgaaaccagtccatccaggttcaaatccaaccgtagatttgactcgggtgctcgcatttatagctaattattttttcagtggtagatgacgtacccgtcaacagtgagacatccgtgggcctagtccttcgaagatgtccgtacaggtgagtgggtgtgtattgtggacgcatgcgtttgtatcgtgtttctcaaaaaaaaataaacttaaaaagtgtattaatttttcttttaaagcaatttttctataaaatgtttcataaaaaaatgcgccgtttaacatttcgggaaatatgtgcgtgaaaatatactcttctttcaactcttaaaggcagccaaatacagaggcctagtttagttcccatttttcccaaaaaaaacatcacatcaaataaaaacaaaaactaattggacagtttgcatggaaatcacgaggcgaatctttttatcctcattagtccatgattagccataagtgctacagtaactcatatatactaatgacggcttaattaggctcaaaagattcgtctcgcggtttccagacgagttatgaaattagttttttcattcgtatccaaaaacctcttccgatatccgatcaacatctgatttaacacctaaatttttttttcgcgaactaaaaccaccatgttcagctctcaaacgcagctgttcagacttgagagtagaagaaaatgccagccacaaagtgtcagcaactagccgggcccacatgccagctcggacccgaccaattcctcttcccctcggccctcgcctccaccttccgcgcggccacacccacgaaccctcacctccacctgcacacgcggcagacgacgccgacgagtggccgccgctcgcctcccctccccgcaccgcgccgggcgccagatcttccagaagcttctagaacccgcccgctccatccaatgggggacaacgcctccgcctccgcctccgtgctgg

SEQ ID NO: 47386 - DNA, 1501 bp, Oryza sativa
gatgtgttggcggcatcggggatgattggggtgaggatggggattttgtgagtgattttcgggtgggcggagtgagagggggtgagcagctgaggggaaacgtgggatgatttgaggtgttggatgcgatgaatttggatcatcggatttgatgaatgaggtttgtaggactgcagttggtaaattatatggtagaaatgaagctaccatgtcatggtcttcatgattcttttttgaacttgtctattctggataagctttccatcgactgattttactttttccttaaccgaatccactaaagaattttaccaaattctagcgttaatagacccttctttggcaccagcctgagcttgtgcatcagattgtgttgcgtgtgcgagaccgtgtgactcgggctagcggtcgcgagcttggccataatcctcttgctgagtttcggcactacccctacaaccacaacggtaggcgccggaggcaggggtagtgggagcagcctaaggagcagaggcctagagcagctggcgaggaaggtgcgtagcatggcgttctccgcgttcgaagatggtagtgagtgtgtgccatcagccggccctcgagattgggaacgaccatcggcacgtcaaacaagatccggtccctcgcgaccgaagagcagtcagccgaccacagcggcagggaacaagattgactatggcagagaacggccgagtttggatagcggaatccgattcgaccgaagcggtggaggtgatcttggcacgaccagcgccaaagggcgtccgctcgctgcgatggcactgccatcagggagatgggtttggccgtgacattttagttttatcgtgatccaaatatataattcaggcataaatactgcatcgtggtgccaaatactaaattaagtaaagagaaaaaatgttttacgtctgttttaattaaaatgacaaatttaaaagtaagacagatggctagttggctactttgtatctgtttgacatattctaaaaagcatgtttttaaattttactatattattagtaagataattattatattatgcattgaagtactctgttgaatctataaaacaaaaaccctcaatctctcttttcaaaaacttttgtgcattactaatccggtgatatactcatacatgcaacaactagacaaatataatggagccgcctaaccaattgtgagacaacatggtaagaatataatactgtagcgctaaatctcatcgatcgattggcgagaagagagcaacttcatcgctttccatgccaggttgtcggccaatttggcttgttcacttgccatccatcgctccatgcatgcatctacattatattcaattcatatacctacaatcctacatatgcatccttatctattcttcgagatagaagcaaacatacattaaatcgtacccatatttttttccgaaggaacgtagctcctgcaattaagataattagttaaatttacaagaaaa

SEQ ID NO: 47387 - DNA, 1501 bp, Oryza sativa
aagaaaaataatttgatattatcgaataccatgtcatttagacaaacttgtagcatatagagatggcagccccattgtttggctgtttggtggaataagccaaacggtatattcgcaaacgaaaagtaatttgtgaaaggctaaaaaataaatttcgataaaaaaaaccctaaaatcagctctaaatttaagagtgaaaatttaaattttggttgataagcataagcattagtaaaaagatgaggccgtctatattgtcactgttcaccggatcttatcattcctttctttcttgtatacgcacgaaagctgcgtatcattccattaagagagaagaaaaggaaaaaaaaatcacggcaaggggagctgaaacgccaccactcatatcaaacacaataacacatacaagctttcaccgagtctagggactaacctatctaacgattcaattggtttccaccattgtcagttaaattacggaaatttagttagcagaatattagtgcctaatggctgacagtactgaccagtgaccaaagatcacctggtaatggtcgatcaccatcaaatttcacctcaagtaggagcacttgtgattttgtgaatacaaataagctgattatttcttagctacaaaagaatgacatgagttttctttctcacatgagattggcttacgaattccacaaaagaaaaaaaaaactttacatactcctgtacgcgacccgaaaacgcataaccgatttggattctaacacttcaacaaatttggcgtgaagctacaaatatcgccaatccggcagtcagggcaatgaaccagtgttaccaagcccagctatcatgcctgtaaatgtggccactgcaaatccaagcaccccaccagcaaaaacctgagaaatgcatcttgaaatcattaatgtgtttcacatatgtgctagaaatcagaatatcatcttatgcaataacatgcacaattgactttctaaattgctaacatatacattcaagcaacagatcaaacctgagctggtgtgtgtccaaggagttctcggagtggtcttgtttcagccagtggatgctccgatgggagttcatacacaatttgattcaagacctaacatgttaaagtagttagaactggaatgcaatttaagcatccatagaattaaagaaattatggagatatccaacagaaaaatcgacaacatccttctcaacatatgataaatactaggaataacatgggctattaattcagactatcacaaacataagcatgtgcatatttcaaatagaaccacacccttccttctctctccagcaaatgactcgtgtccttttgcttttaattaaatggtaatagaaacgtgaaatattcaggtcatacctctgcttgcttccctgcatgtagcctgacaccaaaagcatcatacataacctgcaagtaattgccgaaaagttagcagcttccaccaagtgaaaagaacaatataatccatga

SEQ ID NO: 47388 - DNA, 194 bp, Oryza sativa
atttatttgtttatataagcttgtactagagtattagctagtagattatctttatttacctatcttgctctaaatattgttccattggctatttctatagtatcctctaaaatacgtttgataaaccaaacaaatgatattactgccgatgaggcatatttagggtttgtgcttaatttatatttcaatccatt

SEQ ID NO: 47389 - DNA, 1501 bp, Oryza sativa
tcgcggtgggagggcggctgcgccgagcacggatccacgggtgtgccgctggtggagggagggagcaccggcggcggcggccggcggtggaggaaggggatccgcgccgccgtcaacttgtagagggagggcggctgcgccgagcgcagatctgcggcggcgccggcggagtttcaacccataggaagtccacccctgctgcttccagcccgccggcgagggggagctcgttgtccaggccaagcagagcaggccgatggcgtggccaacgcgggcgcaggcgctcgaatggagggaggaggtggcagcggcaacgccggattcgccgaccgcagctcgagatccaccgcccggacttgccgccgccactcctcgtcgtcgtcgtcaccagggccggcgcggctcgccgtctcgactttcgccgcctctccctgtggtggatccgtggaggagaggagaagaacttgcagccgccactcctcgtcgtcgtggtcgtcaccagggccggcgccggctcgacgtctcgccttttgctacctctccctatggtggatcctggagggagagaggaagagagaagagaggattggagaagatagaacgggcgggtgggtcccacatgtaatagggtcaaatgagttagggcagaaaagacattttgtgcttcagttaacaccgttagacgcccttatcggaatagggtcagacagtgtcttcaattttgaaaaggaggatcaaataagcaaaccctaaaaagtagggtcaaattggtagttagagttcaaaacaggttcaaataagcaattgcccctacttataatgtcaactagttgatacctcgcgctttgctgcgggatatatggatgattgcatgttatacattatagaaatgatagatgtatatgtctaaataatgtaaaaatggtgtggaggtaatgattcgacattgcttgcgtattgagttctaaaaatacaataaaattaattataaatgatatgtcatgtttgatgatatttaaaatactctagataataattaccagtgggtgataatgtggcacgcttgcatgtgatttaaaatactctagataataattgctagttggtgatgatgtggcacacttgcatgttgagttttaggaattagtgggcatcaactacatagaaagtatagttatagatgcgggcacacccaaggcaatttgaaagggggttatggtagctgttatgaagaggggaatgtatcattgcaggagaagattctagtgcactgattttttttttactaatgtcttattgtagactcatagttacagagcatatgataaaatcgtcattctataataatgctcggtgctaacttatctctatcaaactattattgaatgatttcagtactccttatgtattcattattcccatgcttgatagtagattgaatttcatagtgaagcattagtaaaagttgcacaagttttttttaaaggaaaaacaaaatgat

SEQ ID NO: 47390 - DNA, 153 bp, Oryza sativa
ctagcaataggtgaccttttcaaacaaatatctatacagaattaacaagacattattgccacgacagcatccgatggaacctcacagcaaatgggcagtactcggcaaaatcggcctatcgactacaattccttggggctgccaaatctacct

SEQ ID NO: 47391 - DNA, 1238 bp, Oryza sativa
ccgcaccccccatcctgacggtgaagaagaagaccggaccatcctctctgtgtccggcgcctccattgctccctcccgcagaagttcaacgtcgctgcctctgcgtcccgcgcgttagccgcctcagtatcccgcgccatcgctgttccctcctgaactaaggtgcataacgcttgcctcgccgaccacccacgcccactgcccgtccccacaccgccgtgcgcgctacgagagaggaatagctagagagaggaagagcgatagatagaagaagagaggggaagaggggtatgacatgtgggtcccatattttttaataaataaaatactaactggattgccacacgtatgctatgtaggacaaaatcgctctggattgggtcgagaggggtaatttgttcggtattaaaagttcagggtgaacgatgactggttttcgggtttagggggtaatggcaaggaagttgctagatatcccatgatcccaaggccacatgcttaggaacctatcagtctgtcacaccaatggcaccttttcatttttaaccctataaatatttctctttagatgtataggtttagagattgagttttccatactagtaactttttatatactttatctataataaaaaccacatatacatgaaacaccttggaagtttcaagtcttactattgaaattgtattctttactaattttctttaccattgtataaagtacactcaatctccagttttgtttagcatacaagttaaaccatctcagtttttttttttgcagtgaacacatattctaaactaaattattataaatttagtttaactaaaataaaataaaataaaataaacattagcaaatttacaaggtaattaactaaacatagcctaccattttcaccttaccaaaatgataaagtcgaattgcacataatagttatggctatcaggcatcctaccattgattattattgttgtaatgataaaacaaatcacaacaaaataaataacatttacatatttttttagtaaagcgaatggtcaaacatcatattcaactgtatcatctattaaaaatagatagagtatatttttttattacgaataatatgtgaagacattcggtatagaggaaggttaaagtcgtgcattcgcacgactatatacactagtcttctattgaatacattgttcttcgaggcacatcaggtagtggtcaagaaaaaagcttttggaca

SEQ ID NO: 47392 - DNA, 1501 bp, Oryza sativa
gctagaaagtcttataacctgaggaggtagtatgatggaatttcgattctttttcaattgcacagttaacggtagcaatgatgttttatctttcttttttctctctttcatgtcagcaaatattctttattggttaattaatttactggatgatgtgtagcactgaaagaacacaacataacggtaattctaatgatcggtagtacagttttgttggtaactttttgtgacaagtcgacaagcacgatcacaacacctaaacgccttgcggtgatatggagtcgccaaccacctcgatctagccaaacggccaaatcaagatgggtttcgtagaaaaacagttaaaccggctagcggagccgatttagagatcaaaatcagcttctaggccgatttagatcgatatgaggataactacccgtctcgtgggcaaaacggaaggttttcaggacaaacctacagagaggcgtcgcactctcgcagcggcggcggacaatttacagcgcaaatcgacgaagatggactaaaactagggtaaaatagaaaacatggtaaaagaacgatttaagtagattgtattcggggttttacaatgaaccggccttatcccttaaataggggttggtcttgccttctccacatccaactcgggatagaaactaaagaaaacatgaaacatgccttcctgagtaaggaaactcgagacctgacgaaatcggactcggaccttgacggtctaaccgcccacatacctgcggtcagaccggccctactagccggtcagaccgcccacatacctgcggtctgaccggccctttgaaggaaacccgacactttctaaattttgataattttcccctattttgtccataggtgctaaatttgggtgtaaacactgttgatttgtttccgttgttatctcctgaacatcctcgaacaaacggggttaaacaacacttgtctctttccatttaatcatatatagttgcctaataatctgaggctttctaatttctgtttagatctcaagcggttttatctgcatgggtgtctcaccaaagaccaaacaatttcagatctgcatgtttatatgagatctctgtttatattggtgtgcaccagcttaatttggcccagataagaaagctgaaaccgaatccaacagggtctcttttaagttgtaaaaaaaatgaagaaaaacagggactcttttttgagttggactctacttggcccaacttactttgcatagataatttcctttctttcctaggggcctatagtttttgcctgaattggactctacttgggcccaatctatattctcttgtggcatagatcttgtttggcctataaatattccaagacctattgcttatccttccagattctctgccatagaaattagaggtgttaagctagggttttgggattgtcatcaagggaagttgccaccagcacaacatctgaaattattgaaggaactcccaacagaaattat

SEQ ID NO: 47393 - DNA, 1501 bp, Oryza sativa
gatacctctaattttatccacatcacatatatgcttactaatagaatataccatctttattcacaaatactggatattcgtatttgtgcagtgtataactagaatcacttgtattcgtataggagtaccattaacaacacactactagtattctttcgctctggatcgatggttatctttctttatcccttgaagtttgtgtaggttctctcttagataaggggcacctcctttttcttctcccttctaaaatgtacatgatagagcatgcaccatatgtttaaaaatctattgctaccttcatctgaaaaaatataagatgcaacctctgtctaatttgtaaaactaggatatgtgtctaatccggtcagacggtgctatattttaggatggaacgagtagcaaaaaatatatttctgtctattatatacatcaggtgcaatgtaccacacataaagattttttacgtgtaaatggctaacccatatttaacttataagtggatttgtgggttagccacatacacccttaggttttgtatataatggaagctttattgaactcaagagtcttagtacactcgcggcctctgcaccacgaaagtgcacacaaccaacaaccctacacacaactaagggaacacaagattgatcaaaagtcatctatctgaatactagaacaccactcatatgccgggggtaaaaaactccgtggccacctgctccaaccgaagacaagccgcaacagtaaagtccttcaaaataggcttatgaagtataagccaagcacagagctatcgtgtaattaagaagataacctgcagttagtagagattaaggttaaggagaaggactctagtgtacttaaaaaaatagaatgatagataattgacaggacaaacagtagttatagtaatatagacattatttttggataaatttaaaacacttggaataattatagctcaattggtttgcatttttgcttatcagctgcagtcaaaatttgaatttaaaaacttaattttggatttgattctgatattttttttattttctagcatgtacataaaagtgaaattatttcttatcgttaataaatgttacggcttataatcagctataggcgaaacaatgacaatgcctatacttgtgaagagagggatatatagcaatttgtaatttacatcgttgaactgactctagttgctatcgtcatgagaacaggaatcgtcaaactgccccactactaccgatctcggcaatatgaactccatggcggcggaggaacaagacacgaagcctttcttgtccccgaccaccaccaccaccatcccgccgcgagcccaccgtggataccagcttagcgcttgcccccaccaccaccaccaccaccagatgacggcggcggcaccggaccagcgcagtgcaggcgcaggagcggcggcagcagcagccgggcagcagcagacggcggcggctgcctgcgtcctgaaccgaga

SEQ ID NO: 47394 - DNA, 283 bp, Oryza sativa
agtggggtgatctagtgataaaatctaacataaccagaagcatgcttaagatataataagcatcatgaccatacaacgaacgcaatagaattacgactaacagaagtatcaaaaattgaattaacagtatgcgaaggttataccctgtgaatgtctctccgctggattgtgaggcaaactgcctccgttgatattgtcgttcacagcggctccggctcccggcgctatcagggttacgggtaaggtataccctctacccttcgatatacgtcacgtatcgata

SEQ ID NO: 47395 - DNA, 1501 bp, Oryza sativa
ggacaatagtgccgagggatctcgcttgcactggttttgtacgttggggatgtgttgtattcggttttgaggtccagggacgaattacagacttggcaacaatttttgagggacttaaagtaaacttattcatgcaagtaacatgggagagcaaagcccaatttcaggcctaccaattcgttcatagaccgcaaataagcggatacaacatcccaacttacgaaaacgagtgcaaacaaggtctctcaacagtattgtccctggtttttgctagcatggtacctatatggctcctttaactaggtcttcatcccacgtggcatcgacgtgacgcttacgtggtagtttgacctaaaaagaaaaattaaaagagaaaaattgaagactaacaaattaaaacaaaacatgcagaacccatatgtcagtcaaacaagtatataaaaaatagttagacccacctaaagctcatcagtctcagccgcagagaccgccgcatctggtcttgattcctcctttcccttctaccgccgccgtggccaccgtactccccaccttcagtggaggtggagccctcctcctcctcatccttgctggagctccaggcgaagtctgacaatgagctgtcccatcctcctcctccttcctccacgttgtcgtcgtcatggcagtgtacacggcgcacgcgtctggtgctccgcaacgtgcgccagaggtagcacggcatccccaccatcgcgtggcagcagcaagagcacgccgccatggccatcttgtaggcgctcttgagcatgcacttgccatcgagctcctcccaagagcaactctgatgttgccgagaccacctccaccgcgcggagagggaggaggtcaaggacaacacgcaaactcgaggtcaacgaagaggacttcaactccaactcctgctccgccgccgccaccgccgatgccgccaacactgtggcaacctcactcacctccgccggccatgtcatccgtgtctacttctatgacatcctggcctaattaggacaaagcctatgtggcccatgagagctatgtgcgcatgtttaataccatgagagctatgtgcgctagtttagcaagggtggaactaacttataaggcctcttccctcgaaccatatcactccagggttaacccttttacacgaagcgaggacgaaagtgtaagtggagtggtatgtgtaagtggacccgcccgtcggatgggctggctatgcggttctggaggaaggaccattacatcttccgcctcgaagcagcgaccgcctacacgacacgttgccggcctccctgcgcgccacggcgaacggcgtcgccatgctcgtcgacaatgccttgtcaataagttaattagtacttgaatttgtactgaaattatattctccgggaaaaaagactttgaatttgtactgaaattatattatctcgaataatccgtgtaaatggtgtgatcaaattgcaatgcatgacatccgatg

SEQ ID NO: 47396 - DNA, 849 bp, Oryza sativa
ttcattttggtttcacatgagcgttaatacatttttctcttttttttaagggggctcgagtacattttaaagagaatctgttctatgagatatatcatacaaaaatatttttgtagaaagtaaagatgccaaaaataacatgaaacttatagaaacttccatgttgtgtaaggaggtcacatatttttttaaaacttctaattagataaatcaatcctctaagggtattttttgtttaaatggctcggcccaataaaatattatacaaccatcgacgaagtcatcgatatattgtagaaagagacaatgtcgatggcaaatcgttgactgggaaagctcaatagcatggagtaaattatctctaccttttaaaactaacggagttatcatataagagtgcccaagccgagtcaaagaattaaatccaacataaaaacaactgagcgtgattgttttctcattttgattttacactagccgcgttaaacatttttctctttttcataaggctcaagctatttcaatcgtgttaaatgaaaattctttttgaagattagtatatataggtttatataattgtattgtgcctgccaaacatacttcctcagtttgaatgaaaatatatagtgctacttttggatatgatatttgactatttattttactcagaaattaatgcaatttagacagtttgattatttgatattatctacttgatcatagggatagattatatattttaagaaataaacttaaatattttaaaacaagtggtctaatcaatacagaagaaatcttttaagaattttttttgaaaacttagagcaaataatcggtgacgataatcta

SEQ ID NO: 47397 - DNA, 192 bp, Oryza sativa
ttccaccaacaatatagttatcttgttagacagtccttgtagtctattcaattactgtgaataaataaagtattgaaaattaaaaggtgaaaatagtttagaacaccattatcatatcatgcatggttacattactgtatcagacatggttatggttacgaggtggtggtaatgaatctatttgttgattca

SEQ ID NO: 47398 - DNA, 322 bp, Oryza sativa
tgcgttcgttttatatgcagaagttcatgtgcctaatgataatgtgttccctcattctcctattcataatgcttttcatgtaagtttttttgtcatatattgcataattattgccaagtttatttaaattatttgttttttgagttcctgaattgaaaattttataggaaaatgaagatgcttttgtttctaaatctgctgttgaacttaatgattcaagacaatgtgatgatggtaattttgtaccaaatttgttatgttaaattatactgttaattgttttaatcatgcattaatatttttttaatttcttcctgttaga

SEQ ID NO: 47399 - DNA, 361 bp, Oryza sativa
ttcctttctcaatttttgctttgtacatgcacaagaggaaaacaagtaaacatcttgaaataaagcattattacttcagcatgttctgcatgttttgttgcttggtctcaaccaggcttcaaaattcagctatagattgcataaattcactttttttttccatgcatgctattttgttccagtatcactcttctcttcttttttttttggtcaattcctcagttttacatctagctcactatgagtttccctctgttctcttttattcattcaccacgtacaggtagcagcagaggggagcacatccatgacttgtgttcataaattttgtgttattctaccttctttctttgtcatttca

SEQ ID NO: 47400 - DNA, 1501 bp, Oryza sativa
atttcagtgatacctctcccaatagacttgagttgtgatgcatataagattttggcattttcccgcatagcaatatcaatctgcaagaagaacatggtagtgtcaccaaacaatatcaccaaataaaaaggaacgaaaacaaagaagctatgagcacaagtaataaggcttaaacaagcagttcaatttctgaaatatgtcctaagatagacgagatatgtgaatgcactagagcttgtaggcaatccgcatcctcaaccctatcaacagaaaaggtctttaatttcaacaacactccagtctgagactctatgatacccatgctagtaaaaattatgcatgttgaccatgctaggggaaaaaggaatgtcaatttgatatgacatgtacaacctgcctttttttttcagtactctataactagagcatgaaatttgcaatccattataatgaatacaggcaaaccaactagcccaaccattgcatctagtgtaaaaatacaggcaagccaactagcccaaccattgcatctagaactgcacaaaacaatgcaaagaggttgtacagcacactagagatccttcgtagtcacagttgcaataatgttatgttagggaagtggtgcatctaaaattcaaaatcaacacaaataattagaatattgtctaaggttgccatctgctttctccatggggtgaaatcagaaaatgccgacatgctatgcacagtttaaatgggtgatgactatttcataataaaatacctgagaatcagtgaccccaaaaagacgtttccatggaagcaggaatgttgatgcatccccaaagacaagatttgatacatatatgagtttttgaaatgcctgcaaaatatttacaatagttatcatcaggggcagtagaaagttttaaacatccatttatgtatcacagcacaaaaacgtacccgccgctgttccatgtcggcatcccggtcccttgtttccagcctttctctgtatatgcgcctaccaatctatacaagcaaagtcgaaggcataaggagtaatggaggaaatgtgaaaatggcactaaagtaggaagaacgtctcaggcaagtaagatataaaggggcttggatcatgaggcaatacctccatgtgcatatttgcagcatctacatcatcgagcccaagagcatttttaaattttataatggtctgaacctcatcacctttgagatcttcatctcctggaggaagtactgagtaaagaaacctggaaataaaatggaggtaagatggagcaaagacacttcctatatacactgcatgaccaaaacaataagatgcaaccaataaatggtagatttttaaagattgattttagaagaatctagtttagctactgagtaatgtacaagagcttgccaaaagaagcaactacgtctgagcacatacatacaaaactgtggtatgtgaaatgtgattggaacaaaatatatatatatactatatatagga

SEQ ID NO: 47401 - DNA, 1501 bp, Oryza sativa
ttataatatgaaacggagtatcaaacaaggcctctaggggtagctgaatgcatgaatgtataggttttgctttttatttttattattacttttttactggaaacaataggggaggccttctttttcttaatactagcataattatattagatggactgattaaaactaaatcatcactctcaagctctgatcaatgatggtaggataaacggtgtgttgtatggtgtgcatgaaacaaacatagcttctcattccagtacagtgttggtcatcaatgatggacacatacaaggtagatagtggccactacttgttagataggtggggatgacaaaactagcatagaaacaatataactacaagacggaagtacaaagaattaatccataatcagagagaaatggattgctaattaccgaacatgtgtttctaacatacacctgtactttcacaagaatttttcaactcaaacagtgcaacttttaactcaaaccatacaaaactttcgactgtgaccttaaaactttattttttttgaattacaaaaacttcaattcaaaatacgaaactttcatctgaaaatattgaactggcaacgtacgtgcgctaaattgcaattctggaatgtatatattatctcgctggatgggtttcggtgctctttccaatgtttcccatactcttgcacaaatgccttcaatgacaacatctttcgcttactcgcattgaagactctgaactgtcattctttgtggggattgcagatccaaaacgaaacatcattcggattcagttgtctctacagtgatgcagaacatcaggatgttcatacagctcacctctgtctctcttgtctccatttatactactctcacataggagtagtagttgatgctcatgcacaagtcttctctcttttctggcttgaaccttttccagcatcacttttaccatatgccttgttttccttaatgtctaatgtctccagtcgttcccattcagatctatcatcatctcattgattaatttctgatgttgcacttgatgtctcagtctcagtttcagtgtcagcagctgctggttcttctttaatgtcagcgaaaagctcacttaacaacagtgttaagggagaccattgcattctcctgatacagctttctttggatctggcaatacagaaataaacttgattcaaagttagtaggagtatactgaaaataagaaataagctgcctctcagcaataatttggtgagtttactgaagatgatggccatgacaccttccctgttcaggttcttcagaccatgtgctgccttcacatcaacatgttgtctattagtgtcatactattcatcaaacacatgcaaattgcttccttgatgacaacctgagaagtcctgacaattgcaaaaacatcactaacacagaacaggccatcaaccttgactaaccaatgcaaaataatgatcatgaaccacacatatgccaggagaagacat

SEQ ID NO: 47402 - DNA, 1501 bp, Oryza sativa
gcttagcagataatgcaatacgagaatgaaagaacatgtaacgagacaatccttattcgtttgacaaaacaacataatgtagatacttcattatgctatataaggattcctgtattaaggacaaagagagtttttcagactttataaaaactgtgtttgattttgttttttttatcagttatttgatgtacacatgcccttcatcccaatataacttggattattatacgattactttgcgtcaacaccattcacaaaatagtatgtgacaactaataagatgtttggtaatagttggatataattgatcactacgatcatcttaatgcaatatgttgacactattacccgattagatacttaaccaaagtagagtggttactatacattaacacatagtgcatgtttggatcatgccctgacaaatcacgcttgagcaaagcatcattcccgagcgtccaatttcgtacgcctatagctagatgcacatgtctaggcaagaaccctaggtcagagcactatccaaatatgacatgtactcctggacatacataaagaccccctctcttggaaaaaaaaagttaattgcacaatggctaggtatatttacaaaagttttatattggatcactctttagcaaatgtttttactttgagttaggtaatcttacctctagtgtaatttagactcgttatctccatcttttcatctctccctcacctctggcttcctatatttgccaccatcattgtcacccatactttagagttgctcgcttagcccatgccatccacactttgagctcgagctttgtgttgccggtggcctcttgagttatgttcatgtgccgtgtcaatgtttattttgagttgaagtcccccggcgctgtggtgctcatgcttgaaatccatatgtgctggcccctgatcgggcgcaatctctattaatattagcggttaacatagacaatggggaggataagagatatgaatgggagaaaaggactttcaaagcaatgttatgttctaaatcgtggagatagcatagttgatgcctttttctagtcattgagcgaacaagcagttcaaaccatggaacaaaattgagagaggggggctcgatgacttggaaaaagggaagtgagtcagagttagcaataatagcacgcaatggatgattcttgatgtagcatgattttgtactcatagtggacgacgacaccgtggcggtcaggagcaacacatatatgtttttgttgggagcatataagataatgaaaaatagaggtgacgaggtagggaggaagaagataagtggctaacatgtgaatcaacagaccaaagtgtaaatgtggtaacaataggtagcaataaaatgaaaatattggaatgcaacttacttaaaaataaaaaagaaaaagaaagaaaaaaaagaagaggaaggcacaggggagggcacaggaggaggagatccgggtccctccatccctcgtcttcttcc

SEQ ID NO: 47403 - DNA, 364 bp, Oryza sativa
aatggttaattcaaccagtacaatgtacggaattggacttggtgattcttcactctctagtatgtcttgttatcattgtccatgtaatctctataatgattgattatagccttttaaagaaaagatgggaataaattctatgattaaaaaatatgtctctccctaattgttttctttatccgaccctgcatccatgtatgctcttgcttttgtcaggatgtatgtcagctatatactccataactcttggtcaagtatgctatagctagagctagcttatggcggccactttggttgaccagaaacagaaaggcaagtggctgatggctgatgacattgttccgcttgaagatatatgcttttt

SEQ ID NO: 47404 - DNA, 245 bp, Oryza sativa
tagggtttgggttcggattttttgattttattttttttgggatttttattttacgtgcaggtgatataagcacccgcacgtggaaatcagatttttccgtgcggtccacttaacctgaccacacggaaagatgtattttttcatgtggttgatcgcccgcatggaaaaatatttattttcccagacacctgatgcagacgggtaagatctctgtagaaaaaacactttttgaacccacggaaaaa

SEQ ID NO: 47405 - DNA, 304 bp, Oryza sativa
agaaaacaagacatatttgcattactcatagtcactataaatcgataggtattatccatgtaggtgcgggtcatatatttaaataaatacaattctatatttaaattttgtctcaaaataaggacaatccaactatactacttattattgtgacattaatcacatttaattcaaatttctgttcgtcttacagtcagctaccatctcactccgtaccatttgtcatttaatagggggtattttggataattttccttctattttattttctcatctcacttctaaacttacatttacaatgaga

SEQ ID NO: 47406 - DNA, 1115 bp, Oryza sativa
acagttgttgtgtccactgcccttgcatttgtacctgcatagtaacctaagttcacattggtgggttcgactgttctccagtaaattcttgagttagaaatttccattttccatttcagagcaggttccatttttttgtgagagaagtaatgcagtgagataggggcctctctctccctctccctctccctctccctccctccctccctccctctctctactttgcccaagaaagcgcacgagcaagaaggaattcaccatccctccaagagttggagtcattgatataccctccaccccttaggcataatggttgtaggaaaaatgtgcactactcaataatttgcagctccattacgcctttagaataaataatattttgcaccactatcacagtatggattttggtttatgctatgtaatgtttactatttatcaaatataattagtgtcagtggctacttcaatttaaagaatgttgtgttatgtatcttctcgctttaagatatcagcgatatcaatctaatgttcttccactatttgttacaatgataaatagatttttgaagcaatcctgttgaatatagaagaccattgtagctcttgaattgttttcttattcggttgcctttctctaatctgttcttgtgccaggaatctctcatgtttcttatacatagcaattcatctatatggaaaaagcatggcaaccctttaactaaagttatttttctttaaaagaaatccttactgtggttagtcttttgacgaggctatgtgaaatgacttttttttttttgcttttggctatttctgtcattaacaaccttttcaattcaatagatgatggaaagcaagaatgttcagaaaatatgattatgcctgttctgacagtttattataccttctaattttaaatgtacttcctaaatttttaaacgtgccttgcacgtgcacgattcctagtcttaaaaaaagaagcagctggtaattggaggggattgtaattgaaattgatcgttagcagcaatctttttaccaggtatcctggaggaaatgccgacgacggaacgagaagccttccggatcatgctattgtctgctacgcttgcgac

SEQ ID NO: 47407 - DNA, 977 bp, Oryza sativa
taaatatattgataaactattcatcttaactattgtggtagtagctatctattgtctcttgatgacatggtataaatttatagccagcaacgggctacactattaaacttgctataaatcttctcaatcaaggggataggccttagtaaattcgtgcaaagtctctgtaaccctaaggccttgttgggtttagaggggattgaaaatgattggaggagattgagggggaataattccacaccacaataggtgtggaataaatcccctctaatccctctctcaaagggattacccgaacaaggcctaacccatttttttcctcccggcactccacaaagtggtcaatgtgttgcttcccgacacctccttgaccccgcctattgcatcgccaccaccctggcctcgccggcgggacggataatttgtgtgggggagacgacaagggaggtggtgggtgttttctcttctctctctctcccaccaataatttatataggtaaggggactgtgtagtgtactcattatcatgaaacccctcctaaattcctaatatcttgcaaactttcaactattgaattactttaggcccctttgaattggaggataaatggaggagaggccttagtagattcgtgcaaagtctccataactctacggccttattcggtttagaggggattgaataggattggaggagattgaggggaaataaatccacaccataataggtgtggaataaataccctccaatccctcctcacagggattaacggaacaaggcctaacccattttcttttttcctcctggccactccacaaagtggtcaatgtgttgcttcccgacgccaccttgaccctatcgcgtcaccaccaccctggcctcgccggcggggcggaatacgccaatggcattggcaaggtccccccagccaacctcctctccctccctactccccctctctctttctcctcacagc

SEQ ID NO: 47408 - DNA, 498 bp, Oryza sativa
actaagctgttggtaacctgtagttattttgacgactcacagaacccccttattattgttctgagagctatccacacaatatcatgatcatgatgcacactagtaatagcttcatgttaaattgaagaggctataatcaccatacctgtactagtctactgatgtgtattaacagatttttggtcggtggcatgatgcatgatgcgcacattctacttttttgtactaggcattatcttcctcattttatcaatttttttctgaacttatctgattctatctttagtgattccactgtcatttcagtcaatcttggaaaaagcttcatatactcactacccactgagactaccatatagtgatagattggcagagaagagcttgtctaagctatgccattaacctttttgagttgtcatgattaagaaaacacttaagtttgcagattgttcaattattatctgttctatctccagtaaataaaactgtaattatcca

SEQ ID NO: 47409 - DNA, 1501 bp, Oryza sativa
ctcgcaatccaattcgagcgacacaaccagccaaggggctactaaaacgaagggaaaagcaaggatggattggatctggaccctgaatcggacaaataaccacgataaaatccgctggaagggaaccatgagattgcaatccaatgaaatcgatcaatcatctggtactttgcctcggcactgggcattgatcccctaccgaatttccgaccacgccgtgcatgctctcgcgcaccatgaggtggctgacctcatcggcgtgcggtggccgccacctgctccacgccgcctccggcccccatgtcctcgtcgtcgagacgcgccacgcacaacatcacgagaagccccctcgccatcagagcgcatgccttagtcgccgccgcctccaccacgccgcacacgtcgtccgtaccggcgtatctggctcccgtctcccccacaagcggggcgggtctcccacctccctctcttacaccgtggcatcagctaactccgcacggaagcttcgccgtcatcgctccaccaagccgccctcacatctctcgcttagaccagtgcgtcatacaacacgagctggccggcttcgcttcggtcgtggatctccactgtcaccgcctcaccggggctcaccgaagacatggacgacatgaatacgtcgctcatggctgtgttgtgatgtcatcgctgttgctctgggtggtcgccatcgtggactcatggttcgctcacttgaggcagaaaagtcacggctaatgggcatttttttttcattttttacaactttttttatttctaaagaatatatttttcttgaagggcttatatcatgaaaaactaaatcctaatcatctaatattttttataattttattttacacgttgcatctatttattaaaaatgtttaaataataaaaaaattctcaacctgtcccctctgctctttttttctttgtccctgtccgctctttttttttacttttttattttttttcctcactgtctaatctttttttattttttttcatgtctacttattaatatttgacctcaaatacaatttgtaaataaaaaataatacacgctctcacaaaaataataagattaatttttacgatttgttaaactacacacattttcttcaggtaacaatacacaggtatattcccacaattgcaaagtgagtatagtttaactggatgggtttcttgtggtggaaccagtcaacatggatttaaatctttgatgaataaagagcagcaccgacttcgaccaacaggagtagagctattacctatcatataagggggcacgaacctgtataaaaattcttgtctccatttcttttaccttaatctcgtatacaccctggtaccgacaatccccataccatgcaaatactatagttgtgacctcaaaggtcgacagtacaattgtagtgtaattacatgttagtctaactataactactacatccgtggctccgtaaaaaaaaaatctaag

SEQ ID NO: 47410 - DNA, 209 bp, Oryza sativa
cccctctttgtagttggcttttttctgataaatttatttcttcaaattcagaaagcttgatggtaactcatttactggtcaaattcctgatttcactggatgccatgatttacaatatatgtgagttttccattattttgatagtgtatcctggaaacattattcttgtaatttagcacttagggagcttgtgtctgcactgcagtccc

SEQ ID NO: 47411 - DNA, 1501 bp, Oryza sativa
ttaggctcaaatttaatacctgtggagttgtgtcggaaggttaataaacattttttttgctgaaggcaaaaattcatgcatttttaggcacaacaatagtgatcatgaaatttgtacccaaatgtaatattaatgtgctttttataagactaatactaatatgtaattgggccaaatgctaataacctttcatttttaggcccaaggttactcataaaatttaaaattttggaccaaagttccagtaaaaaaaaattttggaccaaagtccaatgtctgtgtgttgtcgataaaaggttaatactcatgtgttttcgcccaatattaacatgtgttttgacccaaggttaacactcgtgtgtttttgggccaaagactaatacttatgtgtattttggccgaagggtgatgtttatttttttcccaaagttaatgctgatgaaattttaggccaaaggctaatactcatgtattttcgtctaaagttcaaattcatgcatattttggcccaaggttaatagttgagaatatttgagtaggaccattttggccataagattaattcttacgaaattgttggtcaaaggctaatattcatgtgtttttggcacaaatgaaagcccttaatttttttagccagaggataatatgcatgtgtttttcgtcaaaggctaaatttattgccttttgttcagtaggttagtcatcatgaaattctaggcaaaagggcaatgttcatgtgttcctaggcacaagacctagaaagactgatatccgtgtataataatgccacggttagtactcatgcatttttgaattcaagattaattctcaacaacattttggatcaaaggtgaatgtgcatttctttaaaggttaatacttatgaaattttggccgaaggttatgtttgtgcgggttgaaggctacaattcatgtattatcgtaaaattttggacttagtaataatgttcattttcttttcagccgaatgctaatattagtgaaatggtaggctgaaaggtaaacctcatgtattatgggctaaaattcatgtatttctaggcctaaatttcttgaacacaaaattttgaatatatgatccatgcgtttttttccaagtttaatactcatgaaagtctagggtcaagttaacccattcatttttggcccaaggttaataactataacattttggactcaaatttctgtcaaaattgaatcaacaatgtttattcaattacttagttaaataagtaaagaaagatatcattggctataccgttagaagtattttgaacatgcctcataggtttgtctatttatacaattatttcctaaagaaagacaaatagtccagaggtagtactagaaccaccgaatatgaaacagagcctcatgaatcatgattgaacaattgctaaattgtaacatgcttaacaacagacaaactgaactgatggtagtttaatgtagtagtttagaacttaaagtcgcagtt

SEQ ID NO: 47412 - DNA, 746 bp, Oryza sativa
cagttcttcatttgaaataagcaatttacatattagtatggtccaaacacatgcatgctaccatgtgatagttaatgattctcacatagtatcatgtatatattatctgtaaatcacatggagtagacccatccatgacatgcattttgttggtgggataaagagtgtattatctgtgcatgccccttttcttctgagaatttggtgggaaatccatttatcattgttcctgcattaggacaggcagaatctgtactttcgttatgtggtcatgagagttgcaagctttaacttccatgggtgaccccaagtacagacatagaagatatcacatatatgcatatgtatgattgagatgtgcacatggtagggacacatgagcaatatctttggatgaggcccatattactcttagcagcccttggttataagtaacctttcgttatgtttgggccaagatttaattacctagctgtccagaagcctgacaacataacattaacatatttacataagttccaaatattactggtagaccacaaaatgataaatgtagtgaccatgtttagataaatatagtgactagtaaggtgtggtagcaaatgtgaagcttaacacaatatggggatcttgaaggtggtaaaacaatatcatagaaatactgctactgctgctgctgctgctgttgtcacagtaatttaatgtccctttaaatctacccggtcgctgatgatgatgttttcagg

SEQ ID NO: 47413 - DNA, 1501 bp, Oryza sativa
acatgcgtgcaaatgcattgtaaatttgtaatacggccttacaaacagtaggttagttgcatatatatcgatcatcatcatgcgagtactgcagcatataggttggtagctagctagccttccaagctaagctaagctaagatggagatccaattaattgatccaacaatgatgaaataaataaaatgaggtaatcatacccacgaatatagtacattttcgcctttaattatgggcgcagactgtgccatgcaaaggtagctaaatacaacttgcttgcctcgcatggatctgtatgtttcatcaaaccagaccaaagcaatcaacgaatgcatgtgattttcgttcacatatatatcattgatttaattagtcctagtggtctaccggcccggaccagatagtggaaaaaatagtaattagtatgggagaaaccctattgtcatattctattatgatatattacatgaaccttctcagaggtacatacgagatagatgtttggattacaagaaaagttaacagcagatgtatccggaaatattattccgcgcacgtacgctagcaagtatgaaatgacaaataaattattcacttattatcctctcccacctggttcacttgattccgcaacaaacctctcgcaccaattgaagctatgtgccacgataggcgagacgccgctccccatgcccgcaagcaggtcaaggactgctttgtccttccttccttctcgacatcccgtgcaccctagctatccctcttcttcctccctggtgacccctggttccccttcttccctgtccatggtgagacatcatggatgtcgcctaagcctcgccagcactagatgagctaccgctgccctagatgttgggtcgtcggattctattcttccttctcctagcatccatgtcgtcctctgtttcttccttttcctagggtggggttgggggggggttgttccctttcttgctcctcccagtgagatatcgggtttgagattatgagatgaaactttttagaatgggcataaagtttttaagtttctagttgaaagtttccaaatcatagaggggtgttagcgcgagtttcctctctcatgtaatgagtgtacgccgtgtagttgtgctaactagcggtccctatatttatatctaagatttgattaagagctctatttatctttaggattttatttttacgactctattttatcttagaactctgttttatttttacgatgtttatatttgagtggcatatgtactgggatgggtaagttgcatgttgggccgggccgaatggaatggaatcggatgtgtgtgttatgaaatcggacacgttagccactagtaggccagccaggagtattagtcggagaattggacacgtcagcgtcatccaggctcccagcagcctctcccaatctctcctcctttcttcttcttcctggcttcctgctcagtcgacttggtgggaattccattcccctgcagtt

SEQ ID NO: 47414 - DNA, 1501 bp, Oryza sativa
aatattgcaagttattttgagtttttcttaagttaaatttctttatgtatttaatgatactaatttggtgttgtaaatgttggtaatttattttttttcttcttatcgaacttggttgagtttgatttgggacaaatccaaaataacttataatatgagatagagggattatatcatttctttttttcctaattactttaaattttacaattgaaaatttacatttttttaatataggaggtgtatgtacatgctaaggtaatttgctagatattttagttaaggactaagatcatgaggttgattaattactgttaggacacaataattggagggagatggtgttgacgcagaggaagtgacggcggtatggcttggatttggacatattttggacattttcaaacttcaggggaagaagagtggacttaacaattgcattaacataatatgaataaacccacatggattatactaatgatgatttacagtgaatccaaaattaaataatggacgtctcagagctgtccttgtgattttttgccaatttaatggaaatttgcagaatcaaacaaaaggaaaaaaatattagtttttctactttcttgtattatacagttgtatagaaagaggttgtggcacaccaatcataactgtagaagtgtatggcatcttatatgacagtgacgtgcattatagcgatgcgtgtatatgaaaccagctgttaaggttgaaaaaaagtttactatcttttggactgatcatgtccggttatgattagcattcagcaggttttaattaagtaaatcaggcaaaaaaaggacctaatcccatttactaactattcaatttacgcttcctaggaacggatgaattttgccttttgtttttttagagatcgaactgattcctgcgagaattctgtagaactcctgtatatcaaaggagccctgcaatctgcaaataaagtacatatgtcaatgattttcttgaacagtatatagcatgagaaccttgtaatcctttagtactagcatggtacaaggaaatatttgttcaatgcaatggcaaagttgtaattttattacactttcatatccattttgcgtttttgctatcaaactgaggaccaacaagatcaaagtaccagagagttcttgcctgaaacgtggccagcttggtacagactccattcagtatacggttaaaacctgaaacttggatgcatctccctttgtttatattttttgtcagtagaggacagcaagttactttttatttgtttggattgtacaatactcttaatgtgtgtttagtttacatcaaatttgaaagtttgattgaaattgaaacgacaaaggttagaaatttttgtgtagaaaagttttgatgtgatggaaaagttagaagtttgaagaaaaagttaggaactaaaacaggccttagttcacttgtattttctattttgggtttgaactgccatactcactgcaaggggagt

SEQ ID NO: 47415 - DNA, 1501 bp, Oryza sativa
accctcctaccagctgtcaccaaaaaattagtttcggccactagataaaaaccagtaccttatagatgtcggttgtaaactccaaccgacacctatattatcatgacgtgataaggttaaaagtaaaaggtgccggttctcactaagattggcacccttgcttgttcatccacctgtctgccatgctctgcaagcttcatcagtaatagcaattaattggcctgtgacaggcaataatcatggcatgaacggcatgtaattaagatccatccaagtatccatatccaacaccctacatgcaggaaggaacgttcctagcaaggataatcaagtgtcatcatctctgatcagtctcacagaataataattaatgagatagatcattaggcaggcaggggcatggactaatgtcttcaaaatggttgttggatcactaacaagtaacaaccccgtcttgtttatggaacacattagctagctttagctagtgtagccatctaccccttaatcagtttgctaactggacacatggaacgagccactaaccaccttttaactcgcctaatattgatctctgctttgtttaaatcatatgtcatctcaaaggagagcaggaggcacactgagattattggggtggtggtcctctacgtacatatcaaatctttgatggcctaaaagatggagagatgctgtgcaaactgcaaagtgggattctgaatatctcccccgtgagtcacgacgtgtgcgttttgaaaaatgtcagaaatattgaagctagcagacaactcgatcgccattattcaggagcctcgtcggttgcccttatttgctaataagccaaaacggtttattagagaataaaaattaatttatagacaattttgttatatatttattcatagtgcctaaaaaaactattgttaaaaagaaattacgttaaaaatgtttgaaaatcaataaaaattcaaattttaatttttgcttcagctctacaaattttgtacaaccgattgggctctcaattcttcttcacatgcttcttcgcgtcatgcataaacacataatgcatttgattgattgatgatcacaagctaggcgacgacgtacgccgttcggtagggagagctgcatttgtcttttcttttttcagaagctagtagagtgacgtacagggtattcagcttaatcagtagcatggtacagtatagtaacatgcttgagctaatttcacacacatgcgattaatcagtgtatcgcatgttagcattggcgtattaattgcagcatatatcaagtggatcgacagcaactaatacacacagcatcagtggagagaactagtgagaactaactactctcaggatgatttttgcaacagttcatcgtctccagcggtgactgagttagaaagattttttttttacccgaacaaacttcattataaactatcatttgctataaaaatttcatcatcaatttattcaacaatgggagggac

SEQ ID NO: 47416 - DNA, 540 bp, Oryza sativa
atttggtgtacttttatttttcacccattgcaacacacaggcatttttcctagttaaatcaaatttaccatggaaattttgattttaaaaaggaaatcataaagaaagtcatccaatggtagccagtttgcgactttgcaatactaactaaacagacaccagttcgccataacgaagattgattgcctaaatggatcaaatcaccacatacgaatacagtcccgtgtagcacattgcaaatttgccatgaacctagtctaagatccagcaattatactcgaccagaactcctaatctacgcatacaacagaactctgcctacacaaacaacaggccaacagcatgggccacgtggttcaaggcattggggagtaacttccttatatttcatagttacttctttattaaaattcctggatgtaaaatggatgctcatggttagtaaatggagaaatggggaacgtttgaaattgcaagtaatcagatcctacaaagtggcctagtttatatataagaggtcatccagaatccgtcaaaaca

SEQ ID NO: 47417 - DNA, 415 bp, Oryza sativa
agcccctccagcatctttggtcgcggttgctgttacgaaccgggattaaagatccgatctttactcccggttcgtaactgcaaccgcgactaaagatgctggaggggcttgacaacacctgacagcatgtgaaccgggactaaagatcatgtagtctcgttctacttataaactgggactaaaaaccatctttagtcccggtttttactgcatccgagactattgtggtttttggtcgaccgggcaaagatgttttctccactagtgaactgttttctctttatatcccctctgttggcgccgtggaggtcatagcatctgacggaaagcagcacgtgcatacaagagaggggttgacgcagacaaccatcaccctcgccctcacaacgagttctctagcgtgtgccctcctagc

SEQ ID NO: 47418 - DNA, 1501 bp, Oryza sativa
gctgagccggggtttacgaaaccggcgaaaaccggactttctgggtcaaattgggaaaggtttcccaagtcaagttaacaaaatcaaagtatattttaattttttgacaaaatttagttggatttcaccgataatcaaatggtatttgcgaaaagccgaaaagactactctggtccagttctgtgaagcctgagtggagccacgagtttcaaagagatattgtgctcagctcaacacgctattctggtatctcttccactccgtgggcaatcaattctctgcacggacacattcttttctccatgcatccgcatgccctcctgtttcctcctgttccattgtgattgagatgcacacttactagcgtagtcgtaggagtgtgttggttttctgggcacgctcgtattttcttcttaaatactccctccatctacttttaatagttatatttttaaatctgaaatatttatttttaattgacatatttcaatccaacaacttatcatcttaatggctttcttgtatttaatgcgtaactcttcattcttccacacaagattgactacctgggcatcgagaaatataaatattaatgaatcgcttgtttacgagaaatgaccagtgacatgtttaaatggatgataagcggaatcacttatccttagtctgtgtgccaagatgaaatataactatcaaaagtagatgaatggattacttgccactaggttacatcttgattgactagtgtttttttttccttggtgtttttgttgtcctagagaaaacttatgagctagtcacgctttagttttcgtccccatgttagtactgtactactaagcatggagtactaatctttgtgtactcacccaccttttcaatttagctgtagattataaatgagaaaaaaaaagaagagctgttgcatcacagatttttttagcaaggtgaaaaaaaaatattgttcttatgcttgctactaccttataaatagaagttgaattagttgagtaaaccgaatgcgacagacgtaccggtcgcctctcgatcacggtgtgttgcctttcagtttactgcaaataaatgcacaggtcaccagtgcagtaccgggtcatgtagctctcaagtgcatctcactcaacagctcagctgcattcttaagcatggaaccttgtttcttcaggaccacctcgttgttttagcacaagtgagatgtaaatcactattagattttgttttttccttttgtaagggcaattggaatcttgtgcatgtgctgcccatctttttgccagttcttgtttatctttcaactgaaagtgcaaacaaaccatttgcagaatgtacctttggttgtctgttttcggttgtacaaaaactttattcctcttaatgcaacgatacactatccttgcgtatcccccctccctctcaaaaaaaaaaaactctgaactttctacctgatgatctgtggtggtgtgacatgacattgtttttcagg

SEQ ID NO: 47419 - DNA, 308 bp, Oryza sativa
caatggctttcctgatttcagcaactatgggaggaagctttcgaagaatttcatcataggacaagtgcaaaacgcccattaaatcattgtgccctatgtccatggtatagagggcattttcaaaccctttgctatcaattggggcatcctcacctggatgacattcaccaaaattaagcaactttgtcactccaaaacaatgcaaataagtcggaaacccaattaattgcgcaaaaaaggaacactttgcttagaacaaaatgtcaccaaattaagatcaaaccgacctctttcgatggactccaagc

SEQ ID NO: 47420 - DNA, 1105 bp, Oryza sativa
cctgcatccgttttctgttgcattacgttacgatgggtttgcttgggaaaaaaaacatattttcttcgttttatattataagattttctagcaaatattgtccatattcatatagatgttaatgaatctagacattgggtaaaactagaaagttttatatatgaaacagcagtggcgtagccagctaggtggcactgtggtccatggaccacctaaaaatttgatcaagattaaaactatagtatatgtgctagttaatataataaaaattatatagtggaccacctatttaattgacatattacatatagatggaccatctttactataaattctagctacgtcactgtgaaacagagtgagtatatatcaaagtcgcggagcccagccacacacctactaataccaacaaacaagatttttcgcggcgaccgaccgagaaatctgcatatatgctggagaggcgagacgaccgagaccgatggatggaatgcgtctcgatcgatcccgacccgccggcggatgcggcgtcgccgttgcggttgctcgctcgctcgctcgctgctcgccggtaacaagctcaggtccatgcgatgtcagctttctttccttggccaagataggaaaccaacgttgcaccaaccacacgatcaacgaacgttcgatcgatctgatcgatcaaccacgacggcttgcaacaactaaagcagtatcacctttatgtgcattttccacctgctttctcactagtttctactactaattaatttaatcatcccctcaccgtcattaattattgcgcctctagaatcagctgattatgttaatataagtaagctggatgatgattaaagatgctggcatgacaacggaaagtgattctggtagacttttacgtgtgtgtgtgcatgtgtatagcttagctaggttcatgttgtcaccacctaccatgatttaagttgtgtactatactatgtatgcgtgtgcatttgcatttgcatttcaataagaattttgtgagccctgcagggggtgcaagtatgtgtcgtcatatactatggttcatcacagataccatgttaggctgtgtttagatccaaacttc

SEQ ID NO: 47421 - DNA, 437 bp, Oryza sativa
ctgaaacggagggagtatatcacaggcgatatatgaagacttatctattccagagtatgtgagtgaacttaatttgttcagtcctacttatttgtgcacatagcactaaagttactaatacctatgtgaattatgtaactgttctagtggacactagtatgccatttcctaataaaggaaatggtacaccccatggtgtatcatgtgatttttctttaatgtaaatgtaactttctttttgaacgctgcagatctcataagtgcgattttcataccatgaagaatgcttatgcatgtcagatttattacaatatgtttattccatatatattcttgtgatatagccttatcttgtttgcttatgtacccttgatcttgcaatttgttatttgcttgctatttttctctcaattatgtacacaatattggtgtgcata

SEQ ID NO: 47422 - DNA, 182 bp, Oryza sativa
attcctgcagcccccgacggcttggcccatggcacggggttttggcctgaccaaattaaagtatggcattgcccgatttttgggccgtgcttgggcctcaccctcggcacgatgggccgacccagcatggcccggtcaaatgatcagggagttaaatagacttattctaccatataggacta

SEQ ID NO: 47423 - DNA, 1501 bp, Oryza sativa
ctattagattggctatagatgaattggagctagtagtgggctgtacaattaaacttgctctaaggctgcgttcgttaggagtagttcccaactcctcctccttgttttttgcgcgtacgcttttcaaattgctaaacggtgcgttttttgcaaaaagtttatatacgaaagttactttaaaaaattatattgatctatttttgaaaaaaaatagctgaaacttgattaatcacgtgataaatgctgcttcgttttgcgtaccggagagtgagggttcccaaccctcactcccgaatataacctaattaagggagctcttgcattggtttgaaacgatctacccgttggttatagatcaaattatcatgattatacatcttctattgcatactaaaatccattaaacttactataaacggtactaatttgacatttggcactccaacaaatgcttataggtttgttaaggacgaaatttggtaagcccaaagtcatcatcggcttagagtcactattggcttcagagttatagaatcagccgatgggagttgtcaaatcgccagcaaccgtgttctcgatggagtcggatcaactaaagggaatttatccaaaagagtctgagttcaagaaggatgcggcatggcagtttatctattaattaggaatagtttgttagtttccttttatctttagaaaagtgtgtttagtgttcgataaggattttatgttttccttttatctttaggatagtttatttcttatccgacaaggacttgtatcaactcatgggtgtaaatatgtacacccggggtctatgtaatctatcaatctcgatcaatacaactactctcggcgcatcgccaccctattccctgaggttttttacttatcaatcggcggaatttggcacctgacgcggggctgcatcggctttcgatctccggcgaaggagtaaatcctacgttccgccggccctggtgaatctatcggctacattggtgttgttcaaggctgcatcgcttcaatctcttggatcgctctggtttggttgatatatttgcccatctgatatctcaattctatctctaattgcattgtatttagagacgaatcggtttagttgggactgactcggttaggtctgatctcctgtcttagccgatatatctctacaatcacagttgttctaaatagatttgttatatccattacattggacagatctatcggctcatcgagtattagattatcatatacaatcttgtgctgcatcggttaggttcgacctactagattgttgttgataatataagtcttgctaagccgataggttcatgctaatgttttattggggtgctagccgataagttatctggacgttgcatcggcttataaggattacatacaagttagatttagccgatgacaactaagccgatcgcttttatatcattatctacatatagctgattgctcaaccctatcgacatcggctggaatc

SEQ ID NO: 47424 - DNA, 1501 bp, Oryza sativa
ttggctgaataggccatccgatgggagccatattttaaaaatttagagacttggaggacacaaacaaacaagttttaaaactgaacgtgtactttattttttttcagatctgtttatatttttcttatctatttttctttcagatttgcaatacttttcattggtccttttaatgttatcctgtgatttcttatcgggagtagtactttggaaagctctagattttatttctttgattccattggaaggaccgggaacctgctttcattccgcacgtcaaagactaatgtgtgtgcgtagcaagaaagaggggaattgaagaagtagagcagcgcagcgctgggagttttttctttcggaagaatcttcccatcacgtgtgaaacatgttccagacatttaaaatttttatgaaacataataaaatacacgttgaaacatatcgctattacatatgaaataactaatgttaacggattgacacacgtttttctttcatcaaaatttaattatgcaatatcttgttgtaaagatttaattataatggtgtaattagatcgtagattgaataattagtttaggagaaaaatcattttgaagctctcaaatgtatgcatgcatagatgaggtggagagagaagagagagtggtggcaggtagttttaagattttttgaaacacactgaaaacatacatcgaaacatataactattacgtatgaaacattgagttttaatggtttaaaatatatgtttttcttttgacataatataattatatgatatcttgttgtaaatatttaattacaaaaaatacaacagtgtgatcggattatagatcggataagtagtttaggagaaaaaaatttaaagagagaaaaaaaagaaggagaagaaacagtttggcatgcatatgacagtgacgaggtttgtcctatttgcagcatttctcgttttctctctcattttttttaccatttataattccaagagttatcttaaattctaatagtgataagcgggccaatcaggaaccggcaatatggatatggatcagcgagcgatcagatcgccgttttcccctatcaacaaatatatcatgcaaatgacaaaaaatcgaccgacgtactccactccatctcatcaaacctctccgccttcttctctctcgctcgcacgcacgcacgcaggcagtcgcgcgccccgtttgaactgggccaaggcgacgactaggcttcgatcggcgagcgagccctccgctcgatccccccgcatgcgatgcgatgcgatcgatgcgcgcgcgatactatccacccgatcgaatcgcgcgctctcgatcgatctcgaattttattcctcctttgttgttataaaaggaggcccaggtttgttcttcgtgttcctcctgtttcaattccattcttccattgcgggcgtctagtgatcgatcgaggtaggctaggtttaggtttcatgtccaccagtggtggtggtgggtggcaa

SEQ ID NO: 47425 - DNA, 1501 bp, Oryza sativa
cagatctgtagccaactgcacggactccaagacgtaatatgtgtataacaggtgggaccaagtattaatagtatagtaaacaactattgtatgaattggctattacattggctatagaagatttggggtagtagtgggctgcactgttgaccttgctcttaaggctcctaactattatgtcgacggttttcaggaagcttaagactaaccagcttctaataataaaaagtctaaggtatatccgtatatacgctgttgtacgtgacaatataagctgttggaagaagctcaacggtaccatttcctgttatagattgtgcacaggaacccaaaagaatcacaaacaaatgtattccagaatacagaacgctatcatagtcagtagcaataggcaacaacagataacaacctaatcgtacaaatgcacgatccattttacgctcctgcttaactataaataattataaattttataatatcttagtagaacaaaaattgggtaaaaacatttactcgtttaaaagctaaaactgaaaagtaaattgatgaaaaaaaaacccaaaatcaactccaaaataaactgtcaggttcacacggctggtaagccaacgtagcatacagtaagagtagaacttcactgggcttcaataaaaacaaacattaatcccaccagattaactgtcacatctggagcgcaacataacttattttttcaaataaacctgtttttcaagtttgtaatagttaacacctaactaatcatacgctaatgaaatttcttgttcctacagcagcaaaaggcaaaagctaaacaagctttcaaacagatcctgaataactgcaaaacccgagaagctgcaaagtagaagctaaccagcaccccataatttcagatcaagaaaggatcacatacacattagtcacgtctagagcaattgtatatccaaactacagaaatttcagaaaagcattggtcaaatctagataatttctgtagtttgggggttgaatcatcagaatgaagcatcattcaacaccccccaccccccaccccccaaaaaaaagcataagattgcaccacccaatgaagccaagggttattgtaagaaaaaaaaaaactctgtaacaaccctaaacttcagaacaagaatggtcacaaacacatacaatgctacttatgtgacacaatctgcaaatgatcgcaaccacttctacttgagccataccatcggcactcagtacaatcaagtcgccatacaagaataaaattttctatggtaaccttcactatgcttaatggcagaatatacaatcagattaacaattgcacatctaactgaacggatgagcagaaatgattaaaaaattatggagactacttccattgagaccagcaatcagcacaattgcatcccagtccatgcagaaaaacaattatctaattgcaatcagtgagatctcaaaaacacatcagagcaacgaaactggcgcaaactaatca

SEQ ID NO: 47426 - DNA, 416 bp, Oryza sativa
tctccggagcagaagttggcgaggacaccgccattgcctcctacgcatcaatcgacccaacccaaacggacgcctcggccgatcccccgggggacacaggacacacgcccacaggaagagagaagaggggagatgagaggaggaaccgctaggcaggaaggaagagaggagaggttatatatacggaccctgtcgttctacctctcctacacccatcgcctcccgtattttataagctttttcttggtttgaatgaatggggaagaaatgggatgggagaagggaataataatgcaaaaatagagagaaatgccagctttgactgcactgcaccacaccacctctctcactcacactctctctctctctctctctctctctctctctctcttgctcctcttgctttccctttcaga

SEQ ID NO: 47427 - DNA, 421 bp, Oryza sativa
aaaaaggagagattggaaaagttgagggaagaacactttctgcaacatactatagcagagcagcaagaacatggcatgattagcatcaccacaattccagtaatgcagttatgagcagcaaccacggtggagcatatctgcaaacaatctttttggccttgcttaatcaatattatcatctctggacgttcacatttgtcatacagtgtgtaaaacaaaacctccaaaattctagaaaataaaaaagaaaaacgagcacggagttcctaagacgagtaaaaggctgaatgaatatagagagatgttcataaatcagaacgcgatgtaacaatgttgagaaatcaaaacatcgtttaagagtattgttgaattcgcactcagggctttgaataaatgcggctgctgtggttgggatcacagg

SEQ ID NO: 47428 - DNA, 612 bp, Oryza sativa
aattgcacagttatagggaaaatcgcgagacgaatcttttgagcctaattagtctacgattagccataagttttatagtaatccacatgtactaatgacggattaattaggctcaaaagattcgtctcgcagtttccaggcgagttatgaaattagttttttcattcgtgtccaaaaattcattcagacatccggtcaaatatctgatgtgacacccaacaattttctttcaacggactgccctgagcctccaagatacggccttgaaagctaaccctgggcccgctcagccatgtcttttgtcgtgggcccaacttaacttgtccacgtggaccaaggaccaattttgttcagtgcctattccagtccaaagtcgaaacgaatgccactaggcttacctgtcaataacataggcttacctgtgaataaagcacttcatatagggacacatccactcttagggcgacagctgtattcaacttctcggacaccgtggcagcacgtagacaggcatactcccaaagggccccacagccagaagcatctgaggatccgatgtggctggttggcacgcagcgtattccaactcacttttcctttttcttcaccagg

SEQ ID NO: 47429 - DNA, 1501 bp, Oryza sativa
tggcctcacaatttcatcgcaatgtcacgtcggacagtttatataaaagtttctgcatgaagcacattgttagtagtttgaaaaacatgctaacgggaattaaggagtagccaagttcaattagctctttagaatagacccttcttcgacacagatcaaggcgagcggctagggcgctgcctagcagtgtcctagcaggagctcatgcctcatggagaaggcaacaaataacaaaagatgtaaaacttggtgtctcttttctttctctaagcctcttctttacgggctctagctcctacttcctccgttttacaatgtaagactttctagcattacccacatttatatagataatgctaaaaaatctttaataagtcttacattatgaaacggggggtacttggctttacttcttcattactccataaacttataaaaccgttctatttatcagcttcctcttcctcaaatcttataatttgtacttaaaaacaactgctatttgtactaagaaaagtggatttctaataacattgtatgatctatcatattcataagattagttactataaatgtcaaaactcaattatcactaagtgggtgacgaccataacatatataaagggggtatattcattcttctcctttctcgttattccttttgcctatggtctctcattctcttagataaggggaaatcctcatgccacttaagctatggccgggggctaagggcctgtttggggtagctttagattctgagaagcagctgtttggtagccagtttctgagaatctggaaaagctctgaaactcagcttctccagcttctggcttcttagtttatttttcagaatctgtaactacatattctcagaagctgtggactgttaagggcagcttctagcagaagcagcttttgggaaaaacttttgggaaaagccgcagttgggacaagctctcccaaacagggctaagactaatttaggtccatatttaaaatatgattttttttgtcaatcgagataagtcaatttaaatcactcagggcatctttaaaatacgatgtactactccgttctataaaaaaacccaatcctaactacgaatctagatatatgtgtgtccagatttgttgttaggattgtttttttttaacggagggataatatacaacattatgaattttcttatcaatagttagcatgtgaattgggttagttccttcatacggagtactatatcgcaattgtgagtttgtgaatgaatgcacatgcacggttacaccgtatctgtcctcgtatgcgcatacgtattccgtagacgctcccgtcggggtcgaattcggtattcgtacccaaactcttcgtatttacatttctgccattctctcctctcctttgtcctttcttgcgcagaaggccagagagacaagcagaggagaaaaaaaaaagaaaaagaaaaaaagaaaaaaaaaacatagcgaagaggagcccgcgaga

SEQ ID NO: 47430 - DNA, 388 bp, Oryza sativa
atttgaatgagctttattttagtagcataatgctcgtacattgcaataaaaataaatataaaagcaaaccgaattttgggttcgctagtaggtacacgtacaaaatttacatagttatgcgtcagacccatatatcgcacacacatgataacttacaggttgcatcttattgataaaatcgtttattaaaattgtagctttgtgaaatacctgtcttttagtatactaatagttcgaatcattttattgaaatttatgaaaaacaaaacaagaaaacagagggttccagagacgttggtgcaaatctctgaattcgaccgagcaacacactgctcaggcttgtaccacctgtcacatagcactagcagcaagttgtaatcaccccaga

SEQ ID NO: 47431 - DNA, 1501 bp, Oryza sativa
ctcaccggcaggacggacggccgcggcagcccccgcgcgagctcgccgacggcacgcaggaactgagctatgcccttgccgtcggcgacgacgtggttccacgtcatgccgacgacgaacccgccgcaggcgaactccgtcacctgcatgagcagcagcgggtcggcctcggcctctcccgccgccgggtgcgccacggcgagctccttcaacagcgccgcgaacggcgggtcgaacagcttgacgtcgtcgagagcgcagctcgccgtcgcggagacgaacgccacgccctcgccggtgcaggagacacagagctggtcgccgccgccgtcggccgctccggtgatgacgagtcggccggcgatggggtagtagtagaccagagcttgggacagtgcccccttgatcgtcatggccggctcgacgatgccattgtcgaagacgtggaacgacgtgaagaggtaggaaccaatggctttgtcgaaggaggataggttgatgacgtcagcgacggtcggcgccaccggcttggttgtcggcgggccgacgagctccggcgaggatttgttcacgatgtaactcattactacagtaattagcactaaaatttaatgttgcgagaactgatatatcgccctgtttaaatagacgtgcttttagacacgtgtgcagttaaaatcaaaaacttcgaacacaagtaaactgacgttgttatatgacccatggaataataatgtgcctaagggcttctttggaatagagaagatttgttggagaagtagaggaattcattccaaaggaaacattttcaatagtcaaaatttcaaaatttaacttattcattttcaatagtcaaaatttcttgttccatataatgttttaatacatagaatgttcttatttctctacttagtgacatttgtttcacataaaatgatttatgttgtttagcttataaattattctgacgaaactacagatcggtcacctgatttctaaaaaaatttgaaggtggctaccgagtgaaacattaagttataatgataaaaaaaaatcagttgttgaaacatttaaaaattttgtgaaacatagtgaaaacacatgttgaaacatgtcgtatcacatatgaaacaatgagttttaaccgtttaaaacatatgtttttctttcattggaatataatcatgcaatattttgttataaagatttaattacgatgaatacaataaggtcggataatgaagaaaaaaatattttaaatcttgctagatgcatacaagcatagataaagtgaagggagagcaagacaatagaaaggcaaattttgtaaagggacatcgtgacttcgtagttttagttgtaggagacagagaagtgactttttggggggaaaacactctattaatatggtaatttgccagtggacaccacacccattaaaatgataatttcaagttgaagaggagagaaaaatcgtgtgaaatgttaagaaatacccctg

SEQ ID NO: 47432 - DNA, 1501 bp, Oryza sativa
aaagtacagtaaaattaaaaaaaagagtgattttttacataccccctccgtgttgttatgtacatatgattttatttttataaaaaagtaagaggtttacggatttatcgttaacttactactcaaaatataataatttttataatttaaaatttatcatagaatataacaacttatccaactagtattacattgtctcaacaatttctccacatactcatgtcaacccatcacgaccattcccatttaacttatcttattacatctataatgaaaaaaaaatcatatattttaggatggagggagtcgtaactatcagtccgtaagacttatcatcaataaaaaataatttaagagaaaacatttttatatgtgttcttcccaatttaaaaattaatgctgaaaaataaattacattgaaaaaaaaacgaaaaatcaacttcaaaagttaaattttaaaaattcaaaatttgatagctgcttataagccgttgggtaaaacggtagagtagtgcgaactagaaatggtgaggtgaaatatctactactgtaaaatcggagtggtagtaattgtcattctccctccaccttcgtacttctccagtctccactagagaaaaaaaacatcggtctaaaaaccatcacgtcgaaaagaccaccaaaaaaaccacgtaccaaaatttgagaaaaaaaaacaaaaacagataaatctgaaccataaaaccaccatccgttcgtacttttcttaatcctattgtaaagcatatgggcatagcactaggtagataaaaattggccgaaggtagtgcaagctgcagcagctagctcccacggccggcagtctcaaatacccaacgcatcaacggcccccacctcccaaccagcaaacgtgctccgccttggaatccttcaacttcaaacgcaccgcggagatttctttctcctctcgcggataaatctcggcttttgccgttgcttcctccatccatctccatccatcccctgttgcctcggcgagctacaggcagcgccatctgctgtgcgagactagctatagctctgtgtgatcctgtctgcaccggaatgcgcgatggcgaggcctttcggcggctacctccgccgctgcttctgctgctccttcttgctgccggcgtcgcgcgcggccagcagacgacggcgccgccggtggtgccggatgcgctcaacaacctcaccagagacgtcgccgactacatctcccaccgcttcagcttctgcgtcgccgacccgtacgctcttctttctcttctccccccaccccccgttcatttcggcggcgccgttcttcgccgccgacctcttaaaacttttttcctttagctttcttgatttcaatggaattgttgatgatttttggttggttttggtgtgtgttcgcttcaggacggaggattggaatgaggccttcaattacacctcggatcttggattcgtgcagaactgcctcgcggagacaagaggt

SEQ ID NO: 47433 - DNA, 1501 bp, Oryza sativa
taaattcccttgagccaattaatagtcttacaaaagaaaattcaagtaatatctataagcaaattttaactacttacaaaatttgtatcttttcgttcgtcacctcttttttgtcttttttgtccacgtttttatccttcaacgcgctaattttgttgaattggactcgagttcgccagagagataaaaattaggattcgccggagagataaactcgacttcgagctcgatacatgagcgatttcgatgggattttcttcaatttcttgagagaaaagatagagcaggagatatagatcaaaagccctcaactaagttgagattatctggttgaatcggacgcgggattgaggtggcgtggggtataggcaggttgaatcggacgccggattgaggtgtcgtcgggtacaggcagggctctggtttggctggaacctgaagaagctactgtagcgacaggaaggtaaattagacttatgctgggacttcttttccatattcagcccaaccttgaaagggaggattttcttttccatattctgcccaaactagaaagtgacgattttgattctttttctaattaaataattgttgatttataatctatcatttattttgtgttcatgttccctgaccccagttgtatcccatgtgtgctagccgatatgagatcatttggattaaatctaattctaattataaagatatagcttataattgataaatctacatcattatatctaaacatggaccaaaactttttctagatccactatgatcaacagcgtatatttttctttcaattaatgtgttgatttctaagccacaattgtgaataaatatttctttattaccgtagtaaattaatttataaatatgtaaaaaaaacatatagtgcttctacacggaaagaaaacatatctcactaggttatgaaaaaaatgtcatttagttatttaatatttggtgtacttttatttttcacccattgcaacacacaggcatttttcctagttaaatcaaatttaccatggaaattttgattttaaaaaggaaatcataaagaaagtcatccaatggtagccagtttgcgactttgcaatactaactaaacagacaccagttcgccataacgaagattgattgcctaaatggatcaaatcaccacatacgaatacagtcccgtgtagcacattgcaaatttgccatgaacctagtctaagatccagcaattatactcgaccagaactcctaatctacgcatacaacagaactctgcctacacaaacaacaggccaacagcatgggccacgtggttcaaggcattggggagtaacttccttatatttcatagttacttctttattaaaattcctggatgtaaaatggatgctcatggttagtaaatggagaaatggggaacgtttgaaattgcaagtaatcagatcctacaaagtggcctagtttatatataagaggtcatccagaatccgtcaaaaca

SEQ ID NO: 47434 - DNA, 1501 bp, Oryza sativa
attaatgaatttaaatagaaatatatgtctagattcattaacattaatatgaatatatgaaatgctagaatgacttacattgtgaaacggagggagtaacttcgatctatagaaaatacgatctcaagaaaaaagaaatgatgttcttgatttgtacagtcaaatataaaggtcttaaattattgatttattataaaaaatatcaggatttaattttttttagaaaaaaatatatttcatatgtcgcattaattaaggcgttgccaaacataaaacgtcatgtagactccaaaactaatatcgagcttatgatttattaaattatatattgtttatagaaaacaaatcaccctataactatagaacatcaaatcaatgttttaacacttcaatctagaacatgtgtgcgctttgcactatgggacagggagagtattagtagaagatttgtgagtgtgaccgaaatactctattgtatattactccgtactatatttttatttctttgtaaaatatatagtttaagaaaataataataataataataataaatatggttattgtagatcatttatattgcccgaaacttcaatgaagtaaatataaatgggacaccatttaactgaaaccctatagaaattgtgcaaattataaaccttcagattgcttaaattttataatgaacaaccaaacaataaaacccttgtccttcttctcaatctcctgatgccccctcgcgctccctacgctcactagcacccaatctgcaccgcctccaccatcgcagtccggactcgctggctggccggaagggctcaacggtgccgttgaggccctccaaacgggctcctctcccttcctcttctctttccccaaactggcagcctcctcccccatccctctccctaccctgtcccacccctaccccaattccgagaccctaaaccttaactccattactttcatagaggtccccgaagttagaaaaggtatcgtcggagctgtatgagattttctaggatagttagaacaagaatcacaaagcaatttcaaaggtaagtaatttgcatgattttgatctaaaaatctatacccagttatttagccatccccaaaataaatagtaaatggtgatggttcttttgtttcaaaaatggtgatgcttcttcgccgtgtttagttccaaaataattcttcaaacttccaacttttccatcacatcaaaacttttctacacacaaaaactaccaacttttccatcacatcgttccaatttcaacgaaacttccaattttagtgtgaactaaacacaacccttgttgagttgttgcgtgcggagtgtggcactgtggccacgtgggcccatgaccttagttgttaaagtatatactaggttatattaggacacatttttagttgttaaagttttaaaatgtttcgtaaaatagtcttagaacactatacaccatattgtctcaaaataaataaattcctagctacg

SEQ ID NO: 47435 - DNA, 1501 bp, Oryza sativa
accaaaactgtgctcatgggctactatatatgctccttttctcttcagaattcatttcgtattttgttgagcgtgcagaacttatgaagagaacattcaaatttgtagaacaaactaagagagctttaagtacaccgtacttcattgtgtttgatgattgcaaaatgctgacattgtctcaaccacaaaaatgcacctcttaaaattagtgacaaaatatatttgtggatgaaatcaacaatacatttggaaaacagctgaaagctgttagaaaaataaaattaggggtaagtaggttgaaccagaacaggctctatagtgttactgttagcaaatgttagatcgggcactcgcaattcacaacagtgctaatacgagaaaatatttgctttagaagttttgaatatatttttttcacttcttctggtgcgttgaagcagttaagccagtttttagcgtcatcataacaaatcgagaatagtctagtagccagctgaaatttcttctagctatgcaaaattttgaagacggtggaaatatattacaatggcctccattggtacgccatattttttccaaattcttgccgaaagccggaaatgaattagtttatctgaaattccttcattcgaacggttagtaggaactatcatatcatatccagaatcaagatgaaatgaggaagataatgtatcaaactcatacaaaggagtcacaggagataataatttaagtggtcaggcagagaccatacgggtatcggttggtaccgatgaggtattagttaatatacgtataaggtataaaatccaacaccaataggtatcgaaatcggctacttgcttggtatcatcccgtttggatgagatcccgttgtatagcagttcccgcgttaatcatgtattcatgtgtaaatatatgaaggattttttttttattttcactatagtagtttgagatcagagaaatgtagaaaattgcaatagatcgcgaaaaggaatcaacgcaaatcagaattggttgttcagcttacagctcccatggctcgacaagttactttcatgtgatttaggaggtttacttttttctgaaccctatctctataaccacatccaaagattaatggccttaatatttctgagacttaacacggatggacgttgaatcggctgtattcgagagttgaggttggaaactcaccttccatgcatgtaaattggaacagcatattttcttataattaattaatttaagtacttaaattttttaataagggttagtatgatttttgtaaaacaactttcgtatatatttttttaaaaaaaaaccaccatttagcaaaactcaccgaaaagaacacagcccaatagcccaacagataggtaggttccaccggcctaacggataggtaggttccacctcaagggaccttactagcgaatttgcgatttaagaggtttattacttgaatgtcctttttttttcaaaatagaaccgagta

SEQ ID NO: 47436 - DNA, 1501 bp, Oryza sativa
gtcgcctccatacgagcaaacgcttcacatgggctgggccgaagctgtcctggtggcccaagtggtaaaccctggtccaacttataaagtatggtaaagaaatatgatgttaagtgaaaacatatgtttaaccttggtccaatgtcccaatctgataaatatacatggcccaaagtgaaatttactctaattagattgatactttaaaatattttcatatgatttttattttcatagttgttataacataatataaataaattagtagtcaaagtatttcattgaaaaccatgtaaaaaatttataggttttaggagtatatgtatacgggcattcttttatggatttaggtagtattttgtaactaactaaccatacgtttgacaaatgacatggatagtcaactcgcgcatgatatcgatgtatcatgtttcacaccacctgttttctctttcctaaaatatcgtaaaatttactacggatagtaaaaaaaattacaattactagattttatattttaggataaaatttaaacttattatattttaggtcggtgggaatatgttataaggatgagtgtgggtcatctgctccacagagagaagagcgagcaatgtgaaatcgacggccggcgtccgttgcgcgcgcacgcagcgcgttcacacaagatgaatgtagagccaccacgtacagtgctttcctaggcagaagcccactatcacatctagcttcatgcctgctttccttacataaatccaaagtggagaaaccaaacctctaatgattcatgctgccacaaatgcaaagaaatcaaaggagtgccaagtgccaagtgctcaccgtcagtgctctccccattcaccccaggacatgattgaggtgcgtgctgtgcgccacaatggcactagcagtgttcacaagaattgcagtggaatcctattcggatttcgtgaaattcgaactctctggatcgggtcaacaacaaaaaaccactttgtctttcttaaattaaaaaatattgaaactaaaatttaaatttttgacaaaatttattcagatttgtttttctgtttatcaactgattttgtgaaatccgatgatactgctcgtgagcggattttgattctgggtcgggattgtgagggttcataatttcagtggaatttaatttggatttcgcaatatccggactttccaatcaggtcgaaaacacaaacgactcggtttttaattgaattcaagaaaacaaaattttaaattcccgacagaaattattaggactttatcggtttttgatttatcaacggattccatgaaatttgcgaattttgacccggtatcaggatcgtgaaccctggacactagtatataacaagcaccacacccttgtatacgagtaagcacagcagcaaaactaaactgatcatacacacaaattaagttgtgatcatccgagcaaaagcaaagcaagagaacggtagctagctagttgacacaatga

SEQ ID NO: 47437 - DNA, 266 bp, Oryza sativa
cggaggtagtcgacgggcgcgccggcgccaacctacctccagctcccgcagtcgccatcgccgccgtcgggatcgggctagggtttggggagccgccgcattggcgaacaggacccgccgctccgccgccgctgccgaaaccgcgccacgcttctacgcggaggaagaccgaccgcccccatccctcactcccgcccccgtaaaccccaccgtcccctgctccctcctcgtcgcgcggagaatatgcgttgccgccgccgccgcca

SEQ ID NO: 47438 - DNA, 1501 bp, Oryza sativa
gcatacggacataggcgaataagaataagattagagataggactatctccctattcttactgctttctcttttttttttctccgctctttccttctaccaatgatgatctagcgagatagggattcaagtcctccaatacccacgctagatctgcacctgcatacggagccttggcgggagcagatgagagaggtggtggctgcggaggcagctgcagatgcattttgtggtaagagatcgaattatgaattctgccttgtcatgcattattttcctaagctatatatgtcattaattacgatccttcggagtttttttttcttgaacgatccttgtgggagtcggaagtgtatatacgcacgcacttaattgcatggtcaatttatttacgtcccggattaatttgtcaagcaagcttttgtatattcttattatatttaacagtttactcagacgaaacacaggatacatattttcacaaccaccacgtgcatagtccatataagtggcagagccccgaacatgaaggactctcgcttattccgacacaaagcctaagctcccacggcatccgtacgtcttgatatcgataagtgccacagtccccctcaaggcctcaagggtcaaggcagcgtgtaatctgtgaaaattaaaataagttaattgctctaaatattgaaaaaatgctaaccatcgattaattttgtatgaagaagactagaagagtatatacttgcattagaaaagccactagatgaagataaatcagtgcacataaaacgagaaagtaattaactataattaattgagttttaattatttaaatttaaaatatagatctatttgatattttaaacgaaacacatcatttaacatcatttaacagtttgaaatccgaaatcatactaacgaaaaccgagaaaaaataatctactccctcagtaaaaaaaaccaacctaattggggatttgttacaacttacaacatggcctattatgtcaaattggccatgtattggccatgttgtgtcaaaaccccaactaggttgggtttttttgatggtgggagtacatctttaaggctaagttattttattagtgctcaactcaaatgtccttttttttttcgtgcacgcttttcaaacttttaaattgtatatttttaaaaaaaatattctatacgaaaattgctttaaaaattcatactaatatatttttttaaaaaaatagctaatacaatttaattaatcatgcgacgatgaatcgttctgttatacgtccgtgagggataagttcccaggcaacaccagtctttacctccgcacttgtagccgacggggcggtcggccatgttgcagcgcttggggatggtgatggcgacctccggcttgatcccggcgaccctggccgtgttggacagcatcacggcgcacaggcagctggggctctgcccgatggtgtgcaccgccgagcagcagctgctcgacggcgccgactgcgg

SEQ ID NO: 47439 - DNA, 291 bp, Oryza sativa
ccagcgcttcgcgcaccacatgccgcttggcgtcaaagcgggccatcaactcgtcctcaaccagccgctctcgcgggtgaaggcgccctaagacgatgtcttcttcaagctgggccgccacccactgggctgccgttcggggggtatcaacgccatcagacataggtcagcgtgcagttcatccaaggacaaggttcaaaaaaagcgggagatctcccccgtcacacaaggatagcgtgcgcgataggtagtagacctgatgaccatcagataaattatcaataatctaat

SEQ ID NO: 47440 - DNA, 373 bp, Oryza sativa
ctttctatagaattattttggaaaaaaccaaatgtttagtagcttgagaagcacgcgcagaaaatgaaaggtgtagaaattaaaaaatgataatgttgaatgaaacctaaattaagagattcccagtagtcaggtctaaaaaactgaaatttatacgtacaacccaaagtcttttgctaacgccccacaaatccaagccatatatcaagctactcacaatatttgatcttcggtgtgtgggtggtgatatacttttttttctttttcctggttatgatctttcagattataatcttgtaatttttcttcggctctaccaatagaactttcgttaaaaaaattatcttcttttttcgaagatactcctggtaga

SEQ ID NO: 47441 - DNA, 1030 bp, Oryza sativa
gctcgccggccggcgaggccgcgagggagctcgatgaggaaggaaggatagccgggagagagagaaggaggcaccgagccgccgacgcaccgtcgtccgtggatagagaagaaggtgaggcccactcccactattttttctttcgtccgactgacatgtggcccatgtttttattttagttttaatttttttacattttgcttccagtgccactcaacaccacggaggatgatgattaagggtgtgtttgaggaggagattgagtagattgggaagatacgcaaaacgaggtgagccattagcacatgattaattgagtattaactattttaaacttcaaaaatggattaatatgatttttttaaagcaattttcctatagaattttttttgcaaaaatacaccgtttattagttcgggaagcgtgcgcgcggaaaacaaaacaatctttatcccttactcctgcgctcgaacgcagcctaagtcaaaccagccacgtatacgccacgtcacccaaaaccaccatctaaaccgctaagggcaagtggtctctacgttaattagagactatcacgttacaatagttaagacaatacggctctaaccattaatataaaaaaatactttcttactagtcatctttcctttattagactcaatgtagcgaaaaatttcgtaataagtgctcagagtcgactctataccgttgtcatgtgtagcaaccatctttctctttctttcttcctctctcttccacatcaccaaatatgcttgcattacaataaagagagaccgctaataaaaaccaatatacatgccctaagggatcttgtttgcactggttttaatagttgaggtaactgctgtatcttgtttttgggttgaaggacgaaaatcaaattcgtcgaaagttaagggacttcaagtgaacttattccttcatgataacgaggagtacactccacagtccccttaccttacctatataaattattggtgagagagagaagagaaaacacccaccgactccc

SEQ ID NO: 47442 - DNA, 193 bp, Oryza sativa
cctgcagcccgggcatgttatcactaatcttattgcataggatcctttagtgcttgtttagtttttggatcacgtcatgtgttagacatgctggtgctaccaatgtgatatgttcatgttagtggcttgcatggatcggcaaattagctagttagttagctatggtttgtgctctgctagtacttgcatgtgt

SEQ ID NO: 47443 - DNA, 183 bp, Oryza sativa
agtaagcagggagtacgttgtatattctgtgatggaaatgagaatgctttgcacagattttgggagcgcccatattctaaatcggtttggagcaaggtagaggaagagttgcagcttgaatttccagtcccgggggtggactgtaataataataaactcttggcattttggctacttgatagg

SEQ ID NO: 47444 - DNA, 247 bp, Oryza sativa
cgcctcctaaccagatcaaccgccgcgcgcctcctctcccacctccgctcctccggggccctgagccctacccaccaccaccaccaccacctcgataatggcgccgccttggcctccctcctgggactcggccgcggtggcctccctgcggcggccggaccatggtcccctcgagacccgccgacgcggtggttctcttccccggctacggtggcggaggcgccgatgaccgcggacgggctcacgg

SEQ ID NO: 47445 - DNA, 390 bp, Oryza sativa
attcctgcagccctggccagcacagcacaggcacagaggcggatataccgcagattccatggaacacggaggcgctcgcgcacgttccagaagagcgccacgagtagagcctctccccgcaacgtgtccggcccgccggggtacgtgtcatgtcctcttctccccaggacgccaccagtaggatcgggttctcgtcgccgcttgctgatgatctgttccacggtgaccacgactcgctcagtttatgtatacgcacgcggctcgcttgctgtagtgtaagcagtggcattgcaaatctgtcaccgaagctgtcaatagctagagagagatagagagagagagagagagcagggtgcggcgccggagcggaggaagatgagcgggagcagc

SEQ ID NO: 47446 - DNA, 1501 bp, Oryza sativa
aaacacggcgaagaagcatcaccatttttgaaacaaaagaaccatcaccatttactatttattttggggatggctaaataactgggtatagatttttagatcaaaatcatgcaaattacttacctttgaaattgctttgtgattcttgttctaactatcctagaaaatctcatacagctccgacgataccttttctaacttcggggacctctatgaaagtaatggagttaaggtttagggtctcggaattggggtaggggtgggacagggtagggagagggatgggggaggaggctgccagtttggggaaagagaagaggaagggagaggagcccgtttggagggcctcaacggcaccgttgagcccttccggccagccagcgagtccggactgcgatggtggaggcggtgcagattgggtgctagtgagcgtagggagcgcgagggggcatcaggagattgagaagaaggacaagggttttattgtttggttgttcattataaaatttaagcaatctgaaggtttataatttgcacaatttctatagggtttcagttaaatggtgtcccatttatatttacttcattgaagtttcgggcaatataaatgatctacaataaccatatttattattattattattattattttcttaaactatatattttacaaagaaataaaaatatagtacggagtaatatacaatagagtatttcggtcacactcacaaatcttctactaatactctccctgtcccatagtgcaaagcgcacacatgttctagattgaagtgttaaaacattgatttgatgttctatagttatagggtgatttgttttctataaacaatatataatttaataaatcataagctcgatattagttttggagtctacatgacgttttatgtttggcaacgccttaattaatgcgacatatgaaatatatttttttctaaaaaaaattaaatcctgatattttttataataaatcaataatttaagacctttatatttgactgtacaaatcaagaacatcatttcttttttcttgagatcgtattttctatagatcgaagttactccctccgtttcacaatgtaagtcattctagcatttcatatattcatattaatgttaatgaatctagacatatatttctatttaaattcattaatatcaatataaatatgagaaatgttagaataacttatattgtgaaacggagaaagtagcattattgattaattgatttatttctttctgctttacccggtcgccagaacagaacgggacgcgagagtacaccgaaagaaaccaactcgtgtccatccatccgtctcggtcgctcctctagcccaggcttcgcttccgtctcgcccaaatcggcgcaccaccaccgccccgccgtccacgaatcgaactgaccggagagatctcgcgatcccctccccaccccttcctgcgccggtggcgaccatgtccacggcggcgcggcgcg

SEQ ID NO: 47447 - DNA, 858 bp, Oryza sativa
caggtgacaaactaccaaagttgagacgaaatacatatagaaaatgaaggataatttcacccattgagtcttgggctcacaaactcatcgaataccaaaaattgtgcccaatcaatacaccactgggccaaggagtattttgccaaggcctaggagaaaggccacagccaggggagctagccagggatcggccgaccccggcctagccacaaccgcctatcccgtctcgccttgccctataccactgcctcctctactctacctatcctcactctccttttgcgacctcacactagcacatcttagcggccgacgtcatcgatgtaggagcaccacgagctgctccttgccgatggcccgacgcatctaggtggcctacaccatcttgcggcaccaacactcattggccttcttcgttgtcactgtccatagggaaccttctcactgcaacccaagccacccaattctgagtcttctcaataggccagctgaccatgcgaggccctagtaagacgtcgggtatcaggggcatggtagggggctattttgccatgttcgtcgcttagaggccggggccaggtggagaaatcgaggatcgaaggcagggttgttcctatctaacccacccccacctgcccagttgccaaccctaatttaaacgaaaatgcttatgatcgatcgtcttacgctgagttaatatcggacgacgcgtctcgagtcagcatttatccaccgcacacatcaactttatcctctcacgcaaactcctccatctctccctcctatctctatcccgagcaccttccttttctttctcggcgttgacccaccgccttcggcaccgctgccttcacatgc

SEQ ID NO: 47448 - DNA, 360 bp, Oryza sativa
ccctactccgatgaagtcggcgactcgcgacggggaaattgtcttagggcaaactgacctagctaccgtgattgagagagacggagattgatcttgttttcgtgcagccgcattaaccttaattaatcctaatctcttcctcctcctcggtttcctcgcaaccaattccgccttggtctcctcccctgccgcgcccagcgcgccgatcgccggcccccccctcctcctcctcccacattatcttctccaagccgccggagacaccgccgctgtgtcatgtcgggagagatggcccaaccgcataggttgaagaacagaggaaggcgcattctggaaagacacgactcgtgaagaaggaaa

SEQ ID NO: 47449 - DNA, 663 bp, Oryza sativa
ttgtgaactatgttattatcactttgtcggatgaagaaatgactaaaataaaagttaaagatcttgatgagttatataactttgttgttgatgactttttcagctgaaatcatttattatttcaaaatcttgtttgaagtagtcctaatttgaaattcaaattcaaattgttgaaacagagtcatatagaaaaatgttcaaaacgaaagttgtagatcttgataagttatacaactttgttattgataattttttcatttgaaatcatttactacccaaaaaattgtttaaatttcttatattttaaaatttaaattttagatagttcaatcaatctcggatggagaaataaccaaaagaaaattggtagatctcaatgaattctataactttgtttttgacaattttttcacatgaattgtgatttagtaccataaaattcgattcaaatttctcatatttttgcatgcggccccttaagaggaccgcatgcaaaaatgccaccctatttttttttatctccctccactctcttttccctcccacgatttcaaatttttttttgcaacccatctcctctatctctccccctctattattttactctcccctctctctctttctctcctcccctgtctctctctctttctctcctctccaaga

SEQ ID NO: 47450 - DNA, 345 bp, Oryza sativa
tgtcattccttcgtgaaggtggctgcttgacatccccaggtcatcatttatattcaattgtttcaggaataacaaatagcttcagatgtagtatgattcttcctgcctgataggtggtatgccattgatgtactgcttgttcatatacactcaatttttttccatatacagtcaattgatgcaagcatgccctcaaatcgattgcaccatcctgattcttagagtttgcgtgccctaaaaaattgattgtatattctttagtcatacaggttgattcttccggtcatgggagttggttcccaagtaaattgctcattacatttttacatacaccatctttgcagg

SEQ ID NO: 47451 - DNA, 289 bp, Oryza sativa
ctttttcgcttcttttcttttcttttcttttcttttctttaaaagtgcttgatttaaatattgatttgaaaggtacaaaaattttactaaaaaatgcttgatcaaagtggtcatattttcttttcttttcattgaaaggtaccaaagcacgttttgaagtgttaggacataagcgggcatgtgcgcagcgcagtggccttcgagcaatgcctacatattgtccaggtgccagagtgccggcatgtcacgccctgaaaaaaaggaaaaaatgtctcttgaaaaatggagt

SEQ ID NO: 47452 - DNA, 1501 bp, Oryza sativa
gcgctcacgccggcgccgtcgttggtgacgcatccgccgcactccccgtcgacgcccgagaagacgcaagcggcgacgccctccgcgacacagccgccttcacccgcggtgaccgaggacgggcgcactaattctccggcgacgcccaaccggataataccggtgacgccgaggccgggcaagcactcgacgagctcagcctcagctccgtcgccgttcccgccgcagtggcagcagccgaagcaggtggagggcctggagatcgtcgaggtggccaccggcgagcggctgtcagcgcacgacgtcgggctcatcgagatggtcggcagctcggccgacgtctccgcggagtcgtcggtgaagtcgtcgctggattatgccaacgatccgccacagcagcttacggtgtcgtcgaaacggaagccggcggtagtgaaggccaccgagccgacaagggtgtggcttaacggcaacgcggtgaagggcaaggccggcgagcggttcaccgggcctccggtggcgggagaggctgatgaattgtgggcgcacgacattgcctgcagccgcgtccacgctgtcatgctggctgagacggtaagttatggatgttacaccatccatcaggctgtttactggaaagaggctactttttaaaaaaactttccccaaattatggtttctactatcttcattctgtaatataagtcattttaatcttttatagtaaaacttctttagatttaacaaagttttttaaaaatctagtaataataatctctaccacgtgaaattactttattaaatataaaattaaatatgttttaatactcgtttgttttgggttaaaaatattattatacaatttttatgaacttgatcaaaattaaaatgatttaactaagaagaaaagtcaaaacaaacggagggagtaattaattacgctttacagtctgagcttttaaattagtccatagagtcactagctcctttatgcttcttgtgcctaaaagcttccccaaattatggtacagtgtaaatattatacaatccacattagaaaataactctacccccgaaaactatctcgatcaagttgactcttcacaagaacttcatctgattcatattgaagaccggattgtacaatggtgttatatttcttctccttagggtccatatcggacttcactgttgcacttgccgttacagtgtccaaattaattagcactagcactaatatacatacacgagttaaaaatagatttgggtaccctaattattccgggtcttatttggttgggccttaattccggcccatccacattgcacggactcggactaaaaggaccgtccaaacaaagttctgagaggacacacacactcaccgtagccgaagaccatagtccgtcaccaactactccctcctccccgccgcgccgccgcgccacagtcgtgggcgaagcggacaccctcggcgacgatacttatggccgccgccacc

SEQ ID NO: 47453 - DNA, 849 bp, Oryza sativa
tgtagcccccgactatgtgattagttgaaaaactaaacatatagtcaagaaccgagtggttttatagcgaagcccgcatggtacttagtaagatacccagccgactgtttctcaacttgaacttatcaaggacaaaaaatacaagaagggccgagtgataaacactcaaaggtccagaaatagacatgttcgatagaaatctgagtaaaaatctcataaaatgatccaccaaacatgatagaaaatcatggtaattaatgactctaatagcctaggctgtgacccttaccataaccaaaataagcatataacatgctaaaagaatggctattaataaatcagtcatctcaaatcaacccaaacagcttttgcagcctaaaaaagcttacaaaaatggtataacacctttctatcgggcaccttttcatatgcatcataataattccaaagaattattgaatcgcgttaaaaaggattttaatagcatcgggccacatcattatgagcacatattgccaaagcaaaaagcgcctaagtccctagggatcacaatgggccacgctgaaaacataattgggctgaagtactgtataggcccaggcccattagtacttccgataccctaaaaacaccgaagtccaaacgtcgtttcgtcttccccgccgagactctcgccattccccactccgtgctacagtatagaaccacgccgacgaagctagggttcatcaatctgctccaacccaccctcaaaaacttcgcgaaatttctccccgcgtccaccgctccgattccccattcctctccagccatatctcagaccaaattaaaccatccagttcacattca

SEQ ID NO: 47454 - DNA, 1501 bp, Oryza sativa
ggaagatctcgtcagatgcaggacacacgcctgaaaaattattgtacgaactgctaaacatcaactgaaacatccaaaaccccaacaggagagaaattttggaatacttcgattatcttccaagcaatattttgtatgaagaggagtggagccccaacgacaaaatggtcgcacgtcaccgtcggcgctgagacaaaaagtacgcatgcgaactcactactactaccattttgccaaccaaaccaattaacccattcttaaacactgtccatttctaacccgctatagctatcactcttttccctttcattaattttgtaattatctccttctcctgccacttccctgtctctttttccccaacctgtagctgtagctgttaccccgcctgttacggccggaaacccagtgtgcacacgctgcaaccgtgccaattttgtcacgaaccttccaaaaaaacgtaaatttgggcgtcgtttctgcgtacagtgacattttacagaaggtgttctttccgtgcgagttcagtgcgttcagagaagagacggcacgagtgattcacaaattttgacgatttgtccatttggaaaaactaattttacaaataaatcgtgaccaaaacttatttcagaaatgataatttttttcagcgccaaatcatatggcactgaacttatacatctcagcgccacatcaactggcgctgaatgccgtgccaccacagatgggaggctgagtcggcgtgccaatgtgcattcagcgcgatgctatttggcgctgagacgtctaagttcagcgccatacgatttggcgctaataggggtgaaaacggtcacggaaattaccgatcgaccgggcgttgtttccgtttaaggggtaccgttttcgaccgtaccgtttttggctatttttaaattttattttttctaatttctttcagcatcgtattaatgtcgatattaagtagtttaaatgataaatatggtcaattaccggttgatcgagcatcgtttccgaagagatgctactgattctgaccgtttctgatcatttttatccctaggcgtcgaaaaaaaaagtcatttttaaaataagttttgaccacagttcatctataaaattagtttttgtaaagggttaaattatcaaaattttgcgagtgattagtgaacggtgcaacgcgtcaaggacgagtcaacgcgccaacgacctcacgggaggagcagttcggttcaaaccgaacccgccatttttcttctcatcgtctccaccgcgcgcgccacaactaaacccctcgacactttttttttttttgtcgccgagtattcgtcgtccccgacgaccacgaaaaaccgctaggaaaacatatttgggtttcttgatccatccgattcccgatcccaccaccacccgccgctttaataccctcctgcccatccacccctcttcccggcccctcgccgcgccattagcggaaggttttgctttgcgtcatccagga

SEQ ID NO: 47455 - DNA, 938 bp, Oryza sativa
tctttaggagagtatatgcaatccatatagctatccggccaatagaaatacagataaacagtaccggtacagtaaattagttgcagtgcaaaatggccctgtactgtagcgcacatatatattgcattactgttgctactgtgcttatctgcgtataggatccgcgtataccatacctccgtcactaaatatttgacgttgttaattttttaaaacatgtttgaccattcgtcttatttaaaaaatttaagtaattattaattattttcctatcatttgattcattgttaaatatatttttatgtatatatatagttttacatatttcataaaagtttttcaataagatgagcagtcaaatatgtttaaaaaagttaacagcgtcaaatatttagagacgaagggagtatttcagtgggacaaatccaactaacacgcgcgtatgaagtactcatgtacgacgatgcatatactagtatttctatactccctcagctgctgctcaggttgtaccgaacaatttaattttgtactacagaataaaaatattatttttttcacgaacgcgcaaaaggattgcacgtcaatatattagacgaaaagagttttcttcatccgataaagtgatttgtaagattgttcacaaaatgaacatatctcttatatagttttataaactatgtaaattttgtgaaaatattactatcactttgtcgtatgaagaaatgaccaaaataaaagttatagatctcgatgagttatacaacttttttgttgatgactttttcagctgaaatcaattactgcttcagaatattatttgaagttttgaaattcaaatttttaattgataaaacaaagtcacatgaaaaaatggccaaaataatagcagtaagaacacaacaatatgatagagcatgattttagaaacatttaga

SEQ ID NO: 47456 - DNA, 1501 bp, Oryza sativa
ttgatactaaaccgcgcagttatcgcgagatataccgtggtttaaacagcaccgatttataaaccctgccttccagtacgttgacaacaaccagataaatttcttctcccacaaagaccggttcctcccttgtggccgtgccgtttcgtccaaagggcccaccggctgacacgaatttgggagaattgtaacgcaacgttctgggattcgaagcaatctccttatcagacaatcatagagatccactgatgacagcaatctcatgggtttggaacacgctaatctcactcaaaattccttaggacccaaattttccgacccgtttgaatgtttctccaagttgtttggcttactccagtgcagtgatcaacgacctaaacttctcccctaagctgcccgattgttttttcctaattagccgccctgatgaaagtatgaaactggagccatacagtaacagatttgtggttttcctggtcagcagcaatacaacagaggacgagaagcaccggtaatgtgatagtgaagtcgtatccacctatcagaattcaaattatagtggtcacaattcacgaatattacatacacgcaagtaggcttttaatatgaatttagtgaaataaaagatgtacaactgatttttgccttttaacatgttttagtagacgagttcgcatgtctgtgaataaatgtggtactccctccgtcccataatataagggattttgagtttttgtttacattgtttgaccactcgtcttatttaaaaaatttatgcaaatataaaaaacaaaaagttgtacttaaagtactttggataataaagtaagtcaaaaaaataaataataattcaaaatttttaaataagatgattggtcaaatagtgcaaaaaaaacttaaaatcctttatattatgggacggatggagtattaccatgtgtgcgtgtatgtacacttcgtaacagttactctctccgtttcacaatgtaagtcattctagcatttcctatatttatattaatgttaatgaatctaaattaatatctatctagatttattaatattaatatgaatataggaaatgctagaatgacttactttctgaaacggatgaagtaaaaaggaaaagcaatatagcatagcggagcactgctagagaagcataactgtagcgtatagccaattagccatctggtggagtccgtgggccatctcgacagagcccgtacggcccacttgacagtggagaagtccaactccaagtctctcgcctgccattacgcgaggacgatcccgaccgtccgtcccctgccaaaccaacggccaccgtggcgtacaggcgctatatatcgcactgaccgtcgcgcagcagcgttcgcctctgtctgtcacacacacacactccagtacccccacgctttcggcacattctcctcgcgcgagaggggggaggagaggggaggggggaggagcgagagcggagcgatgggctcgccggggc

SEQ ID NO: 47457 - DNA, 255 bp, Oryza sativa
cagtaaatatttgctaatgccgaattaattaggcttgataaattcatctcgcagtttacaggcggaatctgtaatttgttttgttattagtctatatttaatactttaaatgtgtgtccgtatcctttaaaaaagatttagctgtggaactaaacacgaccttagacgagtagttcgacaccataaaccatgcttcagtgcattgtgcagatcttttgaattgcagttcgatgatttggcaagccatagagaaga

SEQ ID NO: 47458 - DNA, 438 bp, Oryza sativa
gtgaattatgaagtagagtagatagcatgtacctgtaagtatgggaaatgggcgatagggtcattttagaaaaaattaacagtcaactcacggtcaactaatggaatagggatagaggagatcaaaatgataactcaagggcatgtaggggataaggcaaaattcaagggtatagaagagattgcgaaacttttcagaggtatgtagggaattttctcaaactctaaagatgactatactggtttctaccgtattcatttatactacaccatgtagtagtatggaactatggatagtagaatggtataggtgtatatttgaaagaagatgcctaacagttaaatatttttgcaagcttcattgaccatcctaaccaattgaattttagcaacaaccatctcataatattctcaatgtaaactagaggcggtggagata

SEQ ID NO: 47459 - DNA, 368 bp, Oryza sativa
ttttgcaatcagcacagtgcagacttgtcatccagtacgagaataattgacgaggtgatttggctgcgcttggaactgaggagagtttagctctttgtttcctactcgcgtagtttaaactatgctagactcaatatttgtactcggcagctgccactttcgtggggttatccaatagggccataacataacaaatttaataatatcaccagctgatatctgtaaaaaaggtagtcccacatgtcagcaagagatagctctaaatctctaatagctgatgcgtatgatagctagctgtccaactatgtgtacatccaaaaaaaagagtaaatctttaatctggtaagtttgcttctgtcccacctagt

SEQ ID NO: 47460 - DNA, 1501 bp, Oryza sativa
gtgagttgtatgtgttgagtagagcctacatgaattttcccatgattttatcttgcacgaattattttagataattctcaagacttatgtcttatatgtgtttccctttcctaaatgcatgtaaatgtttataaaagttatatttggactctcattaacctgaggtgatattgatatgttagaattacagtttaccttacacatgtcataagctccttacctatttatgcataagtttacttcagtattaaattaagagaatgcttatagagatgattaagatagaatataccctatatgatataatttatttgttcactttcatgttcatgacatgtcttcagatggatatccaaattagttttgtgaggcttgacattagctatgttgatatattttaaggtgtatggtttctattttaacttcctctagctagcactaggccctaatggtttagttgtttatctagatcttagttaatattcatgagatctattatgaaatgcaaatcaaagattcaaatgcacatgaaggactcaagtcaaaacatgttttatgcaagtatgcatgcttttactcgtgtttgcatttatgtcctaggttataaatgaaaaatttttaatttgttctcaaattttacttaggttcaagttagattgaccacacctaggttaaaaatggaaatttttagctctcaaaatcggaaaagttagcttccaactattttgataggaaatttttaaggtctagaatttgggtatgttacaagtatttgaagtggctacagtggattcacattgatctagtgttgtgccatctctaattatcaacattatgtcatttggataatggatattcattgatccggctgttcatatattgttgggggatttaattggaaagctcttaagttaaggacatgtgggtattgtattttgtggtgttctcccggagaagtttgttttttaatcccaccgtcagatgcgtagaaacaaggcaactttgaggaatgtttgccttcgtttattatttattatatggaaatttaatcagttaagatatcgtgtagagcattataaaaaatgttttttcctagcgcactccttttttcttaatgacggtggacaaacaaaacacaagaaaaatgtaccgaaaatgtaccaaaagcttgattttcagacagacgacaattttaagagagccatttgtaaaaatgaaccttatacagaaccgtcggactgtggagattatgggtaccccatacctacatggcatagttatccgactggctataggggataacttatgtctatggaatatgtaacagatcatgacttgggtattacgtttccctgtatattatggaacggcctaaagtcctggtttgataagattgtaaagtagatttaggaaaccgatgccgtattggttaaggtttctatcttgtaaccctgccccccaacctatataaggagggcagggagcccctctaggggcatga

SEQ ID NO: 47461 - DNA, 280 bp, Oryza sativa
tgtgcttttgtgtgtgtgtttgtcacgtcgttcggttcactggacaagtggacaagcccgcgtctgtgtctgcactgcaccggcattgagaagtgaagtgtcctcctgaccctcttggcctcttgagcgaacggataagcctcatctctggtacacttagtacaccggagtaaagttcagtgtttccggctgctttcagtcagagcaagatgggatttttttgggggggtgttctctttgttctgcacgtgtttggggtttgtgaaagagtgtgatcttg

SEQ ID NO: 47462 - DNA, 249 bp, Oryza sativa
tagctttaattcatctatagccaatctaatagctcattcatacaatagttacataccacactattgatatatggtcccacatatcatacacacactgtgtcttagagtccgtgctacagctgtctataaatctatagcccgttgtccttctctcttctcatttatatgtttaaaatatatttatagctggcttattatagcctgctattgtacctgctcttatggatggatagatatattcccgtcacg

SEQ ID NO: 47463 - DNA, 1501 bp, Oryza sativa
cttattttaagtacatgtgccttatgtagcttcacgtacgcccttgtagaaccagcgcgccaatatattgaaacttctgttacaaccaacctaaacatctttcgtacccattcaaatacgtgataaggtaagggtgtactggtagtttttatttttatgttattcatcttatcttaactagtacagtagtacttaaaaagcacagacgtcctccttcctctcaaaacccccctccccttaaaaaaactgcaaaaagccatagaaacataacccatcgtgaaaaacagacattaaaaaaagcgaatcatatttctatcttgtgattctattgcagcgcatggacataaatttagtaactccaaaatcatttggaggaaataccagtacgtgtccacatggacgggccaaggggactcatggatattcacttgaatactcatatttttcagaaaataggataagctatacatttgtcgtcagattttaattcaaaaatttcacatacgtacatataagtagaattgtgatataatttaattataaattgcttgtaattataatgtaacttaattatatgtaacttttaaaaatccctaggtgacatgctattttcgtgaaaacaaaggtttaatggtagtgcatgggttgtgattatttcctaccattatacgaaagtataatagtaccgaatcccctcacatgaattttaaaagcaaatcgaactgttcaattacatgcaagttacaatataattacattgtgattgtactatatttatatttgttaaatttttataaaaataattgttggtacatactccaccatcaaaaaagaaaacaatcataactatgagcttatgagcttggatacatactagttcagatttatgttaaggttttttttttcgagacggggtagtgtatagcaaaatcgacgtgggaatactattgtacatgtacgggtgcactgacagcacgtgagacgtggcctgcaaatcgtgcatcacacacgggtgggtggcatgggcgcgcgggcattctcccaccaatgaagcgagatctccatactagccgccgcccgccggccccgtctgcaggcgacataaaaaacgttaaaaagcaacaggaatttctcaactcacacgattcacggacccaccaccaccaccagttcacaacttccccaccccgcgcgagctgtcgggctccgcgcgctgagccctagaagccaaaaacttggaaaattccttcccggcccgggcaccaacaaccagaatccttcggcaggccagccaccggttcttattggccttggttggcggcacgctggttcaacgaatattaaaaaaccattggggcatcatcttccatttgtccggcttaccggtgcccagtcaaagcctaaccaagccaccccaaacgaatgcgtgcgtgcggagagagagagaaagagagagagagagagagagagagagagagagagagagagagagagagcatcg

SEQ ID NO: 47464 - DNA, 559 bp, Oryza sativa
catcgtagtttcggcttgtttcctggtgaaataatctggtagtatatgaatcaagttggcaacacttctctaaaaagaaaatcaagctggcaaccattctctcgtgtgttgagatatgattagttattagttgtcacgcgttgaatgccttgtttctgttcaagtatttgcacgttagtcatgttctagagtcagaattttgcaacgaggattggtatggtaggtacaactacttttatatttcccagtaggatatggctaagatcggagctgtctttcggtactatatagatgcctccacgctgttcattgcacaacatcaatggttggttttctgatgagagtggatcgtttcatgtattggaaatatcaaagatttatttcatgccatctcattccaatttcaagaattcagtttgctcataccatgatcatcctactttgtttcagatagcttagcttgattggggtgggtgacaatgggaggtggcaaggacaagcatgacgagagcgacaaggggctcttctctaacatgatgcacggcgttgccggcggcca

SEQ ID NO: 47465 - DNA, 1501 bp, Oryza sativa
tatcttctctgtttaggtctcctaaaaattcgaactagtttccaaagaacccatattcctctaatttctgtgagtattctatccataaattttgagtgcaaccaaagaaaatagaatctaggtatcttcatctaccttcagaaaaatccacaccaaattattctacccacaagttaaataattgaattactaaattgggagagagaaataatcctgaaaatcattcaaaccttttgttcacccacgtttctgcgcaaccctcttaccctagcttagtttgccacgacctggacccacttggcagccactctggctcatcctcaccctgtgcaaatcttccagccgaccagagacagccgagagagagagagagattggcgctggctgtgtacgacgcgtggccacaacgtgtcgacgccatcaaactcctattctagccttctcctcccagctgcatctccacacatcattctccacctctaagccaaagaaaccgagggaagaggctctcaacttctccgtcgccctcatccttgccgccggccgcgaagaagacgactatcgtactcgtcaataagccagggtaatccccatctctttcgcgttccatactctcatcaccatgccgaggatttatcctttgaatttcatcctctatcgtgcagcggatcgacgggaacgccgtcgtgcccacgtgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccagtccacaggcaaaccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaagcagcagttgaaagcagtaaaacggttgtagtaattaatccatattaaccaatcactgtccaacgttacaccacgttgcaacaggcccaaaccacctcttgaactaatcagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcgg

SEQ ID NO: 47466 - DNA, 1069 bp, Oryza sativa
ccgcatggacggccgtccctttcgatcgcctcaaccaagcggaggaggaggggagggatcacgcttatgagacccaacaaaatctgcacagcgttttgcacaccaccaccatcgtgtggctgctcttgatccacccaaaagcaacatgtgaccgatcgatctagcgatggcgatcccctaacaacggagccgtgacaacgacacgattcctgaagccgttgagcgcccccggttctgttcctaccttcgctactgctatctctcacgcattgcccatgcagtattgcagtcatgcagatgctggttagttgcagtgttgcagaggtgagattcgcaggatcggtgaaagaaaaaaaaaagcagtggagaaaaatgcaggtgttaagtagtagtagtagtggtcagtcatctgtgttcagagcctcagagagtgcttgcagtcaaatagattcttgggttggaaaggagattaagatcaggttgaaagtttagtttgcctttttcgtcattcattccttgctggtaattaattagttttggtgtgtgcggctaaagtgatttcttctagatgcatataaatctaaagtagtgcgggtaaagggtagtaattgatagtgcagaatctttaattgctcacaggttttggagagttggtgttgaggacaagttaattttggtgcacgttaggtaatgttctggtggttactttctttaaacagattaaaaattattaactagttaattaagttcctagttaagatagaattaagacaacggcaaaggaacaatggtgacacaacaaaaaactgaaggtgatctttactgacgaattaagcacagttggggtattaattctgaaggcaagactgttctcattttccattagacagaaaagagagacaaaataactctacaggctcagggtcacacttacctcttcctccattgaagccaacgacttagcttcatcacagcctgccatctcctgtactcctctctctgtcttctctgcaagaaacaacaccacaactttcagttcctgactaaaaacataaaagattaaacaaga

SEQ ID NO: 47467 - DNA, 630 bp, Oryza sativa
attcctgcagcccaacgtgataagaacaaatcgttaacagagagggtatgcacctatatataagtccttccccctgtagattgttgatatctaaactgtaattctttgggcctgaaatatattatgttggtgccattttggttcttaaattttgagtgacaaactatttgaacaatgtgatatattagtaaaaacaatagcaatgacaaaatatgatgctttgaagtctaaattcgcaatttgttccatggaatagcaaactaagtgtttatctcagtacttgttgagtgcttcacatttcctcatgcaggtcagaattcacaggaattatcttgacatgtgatctcgtttgcttgaaagtagattcaaatgctgttttgttattttctttcttatcaagctttcacaatttcatgcttccacatttttacaggcgtttggaaactgttgtgttgcaatttggtgttcttaattttgtcggtttaagggtacttagcatcgtttctgcctgtagttttttttagtacttgatggacaatgatattttccatcttttcaccacaagaatacgctgcaatcttcatgtaatgtatattgctgatcccttacacaacctttttgttttccagt

SEQ ID NO: 47468 - DNA, 1501 bp, Oryza sativa
gaattttccaagtttttggcttctagggctcagcgcgcggagcccgacagctcgcgcggggtggggaagttgtgaactggtggtggtggtgggtccgtgaatcgtgtgagttgagaaattcctgttgctttttaacgttttttatgtcgcctgcagacggggccggcgggcggcggctagtatggagatctcgcttcattggtgggagaatgcccgcgcgcccatgccacccacccgtgtgtgatgcacgatttgcaggccacgtctcacgtgctgtcagtgcacccgtacatgtacaatagtattcccacgtcgattttgctatacactaccccgtctcgaaaaaaaaaaccttaacataaatctgaactagtatgtatccaagctcataagctcatagttatgattgttttcttttttgatggtggagtatgtaccaacaattatttttataaaaatttaacaaatataaatatagtacaatcacaatgtaattatattgtaacttgcatgtaattgaacagttcgatttgcttttaaaattcatgtgaggggattcggtactattatactttcgtataatggtaggaaataatcacaacccatgcactaccattaaacctttgttttcacgaaaatagcatgtcacctagggatttttaaaagttacatataattaagttacattataattacaagcaatttataattaaattatatcacaattctacttatatgtacgtatgtgaaatttttgaattaaaatctgacgacaaatgtatagcttatcctattttctgaaaaatatgagtattcaagtgaatatccatgagtccccttggcccgtccatgtggacacgtactggtatttcctccaaatgattttggagttactaaatttatgtccatgcgctgcaatagaatcacaagatagaaatatgattcgctttttttaatgtctgtttttcacgatgggttatgtttctatggctttttgcagtttttttaaggggaggggggttttgagaggaaggaggacgtctgtgctttttaagtactactgtactagttaagataagatgaataacataaaaataaaaactaccagtacacccttaccttatcacgtatttgaatgggtacgaaagatgtttaggttggttgtaacagaagtttcaatatattggcgcgctggttctacaagggcgtacgtgaagctacataaggcacatgtacttaaaataagtcaacaattgaagtttgactagtttgatcaatttattagtcctgcaattttagctataaatgattctaaaaggatttttctttttctgaattcatgtaaaatttaaaattcataagcattttagtgtcacgtcatccaaaattatttttaaattgtcatggttgtgcactgtagaagtttaggatcaaaagttgtctggatataaagttcatattaccttttaaatttgaaaaaaaaaaggctataaataaattt

SEQ ID NO: 47469 - DNA, 1501 bp, Oryza sativa
tccatcctcgccggcacctccgtcaccatggccctcctcgtggcgctccgggtgttcccgttcacgccgcggtacatcatcccggtggccgggatgatggtcgggaacgcgatgacggtgaccggggtgacgatgaagaagctgagggaggacgtggggatgcagcgaggggtggtggagacggcgctggcgctgggcgcgacgccgcggcaggcgacggcgcggcaggtgaggaggtcgctggtgatcgcgctgtcgccggtgatcgacaacgccaagacggtggggctgatcgcgctgccgggcgccatgaccggcctcatcatgggcggcgcgtcgccgctggaggccatccagctgcagatcgtggtgatgaacatgctcatgggcgcttccaccgtcagcagcatcctctccacctacctctgctggccggccttcttcaccggcgccttccagctcaacgacgccgtcttcgccgccgactaatcttccctcttccacaacaccttgcattttgattcattatggattactgcttagtgattagtagtagtagtaattagttgttgagtacttacttagtaggacgagagagaaagtaagagtgtgtatgtcttgaggttaatttcttcttccataataaatcatgtgttgatgacttgattctgtctctaatttgggctgggattagcagatctccatcacatatggtttcagttgtaggacttcttttatggtcttcaaggtatagcaacaggtaccgaagttatcctcaaaaatacaaattagtggagcattttgattaattactactccatccgttctaaaatatagcaatttttaattataaatctggacagatttatagctaaaaattactatattttaggacggagggagtacttagtactaagtagtaaatcaattagtggagtagttagtaggataaaagagaaactagagtgtatgtcttgaggttaattttctccataataaattgtctctgatttgatttgggttgggattagcatatcttggacagactttcagctgatcccaaaaagctgatctgatctccatcacacaggtttcagttgtaggagtttgttatggtcttcgagatggagcagcaacatgtatcaaataagatggaaacgtattatatgtacacgagctttccgtacaattagcaaatatcacaaaaaattcttaagaaaaaattatacgcgtgcttccaataccaacacaaaagataactatagtgaagtcctgcctaatcgacaacttaacactgaagatcaaactattgaaaaataacaacagactaagcagggaatcaaccaactcctgttctcgtcggttttagtcttgccaccatctctttcatcctttgagtcagcaccatcagcgtgctctcctcatcagagcgaagcagcttcttccactgcagcaacatagaaatgatttggaaaggcagagtataacataaaaccaacgc

SEQ ID NO: 47470 - DNA, 1501 bp, Oryza sativa
agccgtctaatcgtttttagtttgggtttacgctaagtaatggaaaatctttctactctattatccttgctcgttcaagatcaccagtcgtgtacagcaggttcgttgaacatatacttgggtaaggattattcaagcagttggacatgatctacaagtatggatgtgcatgtttaaaaatcttactactagtacaagtgccatgattcaggactgtttaaggagtcattttcttttcctcggcttcattaatcattatcattaatttatgcttataccaagattttgacggatgcattttttagctttgtttgacttctggccctttttatcatagtattactatttgcgtgtgcaatttccagttcccatctgaggctggacctctgaaaccggccgcagtcactgtcagtgtcactggctttggtttgttttgttggatgtccaaagctgagaataattgaaaaaatattggttgtgcaggctccaatggtaatgaccaattacaagcttttttttccccttgataagtagtgtgtgatgagagatttcataggacaagtttcttctcatcaatgggtgagcaattgtcaacaaataaagggcagaaaaaggaggagagaaggtggagtatggaatccatggatttgttgtttctctcacaatctgtgtctgaaatcctgcagctcctatctctctttcatctttcttctttctgcctttttatcttcagcataagagacccatcaacctttgcatcgtgcgatccattactgcattacacatcagtcagcaccgagcaaagcaaaggattccagcatctgctgaatttttctctcgtgcaaatactttgtagaataagtttatttttgtttctcttggttaacttaaaataagttataaaagtaattattgtatctgagtttatgaaaaatcaaagataaatgtgtttttaaaatgagaataattacattggaatttgataaaggagggtattatagttttttgggttctatatcaatatgtgtgagacttgtgaaaaatgaatttattttgaggaattgaggttgaagggtagtacaagatcattttcatttttttttctcacatagggacgaggaaattcaggacatgagcagacagcatccttcaactcttcatcaactgacgatattaattttttttaataaaagatggaaaagagaggcgggcactgtagttcttcatcaactgacaagattaaaaaaaacacaaatactgtagtgccactgcagcgtgggccccaccatccagcgtgccttccccacgtagcacccaaacgccacgccgacgccgccaaggaagcagagagaaacaccgcgaaagccgaagaagaaggcgtagtcgcctccctcgctcgccgcctcccccgcttccgctcgctcaccaccaccaactcctcctcgtcttcatcaacgcgctcggtcgcctcgcctcgctctggaacgcatgatggcgagca

SEQ ID NO: 47471 - DNA, 324 bp, Oryza sativa
tatatgcaacatacacaactttcaataagtaataattaagtattattttttatgtcatctctaaatgtatatttatcgcaaataatatggggcataactaactcataaatataatagtcccatttaacaaatttttaccctccgataatacactctattaatttatatgcttcttcaaagcaaagggcaaaatgggcttttctcataagaatttaacggtcaactaatggaaaattcatagcctaaactcccaagtaggcaaaaggtggtgcggacccattctcatcctcttccttactcaagctcccgccttctccctacagg

SEQ ID NO: 47472 - DNA, 1501 bp, Oryza sativa
acgtaggaaataggaagctacatagtgctgcgagcatatatgcactaaggctataatattataaatgttatgcaacgctatatagtgtagccgagcatgctctaaggctataatattacacacccgtaatcaaataataaatatgtagcaaccgatattaaatgtatagtactattacacatttatattaaaaaaagatatttggagggaggatgttcctccaaacatttttttaagaagtaattgtgagcgtgttagagattaaatacgggatcttggggttgaaaccgtgcacccttgccactacactattaagtgcatctcattattgcccacttatgaaaatcaaaaacagtagaatggattcgattcattgtccatgaatttgatatcttccaaatggaacttattttgataatcaaatagagtggtttcgaccatctagcactctcccctgtaactatgtttatgttttgtcgtttatttataaaaataagggacatattctcaagactccatattggacaatgtccacgaccaagaatgagacatcagtaactataatttagactataccgaaaattggaataattaactttttaccgcaacaagtgtgagtggaaaagaatttttccactttacgagatgatgttacgagattaactaaatgtattattggcactatatagttaggttagaacccattcactttggattcgagtatgagactcgatacggatattcttgtttaccactaaggccctgttagtttctcctactaggagaggataaaattttggattagtgtggcatgcttttcaaactgctaaacgatgtgtttcgtgcgaaaaatttctatatgaaagttgttctaaaatatcagattaatctatttttgaagtttctaataattaaaactttaattaatcacatgttattaccacctcgttttacgtggaacacttaatctttatcttcatcttcatcttcaagagattcaaacaccaccgtattcttttagtgactaaaaaatatacccgtgcgttgcaacaggtaaatgatattttaattttattgttgttatatggtttagctagagtaaattcacagtaggattcgcttggatatttttttagaaaatcataagttgtaattaggaatcattatttcattccaaattagcatgcgagtttttttaaagagattttttatataacttcttttgtatttctaaaagcaagttagcttaaaatccaacttaaacaaggatttgtatttctaaaaacgaataaatttaaaaaccgactcaaacacagatgacgtaccaaaataccggcaaaaaaatcttcaatttttataatagtagaagtaggtggcatgcctatcaatagtaagttaattatgatgattttatcaagagtaaaatgcagtagcgtgtcggcgcgaccatcctcctcccctagtcgccgccgtccccctccctcccatcagtgccgccgtc

SEQ ID NO: 47473 - DNA, 1501 bp, Oryza sativa
taagttggtatggggattaacagcaaataagagatatactagctctatgtatagtacaatgacctttagaggggtagtggataataacatgcaaaaggtctggaagtccaccttttttgtttagagagggtttttctttacccggcctctaaatctagagaagggtaaattaaatttttttacctggcctcgcaaataccccaatctaatcaaatatatgcagccatttaaattgaaaacttagccccgcaaataactcaatctaaaaattcgctcatacgaagatttgaatccaagaccttgaaatgctactcaggtcactacaaccactaagctataagcctttttgcacatggagatcgaattcagtcaactgagcagctaaaaaagaaaggttgggaggggtgatgtttactgtctcctatgtggagaaactaaaactactaaccatatagtgtttagatgtcctatggcaagttttgtttggtgttggtctagagatgttttgggttgggcaaatactcctagaaatttagatgatttttttttctcctgtgcaatatcagaactaatcccatcaaggaaagaatcaagcttacagtgctggctgccgtttgctggtgattgtggcttactagagataacatggtctttatgaatgcgttggttttatgttatactctgcctttccaaatcatttctatgttgctgcagtggaagaagctgcttcgctctgatgaggagagcacgctgatggtgctgactcaaaggatgaaagagatggtggcaagactaaaaccgacgagaacaggagttggttgattccctgcttagtctgttgttatttttcaatagtttgatcttcagtgttaagttgtcgattaggcaggacttcactatagttatcttttgtgttggtattggaagcacgcgtataattttttcttaagaattttttgtgatatttgctaattgtacggaaagctcgtgtacatataatacgtttccatcttatttgatacatgttgctgctccatctcgaagaccataacaaactcctacaactgaaacctgtgtgatggagatcagatcagctttttgggatcagctgaaagtctgtccaagatatgctaatcccaacccaaatcaaatcagagacaatttattatggagaaaattaacctcaagacatacactctagtttctcttttatcctactaactactccactaattgatttactacttagtactaagtactccctccgtcctaaaatatagtaatttttagctataaatctgtccagatttataattaaaaattgctatattttagaacggatggagtagtaattaatcaaaatgctccactaatttgtatttttgaggataacttcggtacctgttgctataccttgaagaccataaaagaagtcctacaactgaaaccatatgtgatggagatctgctaatcccagcccaaattagagacagaatcaagt

SEQ ID NO: 47474 - DNA, 1047 bp, Oryza sativa
tgggttggtcatatacaggttgaaccattggcccactccacccaatttatttgcagtgacccattaagtaagttacccatctggtgtgctaattcttgctttaagctttgctcgatctagttttgatcagtttgaattgtaaatggacacccccttttaggagagacctagcggtgggagaagacaatagggctaccaccttaaaattgtttaaccaagttaggggacccataggagaaaagtgtacacataatcaagggttaatgatattaccaagacttggtatggttagccagctgtggtgaaggttgcagtagtacccgctagagacgaggaagagattgtaatagttgggacaagctcaaggttgtgatctagttgttgtagaggaggaataaggaaggcaccacgagacaaaaggagataatggtgacataggaaaaccagtagcgctgataaaattacgagaagggtgattacagtagattttgggggaaagaagaaattgtggttactttaaaaagggttttatgaatcttgatgcgatcctaatatatattcaaagtacatgttaagaaaggacttgagaagttgcacggcaaaatgtttaaacgatcaacttaaactgtttctacaatcaattaacagtagaggatttgaaattaccaccaaagttttacagtttggtgaagagagcttgggttctagttttctactactactagttcaattcggatcaaaagtccttcccgagttaaattgtttggcagggatggctggttggtcgttcttggtgaaaacgatcctcttctaaagaaaatgttggatacgatacttccgccaaattaaaagaaatgaacctgcttgttcttgggagtggtagaaacaaaccaatctccacgaccacgacatgaacggtaaatatttaagaagtgaaaacgatcctctcctaaagaaaacgttgtatacacgacttcttccgagaagaaacgaaaccgtgttcttggcagagggtggtagaaactaaccagcctccgtccgcgacca

SEQ ID NO: 47475 - DNA, 444 bp, Oryza sativa
gaaaacaagaagtgatcttatggatgctctaggcattgtttgtgttttgcaagaacgcagagcatctttgcagttatgcttttcttatggtgaaaacaaaaactgatcttagtgcatgtagcttcatcgtctgctgcatgttgattattatttagctacatcttttttgtaagagaacttgatagccagcatatattatctgaattgtctgttacatgttagctgtttctctggctctaataaacgtccatgtctggaggcatatgcatgaggtgatgccactggttgcaaatttgctgtgatataaaagtgagatttgatcatttgatcctgatcacgcacgacctatccactcgcaaaccactgaaaacaaagttgattatcttgtgctgtccagttaaactggaactgaatttctttcctcaaggcacagactaccaaaca

SEQ ID NO: 47476 - DNA, 301 bp, Oryza sativa
agaggaatcgagcggatcaagaagccgttccaactgaaacctatccaattcgttcaagatgccacattttccagattccgagagcgagcacaatccagtactcaattggaacgaacagcgcgagggaaaaaaaataaaaacaaatctgagtgaacgcagtgaccggtttagatctgccaagaacacaaggcaacaaaaaacaaatcccccaaccaaacaaaccaacatcaaccaatccatacacacacaaagagagaactaccaagaacacacctggatttggagggcagcattgtggaca

SEQ ID NO: 47477 - DNA, 337 bp, Oryza sativa
  unsure (1)..(337): unsure at all n locations
taagacacaacgtgtgtatgatatgtgggagtatatattaatagtatagtaagcactatttatataatttagctattagatcggctatagatgaattgnagctagtagtgggctcttagagactcaatgctgtagactgttgttcaccatagctgcatatcagtagtaaactactactgtacatcaccataagtaccagtgctattacagcagtatcaaagtagtccgncggtggtcggcgcgggtacgacggccgtcgcgcatccacgcggcgatgtgcgagacagtgcccgccgaacgcgggtgcgcgncagcgtagccactagcggctagcata

SEQ ID NO: 47478 - DNA, 1501 bp, Oryza sativa
gaaaggaattgaataatgtctgagcgacacattcttttttctttttagttgtactcttcctagtgacaccttagaaaaaaataatttactgacacgaactagtttgttgaacaaataaatttttcgagtggctacgtaaaccattatatcggtccaacaaggttaggcaagtttaggatggctatgtaaaccatttaggatgcaaaacaaccacaagtagtgggttaccatggacagacccgaccttaatagctaaattgacaacataaatgctaatgcaaaccgcacagatactattaacatagagctttagtttttgctatgtggagttttatgtttttactgagcaaaataacggtttcctaactatgtagcattacactaaaaaaaaacatgcgcccgtcccttataagtgtcaatgtgtttccatattttgtagatataatagaaatgatctccacaattttagacaattatacttgcatgaaatggaaaaaacgtgccttttgaaaagctaaaggctgcatgcactttattacaagattaattcttggtcttgcgtcttctctgctacatatactctccccggacagctgtctgagggtgaagttaggtataagtcaggattcggcatttctacatttgcgaattcatgccgtttaatttgatacgcgtgccattttattgtgagatggagggagcatgtattagcgcaaagaactagtcaaatctcaaatgaaccagcgtggacttgccacaagtcatccgtacacaaatgtaggccaggcggggcagcatcggatcctttgctcagctagccccctctcaccaggcagcgcgggcaagggcgccgtaaaaagatgaaccctacaggtagaaaagatgtgtcagctaaggcagatactactatagcagattagcagctgttgcatcagtagcgcatctcgattcctgaggcaaaatctctggccctctgaaacggaaaagcatgcaaagacctgcatgctggcaagtgtggcaagtggcgactcacccatccagggaaatctcctcctgctgatccatgattcatcaataccgcagtgacagggagcacacacaggcacagtaggggagaggttggcaactggccagtgagcgagagctgagttgaatgcacagcggaaaggtggtcctgggctgccggtttccaaggataataaaaactacctcccccgctcgctgctacgcccacccggcgctctgtgccctcctccccgtgtttatttatacgctcccagctaccactcttcacaaagcgatagccggaggaagaagaagaagcaacagcagcagtcaagccaacccgtccggcgagcaagaagcaaccgaggcagcaaaaggaggaggagggaggactccactgttcgcttgtatcgtcttatgggggaagaggatatcagcaacgacagcaagagcagctgcggctgcgaggacggcacggtggaggctccggcggctg

SEQ ID NO: 47479 - DNA, 557 bp, Oryza sativa
cccagagaaaatatagggagggaagaggtgggaaagaagacgatacaaggtggaagttgctaacatatgggtcccacatattgtttcaacaagtcaaccgcgatcaaactgccatgttggtagaaaccacttttcaaaaaaccatcgaaggggagttgatttgcattggtttttgaagacgaggagacattataccggttttgcggttgaggggcacgattcaacatgagcgtgagagggagataaaatagacgtattccaaaattaaaagtctaaaagataagcagtattttctgggccgactaaagtatgggccgtggtccgatggcactcgccgttacatatcatttgcattactgacaagtgggggttagcgttaggtgggacccaacacgtcagcatcagaagagagttaataattcggtcacgcccgtacgaataccactatgtactcctaattaagaaaaacaaagtactctatagtcacaaaaaggttaatgataatttgttagttggagtgggcttgtcttgtccgtgtttagtcttcctcctccagt

SEQ ID NO: 47480 - DNA, 1501 bp, Oryza sativa
tcaggtgtagctagcaaggtcagtactgtgagaatgggggaaagaagagtaagtggctaagtgctcgctagctgaggcctgaaggctaaagcagcaggtgatctctatagttgtgtacttatacaaacagtaagcgcaggtcgtaacacccatttgcacccctagttcccattgatccagcaattttatattgagtggctacacagtataggctagtaccagtatgcatcctaaacaaaaatcaacgagagaaggatgaaaaatccaagccgactggtcggccggtgcatgctcgctcggccagtcaacagttccagtgacgctacctacacagctacactgcaaaaacgtcttcgtgtttagagaagctccatgttttaaatttttttcccttgcccctctcgtggatacgggagcctctcgagacaaaattctcccccgaaagattcctctcccaaagaacaaaataacgaaacgtgagcccttaatttggtcaaacgactaactcaggttaaaacctgacagagcgagaccccgtgcatatgcacgcacaatctccctagctgttacaggcttttgtaatgttctctccgatgtgtataaattggaccaccgtgcaggggggcgtggacttcctcaagatttcaatcatgattaagtacaaagtaatctttggtttttgtgaacagtgactctaggaccacataattaagggtaaattagatactccaaacctgaacatcttgtagtgtgggaccggtcgctgaaaagtgcatttgccttttggtacaaatgggctcaacgcggttcagagcgatttgaagtttagaacttttgtttctctcgtaaaatttctaaggcaagcctatccactactgcaaaatggcactaaagggctataaaacaagtgcgcttgcaagatgcatttataagctagtttagctaaaggaaatttgtatttggttgtagcaaaggatgaaaggaggaacctaagtgcaaagggattcacccaacctgacaagccgcacaatattgtatctttagtagctgccgttgatatgtggatcggatccacctgtcagtctttgctactacaagtacattattgtagagcatttttgtccgatatgctaatatacgggcgaccttgttatatttaaagtgttttatttggtaagatgttcatccttttatacgtgtcatctataattttatttttttttatttttttaaaataagtaaattacattggcggtaaaaaaagttggcaggtgggtgcaattaggtacaagaacttgaaaatcgagcatgacgatacaataactttaggagaagattacaacttaggaaattttgccacgtcgtcgttgttccaccttagcgagattgtgatattagcagtgacacggaagaggtgctctcctatatatctgattttatagagtgaaccccttatacttttgtattccagttacttctccttcaacagctacaaaggatt

SEQ ID NO: 47481 - DNA, 974 bp, Oryza sativa
acaggcattaaattttgccatacctatagcaaagcaatgtgaaaatagaaaaaaatatatttccttgctactccctccgtttcacaatgtaagtcattctagcatttctcatattcatattgatgttaatgaatctaaatatatatatctatctagattcattaacaacaatatgaatgtggaaaatgctagaatgacttacattgtgaaacggaggaagtattaccaatccttaaactcgtgagtatattatttttatcttcaatgcactaattatctgaaccttatatcattacttgtaaatgtatgtgttgtgttaattctatatatgcacatattaatatttagaaagtgactcaaccgaggtttagatgtcttgagaaaatgactttacatatgagaaaaattttgaagtaccaaaaatatacctctacaagatagatttaacaaaatatgcctaaaaatgtctatatagcaaagtattataggcaacgttaaaagtgccataaaaactgtgctagttttagtggttgttttaacttgataaggagtccataaggatcctcatggataatgctgatttctaaagtacttgcagagtgtagtgcttgcagagtgtgcaggtgcacaagaaaaagacataggctgtatttagtacacactaaaattaaaagtttagttgaaattggacgatgtgatggaaaagttggaagtttacgtgtataggaaagttttgatatgatggaaaagttggaagtttgaagaaaaactttggaactaaacatggccatagtaaaaaataggcttgcttaactggcaataaggatcgttgacttgtcaagtcaggagtgtaaccccctagtcagtcatcagtcattaatataaattctctctttagctcaaaagaaaaaaaaaacctggaaaagacagacatagcttaccgatcaaggggattgccttgaagtcagaagcca

SEQ ID NO: 47482 - DNA, 486 bp, Oryza sativa
ctttcgctcagtgcatgtactgcacgacctcacgtttttcgttctagatgcaaaccgcccgcgagtacaatgatctgatttttttagattgggagttggagtacagagtctgattagcttttcccggccgtgtgtgtttgctcgaagcactttactttcacggcattatggcgtttgttgtgacataaacctccaataattgaatagccatcgcaacgtcatcgtatttatactggctagttgaaagtttttactcctacaaggctacaatgaacatcgaacactgtgttgcaaaagtacatatggaagttctatcagggacgtttgctagtgatggatactttaaaattgtagatttctagtagtaaatttggtgggaaaaactgtagttctacgaaaaatttgatgttaaacatataactttgggatcttacatcttaaatttatagttttgtcaaatatgtgtgttttgtgaattttactgtt

SEQ ID NO: 47483 - DNA, 1501 bp, Oryza sativa; identical to SEQ ID NO: 33855

SEQ ID NO: 47484 - DNA, 1501 bp, Oryza sativa
aactttttttaccgccaatgtaatttacttattttaaaaaaataaaaaaaaataaaattatagatgacacgtataaaaggatgaacatcttaccaaataaaacactttaaatataacaaggtcgcccgtatattagcatatcggacaaaaatgctctacaataatgtacttgtagtagcaaagactgacaggtggatccgatccacatatcaacggcagctactaaagatacaatattgtgcggcttgtcaggttgggtgaatccctttgcacttaggttcctcctttcatcctttgctacaaccaaatacaaatttcctttagctaaactagcttataaatgcatcttgcaagcgcacttgttttatagccctttagtgccattttgcagtagtggataggcttgccttagaaattttacgagagaaacaaaagttctaaacttcaaatcgctctgaaccgcgttgagcccatttgtaccaaaaggcaaatgcacttttcagcgaccggtcccacactacaagatgttcaggtttggagtatctaatttacccttaattatgtggtcctagagtcactgttcacaaaaaccaaagattactttgtacttaatcatgattgaaatcttgaggaagtccacgcccccctgcacggtggtccaatttatacacatcggagagaacattacaaaagcctgtaacagctagggagattgtgcgtgcatatgcacggggtctcgctctgtcaggttttaacctgagttagtcgtttgaccaaattaagggctcacgtttcgttattttgttctttgggagaggaatctttcgggggagaattttgtctcgagaggctcccgtatccacgagaggggcaagggaaaaaaatttaaaacatggagcttctctaaacacgaagacgtttttgcagtgtagctgtgtaggtagcgtcactggaactgttgactggccgagcgagcatgcaccggccgaccagtcggcttggatttttcatccttctctcgttgatttttgtttaggatgcatactggtactagcctatactgtgtagccactcaatataaaattgctggatcaatgggaactaggggtgcaaatgggtgttacgacctgcgcttactgtttgtataagtacacaactatagagatcacctgctgctttagccttcaggcctcagctagcgagcacttagccacttactcttctttcccccattctcacagtactgaccttgctagctacacctgaagatcagctggttgccgacttgccattgccgatgcaagattccggtagctgcactgatcgatcaaagaacaatctggctagcaatcttggttcttgtttgcaaattaatcagtgaaaagatacacgaagaaagctaattaagctagtgattttggtgtctagtagctaatggcttctgcagataactggctaggcttctcgctctccggccaaggcaacccacagcatcaccaga

SEQ ID NO: 47485 - DNA, 1501 bp, Oryza sativa
gtgtaaaaactaatgaaagtgctacatagggaagggaacttttgaagtttgggtgctatagagggaagagcaacttttttctgatgttacatagggaattttctcatcattgtatctgtgaaacactttggaaaactattgtatagaaaatacaattgtgtcaatggaaaaagaagctaagagttatatatcaaatccattttgacattttaaatctattggatgtaaatttcaataatattaatggtatcaaaagttaaaaagttgcataccaaattcctcacagaatatagaatgtagctattttaggtgtaaattttgtcataaatatagctaaaaaagatgagttttattccattactaactctgataggccccatcatcgcatcagccctctgagacctgcacccttcccatacttatttctaatctcgatcacctcatcatgtattaactagataagaaccccgcaagtttttgcgagagaattatatgacaaaatagtggatatgagttataaaatttactttcttacttttcgctttgtgtgcactaacttcattttacatcatcaaacgaaagttagcacacaaaacgagaaagtcattagcgcaattatagttgagttttaattattacaaatttaaaaattatatttatttgatattttaaagcaacttttatatagaaagttttttttatgatacacattgtttagcattttaaaaaaacgtgctagtgctaatgaaaactaaggtacaatccacatcttaattagaaaaaaagaaccttcaatgtatcagctctccaaagtttttgaattgcagttcaagaacttcagccctccggaacaactaaacgatgtttcgtgcgaaaacattctagctactgtggacatcatagcttctctcaggcacaactctttttttattaacatgcagattttatctttgtttccattaacccatttttcaaatagctaaatggtgtttcatgcaaaaatactttatatagcaatttatctaaaatatcaaataaattcgttttttcaatttataataattaaaatttaattaattatacactaataactttactattttaccgatccgtatttaatcccaaccagtgcctcaatgcatgcaagatgcatctaccagctaaggccttcccaaagaaaaacttttcaccatatcacatcgaatgtttatacacatacatgaattattaaatataggaaaaaaaactaattatacagattacgtgtaaattgcgaaatgaatcatttaagcctaattgctccatgatttgataatgtggtgctacagtaaatatttgctaatgacggattagttaggcttaataaattcgtctcgtagttttcaagcggaatctatattttgttttgttattagtctacgttcaatacttcgaatgtgtgtccatgtatctaatgtgacacgtcaacaattttcgttcgcgaactaaacatgccctaaga

SEQ ID NO: 47486 - DNA, 1160 bp, Oryza sativa
tacttgttagacttgtacaagaaacaaatttttagagaacccggcaattgttccaaagtctccagctggggcctttctttgtccatctacctagctactactccatcaatcaatcttttcttgtgcagaaattctggagattatttgaagcatgataggtgatgcttattgattcttcttggaaaaggatgtgcaagaattttgtgcctgttgcattgccgggggcaagtcaaatttacaatagtttttgataattttaggacccccttctcaaatgtacatgcaaatgttctatgtatccgaggagctagttgtttgattaaattgctaagaacatgtatataaaagtttaatccaataatcttttctggagaatatttgaaagcgtgatggtgctgcttgctgattcttggaaaaggatgtggcagaattttgtgcttgttgcattgccggggacaaatcaaaattacaaattttgttttgatgatttgaggaacacccttctttcgcaaatagaaaccccttctcaaatgtacatgcaaatgttcttctatatccaagaagctatacataatattaattatttgattatatatgtgtgaaattgccggtaattggaaaaaaaatcctaatgtgaaattgtaaaaatagagagtaaaaagtacacgtattcagaaattcagataacataggatatgcatactatgagcttttgattagactctacccaattaccaatagttttgtcatcacttctacaagttgtaattgttttgaagatactagtactagtagtagtacgttttgaatacacaaatacaaacatatccatgcattgcttgaacaggactactgaaataatatattgtcaagtttaactaaggtctattgcgtcaaggaaagcttttccaccaataattcgaggcaggtgacattctccttgatagtgtcactattagttaattaagcactgaaagctctgactttgctagatgagcctatttataatgtccaaaatatttcacaaatggggggtttcattttctcaaatccagctagccctctgtaagtctgtatacatccaccattcaccatcaagcaataaagaacataaaactgctggtccctcaaaagaaaatcaaaagaaaaaggaacaaaaa

SEQ ID NO: 47487 - DNA, 881 bp, Oryza sativa
tcgtcactcgtttagttttacgcaattatgcgggtctttcagatgacaatgctactagtacttcctcattaattcagtatcacactctttagtcccttactttgcacttaagattttttttaataaaagaaaccctgatcatgttcggagtggacgaatggtgtttgttgtttggtctgatgacctcatgtgtcaagctaataatttgttcatatccagcaatagtttttttctatcatgcccccaagtagaccagtacatttcatactccttggttctgtttggtgaagcttgtagcagtttatttcaaaatctttagtcacccaaaatttttacctacattgtgaggaaaactcagcttttccagatactgctatgttaagctctttctggatcaggcctttgcatgtatctctctctcttgacacaaaggctgagctgctgaggctatgttgtctcctgtgctctccaaacccgaagccagactagtccagcaccattgcgctaacacacaaatacccaaccgcaaaaccagatatccagcatcttataactaatcaaaaccggttacaattggtgctttggtggttttgacccaggttttgtcctacgtggcagctgagtcagcgtgggacccatgcgagcctcacatgtcaggatgccacgccatctctctcccctcctttctctctccctctctctctcactctcactctcactctcactcttctcttctcttctcttctaattcaccggtcatgccggtcggccgaagcagaagcaagagccactggtggaggggctaggggggtttcgtcgccagcgatggcctagatggagttgagcgttggtggtggcggtgttccgtgacccgccgcagt

SEQ ID NO: 47488 - DNA, 680 bp, Oryza sativa
ctggccgtaatagtgatagcgcgatggtgttgcgctattaaaatagcgaagagaatattacgggggctatgtgcaaaaatatcatccattatttggtatatgttataaaataaatatttttttacttggctatgttataacaaaatataaattaaacactaatctacaatttataattttaacgagtaaaatagtctgacaaaaagtgaatatacacaatttacatattttagttttttttatgatttttctattgaaatataagcatccataatatcacccgctatctgctacgcataggaatttgccgccccgctatccgctttttagggtgtggcctggtttagtttctaattttttcttcaaactttcaactttttcattacatcaaaacttttatacacacacaaacttctaactttttcgttacattgttccaacttcaaccaaacttctaattttgacgtgaactaaacacacccttagtagtagcttgctcatagaacttcggcacagagcctgagagccaccctcctcgctattttgttctatatttttctttgttctttatgtgcatgcaacgaccaaggtgagtgagatgaagttgcaccagctaagctagcctaaccataaaccatggtaccgatcgatcacatgttgctacaagctttttgcttagg

SEQ ID NO: 47489 - DNA, 619 bp, Oryza sativa
taatgtagctctactggaagtctggaactcaactgtattattatcatttttttgtattgttatcttatgtttattgcatgtgaactagaaaagcatgtctaaattttatagagcttcacattgaagcttatctagtgttgcaatgccactgatatctcaagttaacccctctggtttttatataatgtctgaaccatagtgtatttgcatctatgaaatccttatcgcaacaagcaagccacctgattcttttttttttaatgtagcctagtggaagccagtttgtcgttgttatttcatggaaggtagaaaatcatgtctaaatatttagaggtcaactatgaaactaatctactgtgggcgtgttgactgatgataaatctaatgcaatggtgctgataacatattgtcaagttaatgtggtttgttaatttaaggttaacttgttggttcagaaagtacaggataatctgttcaaacaaagcttgttattccaaagtttacttttgcttgagtctagttctgtccaaattaatacagtgaagtactgcatatatatgcttgttgtaatagcttgtaatttctagtcttgttaacttaacatgtttcattttctagg

SEQ ID NO: 47490 - DNA, 522 bp, Oryza sativa
gaaaacatcttatacggagggagcaacaaagatgcatgtgcgttacaacaggtaaagacaatttcacgattgataaaaactctaccaatttaaacgacaaaccgaaacaagacaaacaaaaccatggcaaaacaaagtcagaaatcatatataagtattgagcacactagcttcatgcatcatcatatgaaggatccttcatgtacactttcccatagcctcacaaattgatcgggtggctattctattatttgacacgtgtattttgctatacctcattgaccgaagattgtaattttgattattcaattagtgaaattattttactgtaaatggaaagtatttgcaaagtaataaacttgccgcatacacaccttaaacaattataatttcaaaagaaaaatatttatgagaagagaaattcggaagagaaaagaaaaatgagaaaatagacgagattgaaaggatcggaagagaattaggatgattgggagaaaaaagaaaaatggaaagagaaaaaga

SEQ ID NO: 47491 - DNA, 552 bp, Oryza sativa
attttaggtttgaatttgtaatttcaccactggtacaccccttatttctgcatgttacaaatatattgtgcctgctcagaactgcttgccacggccagggcttcgatctctactgtgacatctagtagagctctttaatttgtgtaggcagcaggtttgagtaggcccattgtgtctctgtattggcatgatctatagaatacaactctgtatagtcgctgatttattagtatacaaattttttgatttttaaaaatattattgttattttttgttggtactcaatcaaaaatatttaaacatatttgacacttaaaatttaaaagtttaactaggcatactatttatctggtattaattgttgagcaccgagatacatatattatatatatatatatatatatgaaaatggttctatacacctgggagtatgtacacctgttctcatccaccgttgatctatgattagcttcgatggaacctgatatcggattaacgagcggacccgtttaactttttgacgagaaaaaaattacgtactccttaattagc

SEQ ID NO: 47492 - DNA, 787 bp, Oryza sativa
tgcgactagaacctgtgccggtgatgctgaggcttggctgataataatcatgagatcggaagtgaaggattcggctaccagtcagggtgcgggtgcttgcggagttggctggaaccgaggcagcgatcatggtcttcgtctggttcaagatgttgacaacatgatcagcttggttgagtgcgtcttccttgaggagggtgtcgaggagagtgattgctgcaaccacgttctgctggggggtgcgaaagaccgctgttccatcgacgtcttgttgcccaatgagttctctcgctcggcgcccagattccaaggcgcgttgccgtcgatcttcagcctcctttgcaatccgttcgtgatcttgctgctcacgttgtagtcgttctcgctcctgtcgctgtcgctcttcctccagtcggcgacgttcagcttcttggcgtgcacgatcttggtctacttctcgggcttggcgttgttcctccgtttcattgtcagccatgaatacgccgaagaagaggggcatgtagttatcctcatagctgtcgtcgaagttgtcgaggtcgccgtggtcgtagtggtagccgaaatcgtcgtagtcgaggatctcggttagtcgagaactaacgccgggggagctaaggtaaccatccaactctttcgtcgagactgtcccaagaggttggagtataacgccaacctctctggatctagattggatcggggccgaagccggagctcgcctagatcttcgaatgggagatgtcttggcagtgaagacagcggccaaatc

SEQ ID NO: 47493 - DNA, 678 bp, Oryza sativa
cataattaacgagagtataattacctagctatcattattagttttttaattgtttgattaattaattatagctaggtacgtactagtactaccacagtacccacgtgttatcgaacatgcaagctagctgatcacgtacatacagctaattatttattttcttggttactactgtactgtattataaatccaccttctgatagggtcggtgctgttattttcatagacagggttctttaatttctcttgtcattgggggaaaatgttaagcgagatcttattgccatcttgaacaaagtatttctgattaagattttattttttaaaaaaaatcaattaatttgaaatactccagtttcaacaagtttagaataaatttaaagaaattcaagtggacccgaaattttcgccatggtgctaaattaatcgagaggttcaacgtttagttgagagataacacagtacatggcagagttaattgttgtgcaactacatgctcactatacttatatggtttttctccatgcaagtgggctaattgtacatttaaacttagttaagcccacatgtcaatatagcttcgtgattacaaaaactggttagccagatattgaccttttaatttggtcacgaaatccaagacgaggagtatacgtgtgaatcaagtctatattgtta

SEQ ID NO: 47494 - DNA, 1501 bp, Oryza sativa
ctcttgtctcgtgtttctgttggtcagaaacatgcttggaattaatgcccataaagagagcataaggaaggattaccccagttactaacgctaacacgctttgcagctgtcaagattaccccagttaccccataaagagaccatcactaacacgctttgcagcgggcatttggagtagcacttaacaagcagagcctaaaagcagtaaagcacgcagtaatcggaataagggcatgtttggttggacaccagacgtaagcctgagaccagccgggaccttgtttggttggtgtcctgaccttagtttctccttccctggcctgagctcttttggagccttattagcctgagtcaggcgagctccagggcggcgcagctacgctcattaatcctaattaccgcttataataatgtagtataggtactgtaaattgtagaagcaaccgaccatacaaatatattttatttgtgctttcaaggagggatacaacacatccaaatattttatttttttgctaacactttataacaaccgtaataattaaaagcttaatcacgtttagttttcacaggcgcggaagaacaaccaaacagacaagtgagacaagtgttcaggctgcctgagcaggcaaaatttatcatcctatcaggtagctctcaggcacccaaatttttcaggcatgttggtgagggcatcaaccaaataggccctaagtgtgcgtacgactgcacctgttcgacctgcatatcactgtacataagctcaagttttaaatcgttttgacaggtccaagtgaatgcttatgaactccgtgattgattggttcagcgcagttgtatgagagttggatgtatagcactactccacagtaatatgaacgccagtggtcatatatggatgtatatatacgacgccagtgttcgactgatggccgacttcattacggcatcacctgcgcgtgtcagattctattacagaatgagacatttgccgtctgagcctttcattgtggctatggtcatactctcttcgtcccatttaatgtacaatcatgcttttccgtactaaattttgttcattcgttttatttattttttaaaaaaaatcatacctaaaatattatttatgttttatcatcccataacaataaaatactaattaaaaaaaattaaacaacatggacgatcaaatttaaacacgaaaatttatggttgcacttagaatagtatggaggacacaatagctggacaacaaggttgtaccggcacgtatatcattttcgccgtaatatagctctcttgtactactgacgtgccgaatcggtctcggtctatagagccccgaccgagccggactcgtccgaccgagtcggactccacctcggactaatcgatcccatttaaatcgccatcactccgcgcgctctcccatccatccatcatccaagtcaacaagacaagcccgagttttgtgccactctacacaacacacacatggcga

SEQ ID NO: 47495 - DNA, 1501 bp, Oryza sativa; identical to SEQ ID NO: 38211

SEQ ID NO: 47496 - DNA, 1501 bp, Oryza sativa
attaggctccaatggatgatacatggtagtactaccttcgtccagtatcatatagatactgctagcatttaaattttgtcatataatataataactacttccacgtctactttttcatcttaaccaatcgcaaattcgcaactctctaatttaaaatcaccctcattccttaatttcttgaaaaagaagtgcagaagcatgtccaatattacttcacattctaagctaatcacaatcctctaatttaaaatcacccattctttaatttcttaaaaagaaagtgcataagtccctacagtataggacagagggagtacataaaaaaagggaagtgcacaactcctggacagaaggagtacatctaccacagagggtgtcgcatgttagagtgtgtttggtttggtgaatgatgttggatgggagatagaccgtctgattttttttttgttttgtttggataaagagcagggtggatggggcaacccaaaaagaaaatattcccttaatatccttaatatgctggatgagtagatccagctaatttggccaaataaagccatccatgttttaatttgggtgacttggcctattccaattggatgtggttggtttaattttctgttaacaagcttaaaatgttttttcctcctgaactatttatctaatttgtaatccgattatactattatactaattacaattaaatctctagttatattttgataaaaaaaattaacaaatgtgccatactaaattgtggcttatcccattcatgttatatctctctaaacaaataagaaattggaatcatcctatccatacaaaccaaataaaagttagatcatcgtatccaacagagcatggatgaccatatattatccatgtatggctttgaagcaaacgcaccctatgtgatgggatgtgatatagcacgaagaacatagaacattaagatactgagtaaatataccatgttgaaatcaattgccaattataccccttaaagaaaaggcaaataaacgaaaattgactaagacatctatatatatatataaagttttcgcaactaatgttgtcacgaagaaacaaagaaatacataattctatatagcttatccagagggggaaaccctaagataagtataataaaagggtggttccaaccgttctgtttcctcttcaaagaatagaaaaaagaatcttttttttaactaaatttgacgctgttcttaattatgatgaaatcattcttagctttttccgtggattatggacaactatattaattacaaagtaattacatcaaaccaccacagaaagaaagaaaaaactcaaagaactacaaatcattcacacatctatgtttcttatttgtaattgaccagccataccaaaaaggaaaaaaaaaaaacaaattcgacacactctgctctgtagagtgtagattgactgactcatgcatcaagccattagcatcaatgctgctacggcggcggccgcg

SEQ ID NO: 47497 - DNA, 249 bp, Oryza sativa
cccacgagactactctcgcccgcgaagagatccgactggctgcgaccacggcaagcgaaggagaagtgcctgcaaccaagctgacgaagaccgaagaaagtgatgccaagacgaaaaagattcccttagatccctccgatcctgataagactgctgtaataggcgctgagttagattgtaaataggaaagcgcgctcatcacctttcttcagaataataaagacatttttgcgtagaaaccatccgata

SEQ ID NO: 47498 - DNA, 1501 bp, Oryza sativa
ccggaatattgtcgtcttccacttcatcttcttctatttcaacacattgctctctgtgggatgtccaacaattatagcttggcatgaaccccgactcaaacaagtggaaatgaatagtcctggatgcagaatactccttctgattcttacacttattgcatggacaacaaataaacccctttgcctgttagcttcggctactatcaaaaaatagtgcacgccgtcaataaactctttggaccgccggtcagcgtacatccattgccgatccatctacatgagtcgaaaaaaaatcgtacaaaaataattattcttacaataatgacagtcatacaataattataagataattacaaactgtttcaacagtcatacaataatgacatatctttattcatacaaaaatcataaaatattacaccaaataattcttatttactatttctaaagttttaaactaattttaatgtgttttacttcttttaattttcattttagtttgttttctagtattcaagattaactttcactatagttttccttctcaactattttataaaaccttctttagcaaatcaactaaatttctatatattctttcttccccacacaaattttctccctcgtcaacttacaactaaattttggagacaaaaaagtgtgcaaaacatagctgcaaatgtaatatgacaaaaaaaacattggaggatgaagttgcaaaccttttaggcacctccgatttgtatgtaatcaccaaaataaattcactagaaattttggcatgacctcccctcttttttaagaaattttgaagcttgctcgggcagctggaggaggaagaagacatatatataggggtgggactttagttaccaaccggggctaaagatccccgagatctaccaaccgggactaaagatcccgggggggctgacatgccctgacagcatttgaactgggactaaagatgatctttagtcccggttggtgtactaaccgggactaaagatcaaatatgcccgttaccctttttaaccggaactaaagatcatctttagccctggtttttattgcatccgggactattgtggaattcgaccgaccgacgaaagatggtttctccaccggtgtttcaaccgttgcggatggcataccctaagctagtccaaaagtacatagtatatatagctgaagatgaaagtccctggctagttgcttgtatatatgctgaagtaagaagtgaactgtcggtttgccctccaaataaatctagctagcacacctcgagattcccaattaagtcaatcagtaataataaataattatgaacccctaattaagaccaataagaaaaaccaaacacaggaggaaggaacggagcaattaaatataagagtgaaagcgacagggcaccggagcgtggcagttgcgtaaattactccaaccctttctctccatgcatctcacctccacagcgacccaccacccttctttctgccat

SEQ ID NO: 47499 - DNA, 1380 bp, Oryza sativa
ccacccacaaccttgccgccgccattgccaccgcagctacagcctacagagaagctagctagctagctagagagagagaagaagaagaagcagtgtggcatgcagcgcgagtgagagcctgagaggaggggtatgtatgtaaatgtaaggcatggcagaaagaagggtggtgggtcgctgtggaggtgagatgcatggagagaaagggttggagtaatttacgcaactgccacgctccggtgccctgtcgctttcactcttatatttaattgctccgttccttcctcctgtgtttggtttttcttattggtcttaattaggggttcataattatttattattactgattgacttaattgggaatctcgaggtgtgctagctagatttatttggagggcaaaccgacagttcacttcttacttcagcatatatacaagcaactagccagggactttcatcttcagctatatatactatgtacttttggactagcttagggtatgccatccgcaacggttgaaacaccggtggagaaaccatctttcgtcggtcggtcgaattccacaatagtcccggatgcaataaaaaccagggctaaagatgatctttagttccggttaaaaagggtaacgggcatatttgatctttagtcccggttagtacaccaaccgggactaaagatcatctttagtcccagttcaaatgctgtcagggcatgtcagcccccccgggatctttagtcccggttggtagatctcggggatctttagccccggttggtaactaaagtcccacccctatatatatgtcttcttcctcctccagctgcccgagcaagcttcaaaatttcttaaaaaagaggggaggtcatgccaaaatttctagtgaatttattttggtgattacatacaaatcggaggtgcctaaaaggtttgcaacttcatcctccaatgttttttttgtcatattacatttgcagctatgttttgcacacttttttgtctccaaaatttagttgtaagttgacgagggagaaaatttgtgtggggaagaaagaatatatagaaatttagttgatttgctaaagaaggttttataaaatagttgagaaggaaaactatagtgaaagttaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactgtcattattgtaagaataattatttttgtacgattttttttcgactcatgtaga

SEQ ID NO: 47500 - DNA, 1415 bp, Oryza sativa
ccggtgtgagagccgccgaccgccgcctccttctggatctctctctctaatctcgatctctctctctccctctcggttgccgccggccgccgagtttcagacgccgacgccgacctcgtcacgacacgacgccgcgccacgacgacgccgtgccatgagacgccacgacgccgcacgccgccgccgctccgctgccgccacaccgccgtcccgctgccgtcacaccgagaacgtgaacgagcgaacgaacgtgaatgataacgagcgaacgaacgtgaacgagaacaaggtgaatgaacgtgaacgagaacgagcgaacgaatgtgaacgagccaatgaacgtgaacgtgaaatgcaattataggcaggttaatgaacgtgaacgaacaaacgtaggtgaatgaaacgtgaccttaacgagaacgcgaacgtgaacgatatcgtgaacgaaacgtgaacgtcaaatgcaatatatgttacatcacgtttatcctaatacatctttttgtatcttgcagaaaagacgttgtcggagttgtccctcaagccggagtggtagagctagccctcgaaggaattcgcccaggcaagtgacataattatatatatatgattgttatatttgtaatgcaattaagattattagatttgtaattagacttaattagcatataagattgtgtagtgttctaatatacgacagttacacttagaatacatgactatttgagttttagtataagattattggagttttaatataagattattatatttgtaattagacttagtatataattattgactagctagggtcctataatatatgtcacctagacttagcatatatatcactatttgagttttagtataagattattagatttgtaattagacttagcatgtaagattgtgtagggttctaatatacgacagttacacttagcatacatggctatttttgtcttagcatataagattatttgagttttaatataagattattatatttgtcattagacttagtatataattattgactagctagggtcctataatatacgtcacctagacttagcatttatcactatttgagttttagtataagattatttgagttttaatataagattattatatttgtaattagacttagtatataattattgactagctagggtcctataatatacgtcacctagacttagcatttatcactatttgagttttagtataagattatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacaga

SEQ ID NO: 47501 - DNA, 266 bp, Oryza sativa
ctagtctcatgtgtcgccgtcacgacaggtatttgaccacagatatatgtacatacatgtcgtgtacaagaaaactacggttgcatttcagctgccttatactataacattttttttaaaaaaagattaaaactcagcctctacatccaaagtggatcgatgtatacagtcgaatctgccaatagtacttaactattacttctgggttaacaatcttatgaaacatttttgggtttttcttactgtcagaaaaggtgtctgaaaca

SEQ ID NO: 47502 - DNA, 303 bp, Oryza sativa
tacgctacaaatttaaaatctcacactataatttccgtaattctccgtatatagaacagttgtaagaaaagcaattgattgcgcacttgatccataccttacattcttgattacacattgctgactttatcgtgatgagtaaataaatttgcacagtcgattgtttagcctgacacgagtcttcaagtctgaacccaaatcgagccaaccaaacacgctcctatataaaggccgcgaccaacacgcaccgcaccgcaaactaacaccgcggtgtgatccattctgcaagtgatccgttctgca

SEQ ID NO: 47503 - DNA, 173 bp, Oryza sativa
gggacactttcctagcttctactctctcgctttcctttccaaactaataaataatatatttttttaaatagagaaaatttattttaaaaaaatcatattaatctatttcaatttttttaagctaatatttaattaattatgtgttaatccgccgcttcattttgtgtgctagg

SEQ ID NO: 47504 - DNA, 169 bp, Oryza sativa
  unsure (1)..(169): unsure at all n locations
ccgcgggccgcccgaatcctcaaaccccaactccggttcaccgttcacctcccgccagccaaggtantactccttcaccccccccaccctctcctccctcgcttatcttgcgcccgcctttcaaacccacactgttcatgtcttcttgttcttgccacagccaacagca

SEQ ID NO: 47505 - DNA, 645 bp, Oryza sativa
ttcctgcagcccgtccataggttttcatttctaaatcatttaattctcatctattcctttgaacttgggcctgactgtcctctgttctgtcaggccggatgttctggtcatcccagtccggaacttccgggggtcgggggtataactacccagggggagcccaagcttcttttctctctcgtcacttcttctcctccccgattcccaaaccctagccgccgctacagtgctcctctcggcgattttctattccaaccgtggaaatttgattcctctccgtagaatcaaccacattggtggctaggaggttcatcccgcgatcgatttgcgattttccctctcaaggtagcacttttgatcttctcctttggttcatcatgtttttgccccgatctctaaatatgtgaacctagggagaaaaccttttggatagaattgttcctgctaccttgtagattgccgatctataggattttgtcacatgcactggcctggttaaatcctctgttcttcagttttgcaggccggaagttccggtgttcttggcctggaacttccggtctctgtccagccagccaataaccttgattctgctactgtttcatttaaccattgcactccaaccttgttgattcttgttgcagt

SEQ ID NO: 47506 - DNA, 1501 bp, Oryza sativa
agggtgatgctaccggggcaagctttgcccaggagcgaaccctggtcaagggtaaacacaagttccatcactcacctgtgcagtttgatttgagggaaaattctgagagagaaaactgtggatctcaaagctctgggaaatttggggggtctagattgcctaagactgatttccctaagtttgatggagagaatcctaagctctggaaaactaattgtgaaaaatacttcagcatgtatcatgttccttatgaaacatgggcttcctttgccaccttgcatttcactggcactgcagcacttcggctccaaacctatgaggagttgcattgcatagagagttggcctgaactagtggtagaagttcatagcaagtttggtagagataaatacgagcaacatttggaagaacaagaaggttttaagcaattagggggagtggaggaataccattccaaatttgaagagatcatgaataaagtcttagtttataataaggcttttgatgaaaccttttttgttactaaatttgttggtgggttgaaaagtgagattaaagcagctattaagctgcacaagcctagaactgttgatgctgctctatcacttgataaaacgcaggaggacttgctgggagaaatcacagtgaagactgttggcagaactacatacaaagagcagtacaagcctgctgtcaagaccccattccttggtaaaggaattctgggccctagccctgatgagaacaagaaggtggaggaaaagcccaagtgggaagagagatttgattcactaaaagcagctagaagggctcgaggagagtgtttcaagtgcggggaaaagtatggccctggacacaagtgcccaaaatcggtgcagctgcatgttctggaagaattgctagaggtgttcctggcgcaagaagaggacagtaacaaggctgatgatgtggaaggaacaagtgatgaggaactggtactctctgaatgtgcagtctctggtacagttgggaaaaggaccattagactgcgggcttgttacagaatcaagagatacttgtcctggttgattctggtagttccagcaatttcttgtcagagcaattggtgtcaaggttgcagttgtctacccaggagtgtgtgccatcacaagtaaccatagctgatgggggtaaaatgctctgcaatcaagtggtgaatggtttggagtggtggtgtcagggaaaaactttcaaaactgatctgaaggtgcttccactgggtggttatgacatgatccttggtatggagtggttggaggaattcagtcccatgtgggtggattggaagagaaagaaaatgagattcacttatgaagaaaagagaatcactctagttggggtcaaggaacaattgtttaccaatgtaagcctgtgacagcaaggcaactcaaagggatggcaaaggctggagcaatctctcagttggtgcagttgtgtgcactagaggagaaagggttggagc

SEQ ID NO: 47507 - DNA, 1501 bp, Oryza sativa
agtatatataaagaatggacactacaaaaaggcactccattatctcgaggactaaacagaatgagttactctgcattttgcattacaatttacaaatgtacatgtacaagaatatttgaaagaccatcacttccacaaactctcgcctacccggcaaagccggtgccataatcaccacaagggatagcggcgaagctcgccagcggcggcggctcctgcctcggggacgccgccggctgaccgatcttcgtctcatcagctgctgctatgccgtcgacggtggcgttgaaccacggaagccgaagcgcctccgccgccgacagccgcgcgtcggggttgcaggtgaggaggccgttcaagacctcgaacccgtcgcgcgacaggcgctcctccgggaacaggtcgcgcagccggtttcagtcccagctccggcaaatcggcaccgcgccgaagagcggcagcgacgggtagctcggccatgtctggcggcacggcgcgccgagcaggcggaagattctcagcagctcgtcggtctcgctgtgcccccggaacagcggcacgccggcgaggagctcgcccatcacgcagccggccgaccaggcgtccacgagctcgccgtagtccggcttcccgaggagcatctccggcgccttgtacccgggcgatccggccttctggtacggcggcttccgcgccgccgtgtccatggccagcccgaggtcgcacagcttcacgacgccgccgtcgccgacgaggatgttcccgggcttgatgtcccggtggacgacgtggcggtcgtggagcctctgcaccccgctcagcagctgccgcatgacgcggcgcacctcctcctccgtgaacggcggcccgccgccgccgccgtggcgctcgcgcaggacgctgctcaggctagggccgacgtgctccatgacgaggccccacatcccggagcgcggctcgagcgcgaggccgtggtagtggacgatggaggggtggtggctgcagcgcgcgaggtagagcgcctcccgcagcagcgcgtcctcgccgacggccttaccacccatgccgcagcggtggcggcggaggaacttgatcgcgacgtccctgcccgtcgcgcggtggcgcgccctgatgacggcgccgaacgcgcccttcctgagccagcacgtgacctcgtaattgtcggtgctctcgatgcagctccgcttgccgccgccgccgccgccggcgtgctcgtcggcgtcggcgatgccactatccgcagcagatcgcttctcgcccatggagaccaagagaagatggtgtcaagcttagccgaggtgagtaaatggaggccaaggctggacgtgggcgagtttaaatagtcacctttcgcgccatgaatccgcgtcgaactcgaactcatgcctccgtttcgcattcggtttctcgaattcgaatccgaatcagcgctcgcctcggctgcgcgccacaaaatacgaatcggactccgtctcgtgtg

SEQ ID NO: 47508 - DNA, 1501 bp, Oryza sativa
tctccccgagaggtcggaccgctcccgtctcggccccgagggccgaggcgccccgaccccttgtgggttttgcgccgcgtatatggggtaggtgagcatagcggggctcacctaaccgcatttattgcggtttggacgagcgcgttacgccacatgtagcgcagtatggcacgctcgtttatccggtctgtgaccggtcacagatcggtcagattgcgggttaggtggcaacaggcgatctgacacacgcctcgccccgtcccgtcaagatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacattgcacctgcttccggcggagtggaggtaggtatgggccgtcccatcagaagggtcactcgggcagcagccgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggaaaagtggtgcatgtggtatccccttgagatataaaaggaggaccttgcccacttaagaggggaggggggaaggggggatgatctggagaggagatcccacgagagaaaaaaaaaggagaagagggtttttagaataagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacctagggcccctggccgaaccggcaaaggggggcctgcgcggtctcccggtgaggagccccacgctccgtcaatatatatatatatatatatatatatatatatatatatatatatatatatatatatatatatatatatatatatgtatgtatgtatgtatgtatgtatgtatgtatgtatgtatgtatgtatgtatgtatgtatgtataggaaaatgcggatttgagctcgagctcacatgtacctataaaatctgccgttcgactgcgcagagattcgtgcgtgtgttgatctacgaggggagcgaccgaagttgttagggcgagggtacatatatggttaaggtagaaaaaacgacatattctctacatgccgatatacacttaatcatagtgaaagcccaaaatgccctttgctgctatcactagctttagacagggctaaagcaggc

SEQ ID NO: 47509 - DNA, 362 bp, Oryza sativa
tatacatgatttattccttattctaaaattgaaataaaaaattaatttgtttattttattattttttatcagaagaagtagactaattttgtattccagtgatcgctcctaaccgttctacgagagataaattaaggttaaattccctagacaaaccgaacttccatgcgccgatcgttaaaatctgtattctaatgatcacttcaaatcatccattgaaagatcaatcaaggccaaattccatggacaaaccgaactcatcttcacatatggtcttctcaaatctcaacgcgaagactattataaagggaaagggactcccatcgttggaaaaaagatgtgaaaaggacgggcatgaatca

SEQ ID NO: 47510 - DNA, 276 bp, Oryza sativa
catgaacaactatactaactaagcaactagattaagttatgcaattcagcggtgataagggctcaagtatgtctatgaaaatatactgcacaaaagtaaatgcattaagtaaatgagacaggagacaagaaattttttaaccgtttcatttacttaatgcattaagttcggaaactcatcggtttcctaatccccgttgaggcaagcccaacttcaccgctcaaaccacgaagccaccaaaccccttcgtcaagtggtgagcaaggtgggagccgg

SEQ ID NO: 47511 - DNA, 1501 bp, Oryza sativa
caaagcagtgacgacgaagaatagtataatgcatgcctgtaagtatgtatgttgctataacacatgttgtttttttaggatataagaattcttagcaacatttttacctttcatgcctttgtaacagaatatttggtcatattgtagccatgcgattcaaaattattcttcaattgttggattcggtgcttgaaacctgctagctgcccggtgcccgttgagctatgggccgcaaagcttgttgctatacctgctagttgctgtaagatacggtttaaaaaaaaagttgctttaagattgagagaacttgagattcatatcagactgacagacacctaaggcacttgtttgattgtttatttctggttcattatttccaaactttagatggaactgactacaatggagtagcagtgacagtgttctatgatttatactcgttgaggctttctcttctttccttctttttcccttttctctttttaaccgttctaggctgcaaattgcgcagcggcatttttcctttgtttttcaataatagaacagcaacatgttttctctgttttgggttcacataatcaaatattcccaaactttacaaaagtgtcaaagcttttgcccttccttaaaaaaaatccaaatattttccacctggggagaaacaatgctcattttccactactgtcgatgtgatttggttctgaatcaagggaatttcataggtttcatatagccatacagatccgtaagaaagaaaatcatcatatggtggccttctatgttcactttttattcagtcactatccttgtgtgctgtaattatttagagatgctgcgttgtcgtgagtactctctttccttcggatttgctagaaaactttcataagttttttatataagttaactaaaccatagttgaatgtaagttttatataagttatatcatggttacaatatagttatagtacagttacaatgcaattacacttcaactatactatagttgcatttgaaagttttttaacaaaaaaaaacttacgttagttttttttaatactcctttttttccctttcatttcattttcccactttgggggagggaggagaaccttcagattttttttcttttctcttcggtaaccaggatactgggccgtaaccttaccagtccaaattgagggcccatttagaaaggcctggatctgataccaatgggcctaaacccaaaggcggtggaggcctcaccgaagcgccgacgtcagcacagagcgtgttcgcctcgacctctcctctcctctcttctacttctcccaatcaaacccgccgccgccgccgccactcctcgatttttctcccgcaactcactgcgccgccgcggagaggcaaacccgaaggagactaggagaggaagagcttcaccgcctccgcctccggcaaggaaagccaaagccaatcgaggccaagagcgagggggaaggaagaagaggggggaagggagaga

SEQ ID NO: 47512 - DNA, 1501 bp, Oryza sativa
tagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttctttttttcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactaaccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagcattggaatttatttaatttaattgatttaaatggattaattacccaattaaatctaacatgtacaaagcacaaaattttctttcttcgcgacagtgtcagcacgggcgagattacaaggacacgtttgacatctgtgacgatgcttattactactgtgactatactcctactactagctgattctactagctcacatgcctggtcattttttttacgcaccgtcggtacgtttttttgttactgtgcacgtaggcacataggtggcgagtgttgtgttgttcactagtactagatggcacgagacaggttccctttgcacagtggaaccggtactagcaaaaaaggacagagaagacggacagaagagagagaggaggtgcacccttccgttcccttcccctgctgctgaaaacgcttccttcccttgtttataagcaactgccgttccacgctgccgcctgtccccgtcgtcacactcccatctagacatgttccacggcaccacctgtgacctgtgtatgtgcacactccgtcagaccagggaaagcagagtggtccagatgttttttttttcttaacaaagcaaatcacgatgaaaaatacaagattatgacgaacacaacgccatcacatgctagcagctccaaatacattcctagagaaaaaaaaactagcaccataccgatcactgctatgtgtgatcgaacgccgctaacctataatggtcataaacgcctcacccaacacaagcgctaaaacagaagatatacagtgggctccaattatcctcacagagaaaatatctactcgtcgctcacgacaacccaataacggtaactgacaaaacgatgaaaaccaaactgagagaagcgcatgacaatggaaaaacaagatcttgaagatgatgcttcaagaaggtcatgacgctcttatttgtgttggtaca

SEQ ID NO: 47513 - DNA, 1501 bp, Oryza sativa
tcggcttgtctcaatacaaatgctcgtttccatttctgatcaattttcacttcaataggcacccagggtggcatggcatatgcaccagagaccagcctccttgggccatgacccatttgagcactcggttccctacacacaagttattttgcatcaaatcatttgatacaattacacttacaaaataattgtacaaatctgccatatcatgttcatgcaaatatggtaggaactaccataaacacttattgttatgcgtgatcctacgaggcaatactaacaacggacttatggacatagtgcaagcacaaacatataagaataaaacaaatgcaaacagccaaacattataatctgtaaaagtgcaaaaacttctggaatgaatgaaaaataaaactaatatcagagcttcaggaaagcaatgcaccatggtaggagacaaggagtcacatcccggcaaaaaggagaagtggtaacgatctaactgcaggagtatttgcgacttcaattttttttaacgcaggattgatataataaaagggtaacaattaataactcctataattatcacctataccttgtaataaaggaaactatgcttcgactgttcagaaaatacagcagatggatcttcacgcattgatcacaaggttgtttgaacagttgttaaattaaaaaataaaacggtccatgaggattctttagtatatcgcatgaacttgttccactcatcacttgggagagaacattcagggatgatattcttgtggagaacttttttttaaccaattgtaactatgtaaaaaaaaattcaatcctacattcttatcgcagttttcatcactgaagccaatgctctagaattcggccatagacgcacgcctattaggcgttaggctgcaggcatccactgcgatcaggcattagatggctaacctgccttgggtgcccttgggcaatatgcttgctaattgcttggaattcactagtcgagttggtcctaggtggtagatgccaacactgtagatgtttagtgtctggcgtgttcatgaaccatgattcaaacaatggagcaacatcacttcttatggtgtcactgcacgatttgtcagatagtatctatttccttgcaaacatatctgttaccacatatttctaatattcaacagcagtctaaagcagcccaccggaaccattaaattgccaaaaaaaaagtcaggggcgggaggccaggaagcaccaaaagccatgcacccaagcagttaggagaatatgaggtaaaaaaataaaaatcaccaccacttttgtaggagggaggatttgaacacgggtgggctagcacaccaaccattaactaacaaatccatactgttgcaaatttcagatcgaataactgcagtatcattaggtgcataaatggtaacatgagtagttcaggttgctcatatatataatcattccaggaatggaagagagcatcaataaagctgctcctatggct

SEQ ID NO: 47514 - DNA, 1501 bp, Oryza sativa
tgacgacggggacaggcggcagcgtggaacggcagttgcttataaacaagggaaggaagcgttttcagcagcaggggaagggaacggaagggtgcacctcctctctctcttctgtccgtcttctctgtccttttttgctagtaccggttccactgtgcaaagggaacctgtctcgtgccatctagtactagtgaacaacacaacactcgccacctatgtgcctacgtgcacagtaacaaaaaaacgtaccgacggtgcgtaaaaaaaatgaccaggcatgtgagctagtagaatcagctagtagtaggagtatagtcacagtagtaataagcatcgtcacagatgtcaaacgtgtccttgtaatctcgcccgtgctgacactgtcgcgaagaaagaaaattttgtgctttgtacatgttagatttaattgggtaattaatccatttaaatcaattaaattaaataaattccaatgctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggttagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgaaaaaaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggactattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaatccaaaaacctgataggtcattttcggtagttggctttgctgctgcactgaaaccacatgcctttgatggttcaaactataagagatggaaagcacgtgcactattgtggttgacagcga

SEQ ID NO: 47515 - DNA, 1501 bp, Oryza sativa
tgattggctcgcgagcctaacgagctagctcgagctttcaaacaagctgagccgagctaggtttctagctcattaggttatcctaacgagctagaccgagccgagccgagccggctcgctatccgcccctaggtgtgatggcatggcatttgacctcaccatccaacgtcggcgcggaatggaattttgacatcacgttattaactgggcctaccaaaactaagcacgcgtgtccaaagaaggctccccaatttccggcgacaacgaaagcgcgtgtggtagggagagcgcggtgcagccgtcttgtggtcttgtggaacgagtggcttcggcctcgttcctccccgagtgctctcgcccctcacgttccttcccgcgcgtgctgtgaatcatatgtccttcgaggttcctcagtctatttggcagcctaggcatggcaaattgagggttgcattgctagtgccctaaagttgatatatggattctttatacaatagatttacatttcaaaattagatgaaaataagttagaggattctctaacgcgcgaaatcagggaccaggagtagtacgccgctgctgctggcctgctactttgctactgttcttctttactagtgttgtagctgtgtgttcatgcgaagcacagaggagtaggagtaacgcgagctaattgaattggattcaatgcaaacagcacggagtgtgatggcctctgccctctgctcagttcttgtgcgtggtccatatggaccaggagtctaggatccctcctctcatccgtgatcatgcccactgcaagtaggaaatgcatttgtaagatcattcgttactcgttagtacacataaacgtgaaaagaagatgtactcctactcatctgatagtgttctcctgtgaaaattttatgcaacatcgggacctgaaaccgaatcacatccttcagatcatgaacgaatttggatcagctataacgttggtttcagtcttacagatgtttctctttttttctttttcttttcgccgggaaatcttttaggtgttaaaaaaagagcacaaaagaagagttatgggatcgaaccaggtacgagctgtacgcctgtataaagctagtacaaaaaaatgtcagtaataatgcagtgcaaaacctctgggctctgtatttattttcactgcagatctcatcacgtctgatttgccacctgtgctcggtacacctgaatgctccctgacactgtacactacaatgatctagacaaggcccatataaatttcgcgatggtctttctgggccgggccgtgatttagttcggccccctacgccatctcgacggagacgggccttttgagtccatgtagacgaacgaccacaatttacagcagcgcgcttggtcaaagtcgccgtccacgacacgttcacactcgcgagtcgcgacgcctatacccgtccatggcggtggcggcaacgggcgaagcagctttcccggcggggatcggccatgg

SEQ ID NO: 47516 - DNA, 1501 bp, Oryza sativa
tgtccttctcaccgtcccattttaccatcttggaatcgttgcatctctcagactctcacagaaaaatggagaagaaatgttggtgctcactcaacatcaacaacttggagacttgtttacattttggaaaatggcatggagtcgctgcgtcctggtacagtatagaggagcccgcttgccagaggaatttggagaagatattttgttcacgcgccggcgaaaggtctatatatatgctgccaaccatgttcttatccttaaccttatgtattatgggaccaaaaaaagctgatatgtgagctctgaagcgaatgttgagcccctcggctgtgaaggtgagatcactaccttgtttttgaagtcctttacttttatactgttgcatatctgtaagattatgtctgtctacttgcgtacaattgttctagttggatgaatcggatccagaattcacttgatagttcattgactaaatttcttgctattacgcatgtaaccagtagagttttacatctaccgttcctatagctatttttcgtggtccttgcagtgatcagctgctagctattttagataatggattagattaaacccggcctctacaagctattatctctgctctcttatatttgtccaactgtggtagacaaagatattggttttagtttctttacgttccaaacgactttgctctttcacactcctggacgtggagaatatatttctaaaattgttaagaaaaaaaattccacgtcataaaaatgttcttccactgtcaatatgaaatgggcatgccaagcatggcatcaaagaaacgtatctactgttgtacattgccttgaatctgttggttacggagtatttttgtagtacccacaagcagggtttgaaattttggtaatttcgtcccccaccggcaagctcacatctcgcccgaaattttcgttttttttcattttttttgtgaatttggtcaaaattttattcaaaatcaatcaaaatttcaaataatttcggcaaaagaattcgaaattttcaaaatttcgcaccccccaacgcaaaaatactaattttgaaattgaaaaccctgcccacaggtacactatggcagaggtgagtatatcgagctttgcaatcaccgttcttgaaaaagctgcgtcttttggcactgactgggctgttagtgagataaagtcagcttggaacgtcaagaaagaactagagaagttggaaacatcactgagatccatatgtgctgttcttagagatgccgaatgcaagcagtctacttcccactcccttcaagagtggttggacaatttgaaggatgcagtctatgacatagacgatgttctggacgatgtttctaccgaagccctagagcaagaagttcggaatagtttcatccatagaacaaggaacatgcttacttatccattcaaattgagtcaaaaaataaaagaagttcgcaaaaaacttgatgagatagcagccaatagag

SEQ ID NO: 47517 - DNA, 605 bp, Oryza sativa
attaaattagggtttctcttttgctgttacacagataaattctcgaggtcatttataaatatgatttaggcttgggagaagaacttcagggtgtgacaaagtgcacgcctaccagtaggagtctgcgaaagagagtaattttccaggcggccagctgaaccacatgtgaaaatgtggctccttatgccaactgcatggaaaaaaatggcaaaactaaaataagaatttcaaaaaaaccaaaatccagaaagcctacccaatccaaccatgccgccgctgtactcttgccgtcgtcgtcaccatgaatattgccatagactcaagcaagctcctctgcctccctcgtcggagtggagggactagtctttgctgcccaataacgtgttgttggccgtcatcgtcgcagtcaaaattgccaccacctttcccggtgtccccaatgggactgggccggatctgtcgctcctgtgggcgctggcagtggattcccgttaactaattaggtctcaatcttctgataggtattgataactcttaatttggcggaaacttgacacacacgatttggcttccaatcaatacgatctgaaccatgcaattttagc

SEQ ID NO: 47518 - DNA, 1501 bp, Oryza sativa
atcttcagttttaagatgaaccacccaaattatcttattactagaaaaaggatgaaacaagggcttaccgtgacacgacgattattgttgctgctgtcgactagagagatgagagggatgaggcgtatgtacatgtcaatctcgtgctgcgcggcgcggagctcgtcggccatccgagcgccgaggagcaggcggtggaggtagccgcagtcatcctggcacgccctgacgagtgcgtagcaccgccgcagcgcgccttggagccgctcgaggggccgcctggtggcctcccgccgcatcagctcggcgagctctagctcccgcagcaggccgccgacgaggtccacgtgctgccccagccgccggcacgcgtcccggtggcggcgcgccgccagcgccgcctgcaccaccatggagaccagccccagcgcgtccacgccgaccagctgcgccacgctcgacgcctgcccgagcgcgccccacaggccgctcgccatggccgatccccgccgggaaagctgcttcgcccgttgccgccaccgccatggacgggtataggcgtcgcgactcgcgagtgtgaacgtgtcgtggacggcgactttgaccaagcgcgctgctgtaaattgtggtcgttcgtctacatggactcaaaaggcccgtctccgtcgagatggcgtagggggccgaactaaatcacggcccggcccagaaagaccatcgcgaaatttatatgggccttgtctagatcattgtagtgtacagtgtcagggagcattcaggtgtaccgagcacaggtggcaaatcagacgtgatgagatctgcagtgaaaataaatacagagcccagaggttttgcactgcattattactgacatttttttgtactagctttatacaggcgtacagctcgtacctggttcgatcccataactcttcttttgtgctctttttttaacacctaaaagatttcccggcgaaaagaaaaagaaaaaaagagaaacatctgtaagactgaaaccaacgttatagctgatccaaattcgttcatgatctgaaggatgtgattcggtttcaggtcccgatgttgcataaaattttcacaggagaacactatcagatgagtaggagtacatcttcttttcacgtttatgtgtactaacgagtaacgaatgatcttacaaatgcatttcctacttgcagtgggcatgatcacggatgagaggagggatcctagactcctggtccatatggaccacgcacaagaactgagcagagggcagaggccatcacactccgtgctgtttgcattgaatccaattcaattagctcgcgttactcctactcctctgtgcttcgcatgaacacacagctacaacactagtaaagaagaacagtagcaaagtagcaggccagcagcagcggcgtactactcctggtccctgatttcgcgcgttagagaatcctctaacttattttcatctaattttgaaatgtaaatctat

SEQ ID NO: 47519 - DNA, 1501 bp, Oryza sativa
gctttcactccctcccctgtggctgttgggcctctgctccctctcccgctgagcagcgggccccacatggcacgcgcgcagcgagcgcacacccaacaagatttgactaattgctcgcccttttttagctagagtggggtggttttgcctttgctgcctcccctcctcgccaatgtcgcgccggaatgattgttgcagcgcagcaacacaggctagcaagcagctctagtcatggcggccatcatcaccaactcctctctactctagtctctggcctctttcctctggatcctggcattttgcattgtcgtttgccgtgttagtttagtgagcagattgtactttgggggtggttaaagaatccgggggtatttgtggtgtggtggatgctgtggtgcgtccgcgcggaggacgcattggccgccgctgcagccgtggccgtggcgtccgacaagatgcgctccgtgaccctgtcagtctcctgctgcttaatttacctgcttctcatggatgtttgctgttggcccgtctcctcaaggtttggttctttcctcgctgtgcgcgcgtgtgtgtgtgtgtgcaggggcggttcgatccagagggtgatgcggaggattggcggcggcggtggtggccggagatcggccgggtcgaggggcgcgccgcagcgggcggaatgcctgggggcggggagcggcgacgcgtcggcgagctgctccggggttggtttttgtctttgatcaaattaaaacccacttctttcttgttgccaagcatttgtgcaatggaagtgcaatttcttggttcctcctgcgaagattgtttgttctgaaaacccgaaaatgtggtgtttttgggtgcatcctgggcactgggcagcttcagacaagctagctgtgttcgcgtgccaaatttgaggggcccagatgagatgaagtgtcactttcccctctctgttcttcgcatttctagtgtaatagatgcagaggttttgactgcttgtttgctgcattctgaactaaatttcttttggatggattctgtcccggcaggtgtcctagactggggattttgtttgtttcctgtttttttggacagtttcaggtgatatgtgaacctgattgctctcttatctttcctctgtaggatgatagtagcaatggcactggcaagagggatggaagcagaagggtaaggatgcggcggtacagatcggagctcgagcaagaagtgagtgcttttcttggtgtaattctgctcgtgtttgagttctgacgacttttgttcctgttgttcaatgaaagttggtactgatggggttagctagtataggctgtggcattatccaatgcttcattgaaaatttattcatagagtggtcctcaaatgaagtctaatatttgctacctaatgtttgctaaaaatttagttactctgacggaactatatttgcatttcaactgagtaaggactaagagctaatattttcagatgttataca

SEQ ID NO: 47520 - DNA, 785 bp, Oryza sativa
taagattacggagctatcgttggtgttcatttctttaagtgagtacacagctaacatattcattgatctatatgctctttttttaggtgtgtatgcatatgtgtctttcatgtagtgtagaaaaaaaaactctcatactgtattatctcgatttaagaattctagagaattttcatatgaattgaactaccttgaaagaaaatcatgcaaattcatttcaaagatggttaaaacgtgacgagcaaacccgtcaacctattcaacatttcaacccgtactgcattcatactcccgtggtactctctccgtctcaaaataagtgcaaccatgattttccgcgtcaaactttaaccgttcgtcttatttgaatttttttttaaaaaattaaaaacataagtcacgagtaaagtactatttatgttttatcatcttatagcaataaaaatgctaattataaaaaaaaataagacgaacgactaaaattgtgcgcggaaacttatgactgtgcttattttgggacggagatagtagtagtagaacatactcctacaaatccaaacatggttttgacttttgaccttgcctaatcattcaccctgcacagtccgcatgttttttctcctcgccacaagataatccaaaaaaaccgctcaaatacaaatttaaaaagcaccagtatgctgacccaaataaataaataataaatatttttattatatacaaaaacagccgaaatgaagcgagagagagatagatagggaggctgcagcagcaacagcatcagc

SEQ ID NO: 47521 - DNA, 189 bp, Oryza sativa
ccagctcttccaatccaatctaacctcgggcacacgaaccacatgcatacgagatcaggagatcgccagcccccaccaaaattacacctcatcatcagcacactcccgagactaaacccccgagctccgtaacatccacaccgaacgaacaaactcccccaaaatcaactactcccgctacacccgaga

SEQ ID NO: 47522 - DNA, 418 bp, Oryza sativa
aaagtgcgtgtgagaaaaaaaaaactgctacttatcgtccataccctgtccaaacagtacaatttcacaaaataatcccttggcttcttttcaattgcatatttaacgtcttcagaaaattacatgataaattagaatgtttgcatgtagcaaataaagcatatacagtgagagtaattcatcttcttttctgtatttttagcgatgataaaaaatgagcccaatatatctaatatatttaaaggtttaaatgtaaaaataataataaaatcaatcgcacagattctttaaaattgatttacctataaaatttcatatagtaataaattagcaggaacacgagtgaaactagggatgaaaacgaagcggattcggacggatagtggttataccatatcctaaaccatattttttaagc

SEQ ID NO: 47523 - DNA, 274 bp, Oryza sativa
tatataaaagctgctatggaatagagagcattctcatgagccttgaaatttgtggggattgttagatttaattgggtaattaatccatttaaatcaattaaattaaataaattccaatgctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggt

SEQ ID NO: 47524 - DNA, 170 bp, Oryza sativa
atatatatatacgtgtatatatatatatatatatatatatgatcatgcatgatcgatactgctggggccgcccgatacatctgaagtattggatgtagagggcggattaattatatcatcttaaagagaaagtaattaattaatggttatgatgtatatgcaggacgtga

SEQ ID NO: 47525 - DNA, 1033 bp, Oryza sativa
gcgaacgaacgaggacgaacgttaacgtgaaatgcaatatatatatatatgttacttcgtatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaatttgacttagtatgtataattattgactacggaattggtgcgacaagtagcaattgactattgtagtcttaattagacttagcatatacgcacgaaacacttagcatagatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 47526 - DNA, 166 bp, Oryza sativa
tgaaacggctgaaagacacataaaaaatgtgtaatttgttgatggacactatgagcaataaaataatatatacacctagctgaggagagagaagctatgtgaaatgtcaattttgcccttttctttttttcactgtctttttatttattcctgctgctcgtttagt

SEQ ID NO: 47527 - DNA, 980 bp, Oryza sativa
tttcacaccctacggaaagcaaatatctcgcacgaaatttttgagtcaaaaattgataaaatttcaaacattcttttgcaaaaaagtatgaaaatcatgaaatttttggtatctcagaaattcagataaaaaatgaaaatgggcaaccccatatatgtgtcatgtttacaggaggcagtgcaaaccttgttctattgtttaaaagatatgacaaataaggacggagccttgggttggtctttgttcttgatcgtgtgccttcttcggtcctatagtcttctcagagattatattttctatagtactagtggaaataggtttagcatatcttcggtcctatagtcttataagagattctggtatatctttaatactttattcttattgtaagactatatagttgaattaatagaattatcttctaaagtgttcataatttatatattgctttagtagttatataccttattaataagatatacttcatttatatatttcacttgattagattagtcgatctatgctacggcaacgatcccatgaccttgatgagttgctctaactctaacttgtccatccgaatggtggaagtcctgaggagttagtatcactatttactagcataagcatagtgcttaggttagataaataccgtttgatgtgggtatgtccgacagaaagtgaggtaggcagcaggtggtgatagccttgtccgtcccttgtattcatccacgtccgggtatgatataagagtgcgtaaatgctaggcaaaatttgctacaggacattcaaaaaatatgtaattagctaagagacaccataaaatcgtgaaacggctgaaagacactccaaaaatcatgtaatttgccattggacactttcactattattttattattttcggaacaaatggagggacaaacaattaaaaaggaccaaattgcccttgaggccaaacttaggttcaagggtggtggcga

SEQ ID NO: 47528 - DNA, 1501 bp, Oryza sativa
ggtcgttgctcttattcaccaaaatcgcaccagtacaatatttggggtagcctatataactgttgtcgacttggcggtctgaagtgctgactcgtagtcgacaacagagtagccttcctcctcgaatctgcatccggcgagatcaaagacatcgttatgtctctcctgatagtatccgtagacaccgtaggggactagctatgcttatctctgaagtcgatatccggcgtcttgtcttggcgcatgttggcttgtatgttgatcttgtgtcttgatctattgttctgtgtcccctctcctcctaggggaccttgtatttatacccataggtgtccctttgtctaagtagaactagggaaaccaatatagatacaatccgagtagtccttgtcgttttcatgtagaactctattcatccttccttatacggaactcctcctatatccgaaggttttttccgtataagacatggtatgtggtgggtcctgccgagatttagtcaactactattaggtatgtggtatcaataaccctgacagtattcctacttgaactcttcttttcttttctttcttctaatttcggtgttttttatttttttattcggaaatttaattaatcttgtattggattcctgtatggacttttttaattctgaatttaagatatttttaaattgtattccttctcgaactcttgtttttttttctttttctaatttcaaaatttattttatttttattccgagttttaattaatcatgtattgggttgctatatggactcctctttcaataatgcatatttttaattccgaatgttagctatttttatatttgtatttctatttggattcttcttttctttttctatgattaatgtgggaatttttagcctccacagcgaacgtggtgcctcctttcaaggctgttttaataatataatagatctcagtccactgccattagctgtcggatcaacctcgcgcatgtaaggggggctaacgagccgattcggcttagctcggctcgtgaaaactagtctatctatctattatatactagaaatccattaaacttcctacaaataatcctaaaccgccatatgacactcctacaaacgctcctaacttaccacatggtactttaataaatactagaaatctattaacttaataaattaatagaaaaagaagcctccacgtttagtactctcattgtctagaaaatcctacattaatagtagaaaattgaggaaaatataaaaatcgaactatagtctatctaccctataattcaccaactcactcttacacctacattactcattcatcaaatctaacggtccaaatcatccaacgcttctagatccaacggtaccggcgcacgcggggtcacactgtgggagagagattgcgcgcacgcggggtgaccggccgaaaatcacgcatgcgagcaaatcaatcgctgcctcttcccacaccttccctctgcacattgcca

SEQ ID NO: 47529 - DNA, 160 bp, Oryza sativa
attattaatttttagaagtcccgtcaaacgatgcaactatactcctctacggcccgtcaaatttcggattttttaattaatctactattgggttcttatatttactcttatcaatattgcttatatttaattccaaatttaagttaattttaaattgtat

SEQ ID NO: 47530 - DNA, 1501 bp, Oryza sativa
cggccctagcggcgacggtatgtggccggagatgagcggcagcggcaaagctcggcgaacgcggcgcggcggtggtaggaggcacgggaaagggtggcgagagtgggaaacgagagagggggctcgggggagcgatttataggtgtgagagggagcggacgaggccgggaaaccaccctactgcgccggcgacgtgggaagatgggaagggagagagagaggggattcaaatttgaatcccagtcggtgtggggcgcgcgcgcgtgcgggggaggtggaggagtgggcggcgacgtgggcacgagcgcgggagaggcgcgggatgggcgtggaggagcggcgtgggcggcagcggcggttgctgccgaggcacgggcggcgagaggttagggacgacccgactggtgggccccacctgtcggcgccccaagggaggagaggaggcggcttgggccggcccagcaagagggaggggcgcaggagagagatgggccaacggcccatcaagagaaaaaggaggaagaaaaaaaagaaaaaggatttttcctgggatttatattgcaccttggtgattttaaattggttaaaattatttccaaggctctgaaaattccactaaaaatcttgttaatgcattagggcatggggaactcaagaaaaattccaccacgccatttctgattattaattgcatttattaattagggattagctctaggttcattaaacaatttcttcgggcaatttattaaacaatttttaaagcaaggaaaaggggaaacttcagggcgtgacataggataaggcgccgtggtgggccgagggggaagatgaggatggcgatgaatcagagggggaggcggtggcggagtgcggcagcgcgagcgtcaggttaggggcggcaccgatctgggcgacggacgggacgggggcgcgggcgcgctccatggcaatgtgcagagggaaggtgtgggaagaggcagcgattgatttgctcgcatgcgtgattttcggccggtcaccccgcgtgcgcgcaatctctctcccacagtgtgaccccgcgtgcgccggtaccgttggatctagaagcgttggatgatttggaccgttagatttgatgaatgagtaatgtaggtgtaagagtgagttggtgaattatagggtagatagactatagttcgatttttatattttcctcaattttctactattaatgtaggattttctagacaatgagagtactaaacgtggaggcttctttttctattaatttattaagttaatagatttctagtatttattaaagtaccatgtggtaagttaggagcgtttgtaggagtgtcatatggcggtttaggattatttgtaggaagtttaatggatttctagtatataatagatagatagactagttttcacgagccgagctaagccgaatcggctcgttagccccccttacatgcgcgaggttgatccgacagctaatggcagtggactgaga

SEQ ID NO: 47531 - DNA, 896 bp, Oryza sativa
aaaaattaagaataaactctaaaaactataaggtccaatttttaaaggtttggaacttctaaaaaatataaaaaaaccaacgataattatgtttgatttttaaaatagcaatggcaataaagagaagatgcagtggacggttgtagaggagtataatggcagcatttaatgggacttctaaaaattatacaaaagaaccctaataggacgataaactctaaaaactataagtttttaagatctaatttttaaaggttctaagaagaatgaatagaaacggtggtagatcaagcaagctaataaagaataatatgacagaagtaagtggtagcaacttatgtgacttttaagaactataaaattacaaacacgaggatgataagatttggtctttcaaaatctcaagatatcgagataaatttttaataaatcttaagtaaaatcatattaaaaaatatataattttatatgggtgctagccgcgcaattgcgcgggcagtttaaaaaactctgtcacgtataaccagccccagacgcaaccacggtggttgcatccaagcgaaggatttcataattaagtcattaatggccaatttggctctaatgggacttgttaattaattttctcctgattcttgccagctaaacccaccatcctacaccttacccatgagagggatgggatggcatctcaatctatgggcgccgggcggttgatgaggcagacaaaactgatcaattttcttttgttgcattgtgaatgagcccaagctagtagaaaaggagtcatccggacctcgtctgaagtccgggctcctgcaggcagcattatacccatcaatacacaaacccaatcaaccccagcaactttccgggccatcggacgagctggtcca

SEQ ID NO: 47532 - DNA, 449 bp, Oryza sativa
tgtgtactagttgaactaagcatggctaagcattttcctaaaccaacatctagtcattttgatacccaagttatcaatggcataaggtaaacaataaatggctgagtaataggacccatcccacatgacattgtaaaaggatgcaacatttaatagaaatgcgggatatttgtaaattgggtacaatatgatcaattgtaatgcatgacttgccttgctctcgcactgatgagacctcagcaacgtcttcgagaaaccgcggatcgacgaaacggccagtctacgcgacaaacaaagcacacaagcaaaacatgctataagactactgaaacaggaaacaaaaccatttttaatggattctagggatttttataaatttactgagacttgaatggatttaaacagagctcggatgaattagttatgattttcagaagataaactgtgtt

SEQ ID NO: 47533 - DNA, 539 bp, Oryza sativa
cctcgacgggttggtggcggcgcagacgagggagaagtcgatctcagtggagttgaaccgggggatgcggtggcagcggtgcgacggtgagggcgaggtgatggtgacctggtccggcggccattgcagacttcaagcgcgaccgtgagggcgaggcgacgacgatttggcgagagatggaacgcgatgcgaggggacggggttgcggccttgcggggggtttggcgcagatcgcatcgtgggtggacaggaagctcgtggctcgttagttcgctccgcttgtgactggctcggctcggctcgtttgaatttcctaacgagccgagctggcattttagctcgttagatataacgagccagctagctggctcgcgagctgctcgcaagtcttaacgagccaggactccatcagacaacccaaaagcccaatacaataaaaaggcctaagccacaagtagatactgtgcaactgcaaaccctagtcctctcgagactcactcctcaattccccacctggccacccgagacacgatgctgct

SEQ ID NO: 47534 - DNA, 357 bp, Oryza sativa
agagtgaatggtccaacagttatgttatattgtccatttgcaagttaaatgtttttttaaaaaaaagagatatagcgggttgattctgaagtattatcgtactattcaagagtagagaaagtagtaatcgtatccaaaatacatacaaagaaccatcatacataattttagcattcagagaaatagagatgcacgcgcaacgcgcgggctatcttcctagttgtcctaatttctcttcgttgctgcggccatcctcggagtgctctgtctctcatatacaagacataaaccccacatggtttcccaacttgtgtgatcttgacattcggagttgccccaagttgtccctgcccccca

SEQ ID NO: 47535 - DNA, 347 bp, Oryza sativa
attaagagcggcgggctgggcggccgctcgcgtgccacgtcggataggtacagtgcgcgggtagaagttttgcgaaaaaatccttctattttttgtaattatatatatgtccttataaacagtacttgaaggggaaaaatcgcggaaagggactgctctgtaaaataaggaaagaatagggtttttttttcaaaaatgacgcccactaatctaaccccccagaccttatccgccgccgcccgcaccctctccctctgcccgctccctctccctctccgcggccgccgcctcggccacctggatttttcacattttgatccttttaaaaaacttatttcgcaaataga

SEQ ID NO: 47536 - DNA, 198 bp, Oryza sativa
ttacaggcaagatgttgtgtgaagaagggcgagcatgtagattgctaagctgacacgtggtggacaagaatgaccgtcgtgactggtctgataccggtcatgttgtcagcagccagccccgattccacgtcgcacctgctcccggcgaaagtggaggtagttgtgggccgtctcatcagaaggtgactcggacggcaa

SEQ ID NO: 47537 - DNA, 771 bp, Oryza sativa
ttgtccaaaaattttaaattgtactataccttttatgatttcctatacttttgggatttcggtatttattcgttttcaccatgtattggtttaacataattattatataacttgtaggcttggacatttattaattagaatatactaatatcaccttattaatacaatggcacattggtcgagttaatttggataacaatgtatttacacatggataggtttaatctatttatttcacaaaagtaaattgagacttggtaccatattgatttaaatgtttaattagacattcacattaacatattatatatataaagctcaatttatttgcattaccatttactttatgtgagtgaattctattccatgagagactcaatgaacattataaatattaatgtaaatattctagtggaacgctccttttatatatagaatcatcgtagtggcgattatttcatgtgtagcatttaatatttgacttataaattgatttagtaattaaccttctctttgtattgctttgttgtgttgtgcataaatatttgtagggttcataataaatatcataactttataatttttacgtagttatatagctttagcttaattttcatttgtgatattttatagtttggcaagcaataacaaccataacatccaccatgatgcacaacaaaagaaccaataacatcggcatgatgcaatttatttaaaagtttttgaaagtactttaatttcaggtttcgttttatttgtcgaattttcagg

SEQ ID NO: 47538 - DNA, 163 bp, Oryza sativa
ccagtaattagctgcttggacacccgtcggattattttattatatctgatggaatttgagagagaaacacccatgtaagtacggttttacctttcattttttttctttattctttattcttccttatcttctctctctttctctcctctttcttcaaccgaga

SEQ ID NO: 47539 - DNA, 1248 bp, Oryza sativa
  unsure (1)..(1248): unsure at all n locations
aggtttgatgcagtcagtaatcagacatgtggatttgtctcaggagtgaagtttgaactgtaggattggaatgtggaatgtggcaaccaagtgcatgtccagttcgttttttatgggcctgttcactataagctaattttcaaccttaccgaagttcggaaagctaccataaaagtggctacatttagtatgctaccaaaattttggcaactttagtaaaattttggcattgccaaaatttggtaaggtttttttnggcatcaaagtgaacaggccctatattttgcctacatgcttgttcagtgtttactggaattacccaatgacgattgttaattccttcttgacaatctggcaaacatcactcttgtgctgtgttctagtacgtaaataagtgaaaggtgaaactgttgcatttttcagctattttctgattctgatcagcatagccacgttattttgtcattcaaaatagtgataactcacaccctcaagtagccttttttacttatttacccttgtgttctttttttacttatttacccttgtgttctgttggaagtgtctatagttctcagtattccttcacttgttttgaatttcttttctgttcaaattaaacatttaaactagcctacctctagacttaccccagtagaatttctgagtcccatcgaaatcttcctttatcttctctccaactcatctattcttttcctataaaccatcgaagacaacccgatctaaactacaatcccaaggaacactataatcatcgtgcatgctcgctcattcatgaatcttgcgtttaaaataggcgcgaaactttaaccaagtctagtagtttcgaccaatgttttaagagcaagtttaatagtatagctaattactagctccaaatcatctatagccaatataatagctaattcatacaatagttgtttactataatattaatacatggttacacctgtcatacacacattatatctttactataatattaatacatggttacatctgtcatacacacattatatcttagagttcgtgctgcagctggctacagatatgtaacccgctacttttctctctcttcttttatctttttaaaatatgtttatagttgacttatctgctattgtacctgtttaaaaaagaatcctttagtttagtctccttgttccactatcaacttataaagaataaaagctaagcacggtagttaaaagttcgacgtgaaggcat

SEQ ID NO: 47540 - DNA, 532 bp, Oryza sativa
attcctgcagccctgcaaatggacactattttgtgtgatttgtttaagcaatacactagttatctattgctgccatcaggcgcactatcagcccagccaaaccagtggttcacgaatcatgaatatgtaaactttttgtggttaactgactaagctcgcactcccaatgcgctagccaatcacgctcgcttttagtacatcagatgtagacgttaaaccacactgaatttctgccctctcaatagagattaaccagtatactagtaattattagcgactcaaatctacatccacaaataagagaaaaccctgcattttggcaatattttttgttatgtgaacaaaacaaacgaatccaatccaaaagcttgccttgtcaaaaatctgaaggctgcctctaatcgattatataacaatctagaaatgcgatattttgagcatttttacagggatatagttgaaatgaaagagagaacacccccacaaggccacaaacaaaatccccaactactacgccctcttcttggccaga

SEQ ID NO: 47541 - DNA, 309 bp, Oryza sativa
aattgaaacaatttgactttgaccaaagtcaaaaatatcttataacgtaaaatgatggagtatttctttttcttttatataaaatccaccgtttagcggttaagaaaacgtgataatagaaaaatgagaaggttgtagtatggagcgaaagtttagaactaaatcaattgggtcgcatgaacgattaattggaactgtcaactagcgtttgtattacgtccgtccgtgcatctacctaatacgagtatagtgcaatcccacttccactatacgcggaccatttcaattcgattgactttgtctcttagg

SEQ ID NO: 47542 - DNA, 551 bp, Oryza sativa
cgctccatattgcgattgagaatacttgcctgcataagtatcttgaggacaatctttcgcccagccagaatcatttggattatatctacaagcttatccacctgctatgtttacctgaaatggtttgtttcacttccctccctatgcaagtactacttttgcagcatgacataaatagtaactgtggtcataccatagatcccagacagctgttattacgaattagtgatattaaggactgaacatccttttgtctccacttgttagaggaagtaaagtttcccttttttaatcttgtcttcatgtgttagtgcatgttcatatggttaaaggcaaggagtcttcaataaaatatacaaaacatgttgctactaagcaattttattttctttgccttggagattgtccgtaatccttaactactttgataggaggaaatgaagccatatacagaataggaggaaatgaagccatatatagaaagttaatcaacactacttgcttgcgcgtacaaatgctaaatgtcactttgtttttgttccttgttttac

SEQ ID NO: 47543 - DNA, 336 bp, Oryza sativa
tctccatttgcaatcaacttagtgtgattttttttaaaacccgtacagctaaaaaaatgaagaaaaatagcacactgtatatttcttttcttcactagactactggagtacaacaatcggagtatccgatccacagtaattcaccccccgaaatggtagtgttttaggtgcaattttcttcgttggtgcaggttgcacaatggtattaactttagccaattgcggttgttatgcttgtggcctgatacttgacgaattggttaagttaaaaatatgttacttcttttattgtattgggcaccaggattattacatcttcatttttacttgtctgca

SEQ ID NO: 47544 - DNA, 177 bp, Oryza sativa
ctgaaatcagctaaagaagtggttcatcatgtgttattactagaagaagaatgtaggatggaggtgatactgcttctgtggaactggtggtttgcccgaaacaaaatcaacgccggggaacgtgggctactgccagagaaagttgtgcacagagtgaaaacgcgatggtttaggaaa

SEQ ID NO: 47545 - DNA, 1019 bp, Oryza sativa
taaactcaatgtgatgctgcataccaagcaaatcgcaagacgggtggttgggggtttgtgctgcgggatgaagaagggcatgcattactggcaggagctggacggctggaattcgttcatgatgttgtttcggcgaaagcaagggcatgcttatctgccctcctggccatctcggtgcaaggtgtgactgaggtggagatcgagtctgactcagctattctggtctcagcagtaacgtcatcctcccatagccaagctgttggggctacaattttcgctgaaatcaagatgctgctgcaacttcattttgctaattcgaaggtttcctttgcccctcgatcctgtaataatgttgctcataatctagccaagattggtgtgagttgggacccggatcagtctgtggtctgggttgaccccctcccgtattttgtacgtactctggtgattcgtgatcgtactgaatctccccagtaataagaatgtgcggatgaacctcaaaaaaaaaaatcgtaagttgtaaaatataccattacttcatctgtttcacaatgtaagattttctagcatagtccacattcatatatatgtctagattcattaacatctatatgaatgtgggcaatgctagaaagtcttacattatgaaacggatggtactattcagctatttttaaacatgtcattacaattttacatgtatttgagatatgccactatttaacctattgatgcagttgtaaaatttttagtaccaaattgcccctttattttaccttggtccatattcatcttctttccccttccccttccgtatctggatttgacggatttcaatgggaaaagaggcagggagatgagagaaaaagcagtggtcttgttgactgtcttttctcctttagatggcagcattatgggctagatgggccaaaatgtgcgctgcgggtgcatacgcgcgagaaaggaggcctgagctcagttcgcaacttttatagcaacatgggcacctagcgcacaca

SEQ ID NO: 47546 - DNA, 1501 bp, Oryza sativa
tttataaggatttttaggggagtttggataaattcctatgaaaatcctataaaatctctggtttgagccctttaacccgcctcagttaactggcggtgttgtggctgtcttcccttaagcccccaaccaccaaaaccactaaggcattgtttagttcccaacttttttctttaaacttctaacttttccgtcacatcaagttttcttatacacacaaacttccaacttttctatcacatcgttccaatttctttaaacttctaattttgacgtggaactaaacacagcctaagtttcaacttctagccgttcctttttgctctgttggcttttgggtcgttggcagtctgaccaaatggatgatgccaagttcaccaaccgtttttatcagttaatcaatctccttaccgtcaaaatactgttgtctttgtgtaccatgctggatagtcggtcggggatccagacagggctggctgtgaacttcatgcaaaaaaaaaagtccaaggatagctgcaagcctgcaactagtgccatcgcccacccatcttcaagaactgtcaccaacttgcaccgatttattcggtgaatgcctttgtatttgttcagctcttaagagttgcggcgacctcactgaacagaagtcgatcgtaatcggttctcacatcatctaaataaacacgagaagaaatagtctttattaatactagtacttcctttgttttatattgtaagccactttagtttttcttctaatcaaacttgatcaagtttatagaaaaatatagtaatattttcaacacaaacatattactagtatatttaatgaaactaatttggtattgtaaatgatactcccttcatactcgtaaaggaaatcgtttaggatagtgacacggtctctaaaatacaactttgatttcttatttctataaaaatatattgaaaagtgatatatgtatatttttatgaaagtatttttcaagaaaaatctatacatataatttttatattttcaaacttaacaacttgagagttatttatgatttatattcctaaggtttgatttaaacattgtcctaaacgacttcctttatgagtattgagggagtactagttttttctataaatttttaaaaaaattaattatttttctataaatttttaaaaaaattaattatgaaaaaaaatcaaaatgatttataatatgaaagggagggagcagtaattagtttttgagcgggtcatactatggggaaaataattataaaagttgttcaccgatcaccaaatggggaaataaaaagttgagaaagcggcgttgccactcgccgcaagtctctaccctcaccaaccacgctcccactatctctctctcccccgcgttgaacttcttgaagtgaactagacttctttttaagtttccagctcgatttgttgcaggtggccaactcatttccgtctcccgatccggccaccaaccgctccccatccgccatggatc

SEQ ID NO: 47547 - DNA, 209 bp, Oryza sativa
caagcagattttgctggatggaatctctgggcagcaatcaatgaccgacctcttctgccattcaggtttaaatctagctgaactgtctatgttgacgtattcaggattactaaggattttcatttcttttttaatgctaatgttctgtcatgtctgtaggaatagttgaacttcatagaagagctaaatatcctgtgtaacttttcagg

SEQ ID NO: 47548 - DNA, 214 bp, Oryza sativa
acgacggggagtttctcggtggacacggcggccccgggcgggaggtacacgcgcgccctggcggcgccggcgtgaatgtcgcgggagacgacgcgggtgacggggtcggtgccggcggggacggtggggtccccgccgaggcggaagacgcgcccgctcttgtactggcagaggtagggctggaagtcgaaggcgacctcggagtcgggatcca

SEQ ID NO: 47549 - DNA, 806 bp, Oryza sativa
tccctcctcccgccacatggcagctaggcgagggcctcagggcgaggcagcgggagagcccgaggggcacgacgtggcaccctgaggcccccccggccgcttctgtgactcgcgaggcgcgggagtagggccaggctgtagagccacgcggctggatggaaaggtaactttcccccacttcacatacccccgggcccatatctccgtcagtagccctcggcaccatatcggacactgacctcctgaggtcggttctgacgtggtgcctcacgacttcccaagctggggttgtgggtccggtagggaatctaaggaaatgtcgccgaatggccaggttggcgtattaaccacggcagcggtttgccaccactgaccgtgctgatgatggtgatgtttaaggcgcgaaaatcagggggtcggttaggccacgcctcgattcccttgcccgctactcatgcggcggtagtggcgacggttcgctcaggttgtgcccgtgaccgttgtgcgccctacttcgagtgtgccgctgataggcgcactaaatgcagggcgcagattcaatgggcgacgtgatgagtggacacgggaaacgaagagacaaccgcgggcgcgagaatcgtgggggcaaccgtgagggcgtgaaacgaggaggtgagcgtgggtgaggcgaggataaaaggatatggaggcgaggactttgcctccttcctttcgccaactgcccactcgtcttcttgctccttaagccctaacattctcgccacttcacactattctgcgcgccaagccctccgccgcttctccgc

SEQ ID NO: 47550 - DNA, 466 bp, Oryza sativa
ttaaaaacaaacactaaaaaaaattatgttgaaaatatcagtgacagtcacatatctgggcgaactcctcctgcggctttctttctctgggcctaattctctaggctgcgtacgtgagttaggacactcgtgggctccgttacggcccaacttaaccacgtgaaaactcctcccacaaaacagaaaaaaaaaagagtaagaacaggaatgtgaatgcgacgactgcctgctgtcaactgaccacctggcagtgcaacgggtggcgcacagccgagcatgctccaagcggctattaattccgtgtttaaatcttttaatccgcgtgtttaaagctttaaattcgacagctggtgagttgttaataaagccttctgccatagcgatagaactctccaggctccatctcagtagctgacgtcaccaccccagcgtccacacgcgcaccgcatggcttctaccgacgccg

SEQ ID NO: 47551 - DNA, 1331 bp, Oryza sativa
gaagcccattaaggcccatcgcaaaaaccagaagcccattaaagcatcagctaatcttcccggagaggcagagacggctccacggcctccgctcgctgtcttcccggagacgcctcctcctcctcgcttctcttcccctctatcgtcgggagctgcgaccggaggcgcgccacgtgtccctctcccctccccgccgatgagctgccgcgcggcgccgtgggggcgcccgtcgctccccggcggccggccctcccccggctcggcgcggcaacgcggtccattcggtgagattcacgagcttagctcgtcgcgcctactacttctctgtactttacgctgctgtggactgcggggatgtgttgtgatgctgggttagggtttacgtcggatgcttcaaatcttacagtagatggagcagttcccgcgcgcggatgtaccatttttagaacagaagttcaaaacattgggttttgatgtttctgaactactcacaagtgatttcccaaatatgaactcaaattgatttttgagccccagagtagttacataagttgcgggagcattcgtaggacagcaccatttgttggtcaaatgtatcgcagtttccagtgatttcatattccaatttgaaagggggtgattaggttaatgtatccgtcaatctaatgggttagcactttgttcctgacaggaggtttgaatgtatggaggaattcaatcctcaacaattcatggaggcttggtggtacgccaatgaagtttggactaccatctagattgttcagactcatggcttcaagtagctcaggagatggtggtttttcacggccttcatcaactgatgaagggccaatgccaatatactcttggccggataagcaggtgattctttactgtagatatccgtagttgagaaccccctgttatttggtggttttccttttcattttctttgcgagttggttttgttttatatgtttagttgttcgccaaattctctatttcatgatgaagcataattcagtatatggaaatcccaaggggacatacttcggtacacttgattcagagcttatgacatgcattaaaatacagtgtgtagatactcacggaatatagttcaatttattataactataaatcaattggcctatactgatggtgtcttaagtgcatgttttttgactcatgagttaatttttttcatatttttgttttgtctatgcatgccaggctgtgaggataaatgtttgaggaaaagttagatttacagcgtgcttatgctataaccactatatttgtataattgtattactgaatatgccctcttc

SEQ ID NO: 47552 - DNA, 337 bp, Oryza sativa
aggtgacgccaccatttcctcgccatccctttaagccgagaaacacctcccatcaacccaattcacaaccctctcctacttaaacccaaaacctaatcagatggtaattcaccaccggagtagagaaagaggtcattttttttagataatagaagaaagaggtcatggagcacaaatcatgtaagaagatatgaaggcccccaaaatcggtcgagtatttgacatgatttgtatgtgtgcatgtgcaattgtcgttgatttcttcacacgtcaaatattcgcaaaaccgatgataaatattttatgctcctcatactagtattctagtcacaaccca

SEQ ID NO: 47553 - DNA, 318 bp, Oryza sativa
gcacataagttccttttttgaatagctgaatgaattaaatattgtaatgttaaaatgaatttaaaataatattgtaagaaattcatatatagaaaatttttagtaccgattacagctcgaaaaatatgcacattcatccgatccatctttaattaatcggaaaagttatcgtgcaagtattttgtgcttgccagggctctaaggagcagataaagaaaagttttggcgatagtgatatgttaatatgatactgtcaactataaacaatggtttagacagcgtggttttcatggactaattcgcttcttttataaaagc

SEQ ID NO: 47554 - DNA, 555 bp, Oryza sativa
ttatattatagtacatgataaattataagccaaccgtaccaagtttgaccatgccttatattaggatgaagggattaggcttgccgatcaatgagtgaaaagcaatagttagatcaacttgggtttactagactaatctttgtgtcatgcaagccaataccgctgccacgtaatcattttcatggcaaaaccacctaaaaaactactctggggggttatttgaaccctttttcatactttaaggggtagaatatccggtttcgtactttagggggtgaagtaggcttattccttctggtaatggagcatgggaaataccctataagggaaaaatgatgggctataacatatcactgatatctacaacttacaagaaaggctcaggtcattttgtagctcatgctaactatgacaaattagtaattatgtgcacaaaatggtttatgtgattttttatattaacattttggctatcggagtttttcggtactaaaaggctgaaaattggttatgtttcattttctcattttattttgtgtgttttctctacatagg

SEQ ID NO: 47555 - DNA, 375 bp, Oryza sativa
caaaagcaaagcagattgaatgcaatacattatctttatgcaggcacctattgtttaaacgccccaaatgatgtaaagcccttacacaatgccaaataggaaataaataatactatcagctgagctaccataagctcagaaaataattaatgataattggtaactatccagcttcctcatcaaccatcattatgtatttaatgtgtgcaatagatcccaaaacattaattttcgaaatctattgcacacattaaatacataatgcaaaccttccaattcaccaaccaagcactcggcatgcaagactagacctaagattcgtacttagatccaagactatataatccataatacaaaggccctcatctcgcaata

SEQ ID NO: 47556 - DNA, 393 bp, Oryza sativa
tcagcttgggatctacgtgagccccacatgtcagagtgccaggtcttctctctcctcccctcttctctcccttcctgatctctctcatttctctcctctctgcagggcggctggcgttggggaggaggtccagcggcggcgcgtgcgacctcggaggtcggaccatcggagaagcccgggaggcggcggcgacgacgatacgggataagggaggcggcggcggctgcgacgcttgagaagggagaggcggccggcggcgccgacgcgggaagaagctgtcttcgtcgtcgtgcccgctccgcccgccatcgcctgctccgcccgccgctgccccgcaatcacatactcccgccggcgacgccgctgacagcgcgggcgcgagatctgcggcca

SEQ ID NO: 47557 - DNA, 403 bp, Oryza sativa
ctttgaggaaacctagatcccaaatccccttattacctgttcttttaaatcgagagcaaattatcggatagatcggtcataataaggtacaagatggcgatggaagagttacaggatatgtattttagccggtagcaaatcgagcaggcggcggtggcggcttgggtgacggactgcggaggcacgcgcaacagcggtcgggtttgcagcggcttgggcagtagcagcagcaggcgactgcagcttgggcctaggtaggcgctgaggcggtcaattatggaggtagctacaaataaaaacgacgatggcggaggcgggtgttgcggcggtcgattatgcagtctattgcggctgagaagccgcaggcgcagcagctaactatggtgatagcagatgagcagca

SEQ ID NO: 47558 - DNA, 158 bp, Oryza sativa
agggatttgatttgggaaggatttggattcgggattgaacttgacgatagatcggggatttgagatctgagatggcacagacactagacaacaagcaaagaacagatttcgcaattaggtttttttttaagagatagttttcccgctaggcgccacga

SEQ ID NO: 47559 - DNA, 1501 bp, Oryza sativa
  unsure (1)..(1501): unsure at all n locations
acagatttggctgcgcacacatgagttgaaatttgcaactaattcgctacttttgcttggacgtgtgcaggggtatggttcatgcattgccacttggaggtgcacgtcagctggggcctgaagatggcatgggtggtgcaggacgggagcctacccaaccagaagatcctccctccgccgtccgatctccccaaatgctaaccgatcgacaccggccgaccagagacagagattgcgtcttgctcatcagcttccctgtaggatactcggatactcctctgcttttgctagcttgcttctgttgattgctcgcggttggtgctatggaatgcttttcttgtagtggtgtgcctttccgaagttgtgtcgtcatctggttagctgatgtacgaatgatcatgggcaagtttcttgatcagacgcaaggcctttaattttgggcttctcattattatttgtcaccttttgtaacatatgagggagctggatcataaatccacgttcatcccaatatttgtaccatcatttgatgtacggcaaaaggatttttttatgtactatttcatattaatcaatgtttgttatattgttttggagtaactcatttacctcggtgattttggtgtaactagtattgactaggggattagcttgctatgacaggaatagattgtggttgcttgagaatgttttttttaatcaaagtttcacttttttttaaagaaaataccgcaataaaattgccaattcactttactgataaggaatatattgtggttgtgtggcaagtctgtttttggcagctccagcaacacaggagtgaaatcaaatcaaaggtttaaataataaaaggcctacaaagtgtatccaagtccccaagtctaccttgttaaattttctaagaaaaaataataacactcgttaactgttatgcaggacccaataaaaagcagccaatcaaaatatttaggtagtaacctgacccacacaatgcttaggttacaaaacatttcatatcaatgaaaataacgggcggtatcgttatcacctttttccaagaaaaaaaatatttgatttgggacagagacttgaaaaattaggaggcgacttctttctcacattttttttttgaagagattacaacgagactcctatgcagtcaccaacgcaaaccaccaaacacacgtgtgtgcggcttccaccgtatgctaggaatttttcagtcatcaaatatctcctggagtgtggcagaatctttactcaacccactaaacatgcacatccatatactgttaaaattaaagtacactggttccaagccttgaacataacccgtttagagttaatcattgaggttaattactgcttgattatagaataaattgtactgtcatgaaatttgngaataataaattaatgacaatctagctgctctttacactttgacatcaatctgcacctctgtttgatcttattgacatgtggatacataactcacatt

SEQ ID NO: 47560 - DNA, 153 bp, Oryza sativa
tatagttgtgtatagcttcggagtgtggctaaagtcaactactcttctgtttgcatgtcaccttgaccacctattatctttttctcatgtcttaattacacgcagaatgccgaatatgcaatataataattagatcatgctgcaatgcgaata

SEQ ID NO: 47561 - DNA, 262 bp, Oryza sativa
tactggatagatatatatcttgggatccatgtcaagtgatcatcgcaacttagccattgttgagcatatattatatatacataaaaaataaaaagcctaggttcattgtactgtaggtgaaaacaagggacgagcatatcaggaagtgatgttaccgcttagcgatatgattatggtgaactttgaaggtatatcagaatggacattgacgaaattaaactgcatgcctagcttgctatactactaccactatatatgtagg

SEQ ID NO: 47562 - DNA, 277 bp, Oryza sativa
ctaatttcataactcgcatggaaaccacgagacgaatcttttgagcctaattaatacgtcattagcacgtctgtgttattgtagcacttatggctaatcatggactaattaggctcaaaagattcgtctcgagattttcgtgccaactgtgcaattagtttttttatctatatttaatgttccatttgagtgtccaaagattcgatatgatgtttttgggaaaaaaattttggaaactaaaccaggctatctctcaccaaacaaccaaccttgcaga

SEQ ID NO: 47563 - DNA, 286 bp, Oryza sativa
atttaaaatagaacgtttccatgctgatgtttatgtatttaattaaattcagtgcgtgagaattttgtgagcttctcgcggatttacactgccagagagtgtggtgtcacgatgaaacgacacgcatgggtgtattagtacatatatgagtggtgcttgatgctacgtcgtgtaacgtacgtgtagtaggttgctaattgagcatgtccatgctgtcatttcgttattagtagttgtaacaagctttcttcagccataatgcacctagcacacctttgtttacaga

SEQ ID NO: 47564 - DNA, 896 bp, Oryza sativa
ttgtgttctgtctgtacatatctaatgctcttgagctgtgttatttcttatggcttcccaacctatctctatcattttttcatatgcacgcttttcaaactgctaaacggcacatgttttgaaaaagtttatataagaaagttgctttaaaaatcatatcaatccatttttcaaatttttatagctaatacttaattaagcacgtgttaatttatcgctctgttttccgtgtggtggggaggggttccaaaagaatacagccaagtgtgtaaagcgatatactcaagtactcaaccctagtacaaaggtatgcgctttacaaattatagaaaagaattaaaacagttgaaatttagaaactccccaaatttaaaatgttcacgttaataaaaaaaacaaattatcaaccctagtataaagatatatacacgctatttgcgtattccagaaataaaattaaaacaactgaaatttagaaactccccaaataaaaaaatgttcatattaataaagaaaatcaaattaccaccatgagttaagaatactactatacttgatgtagatgtagctcgtgcatgcaggcactatatgagctgtctgccacagttaggggatggccatggatggaccgatgccttgttttctatcgacgtcacgatttatatctctgcgactatgatcacatacggatgctaatgtatgtacagtacgtaaggatggtcacatgtacaggttataatatggagcaatccatgtcgagtcatcggtattctatatgccaattggtaaattaagtagtacggagtagtagttagtcagtcactcagtcttattgcttagttgcttaagacattttgtgtggagttagctgattaattaaatatctcttgccaagg

SEQ ID NO: 47565 - DNA, 314 bp, Oryza sativa
atttttatttgtaacgtgaaccaaacacactcttaaatgggtgatgcaatgatgcatgtggagcaatttgcttccgtaaattctgaacaaaataattgcgtgtatgtgatcaagccacggtaacgtagaatacagggaaaggaaagtaggtgacgggcaaggggcagcaaatatctgtctgccatattgccttcgatgtgtcaggtcagcccgatgacacgtacgcatatgcacatacgatcgcgtacgacgcagttcaagaatcagcagttgatagagttgtttattttgataatattatattactatctagt

SEQ ID NO: 47566 - DNA, 993 bp, Oryza sativa
attgaatttgaggtatttatctaacaaacaaattaactaatacattctgtaacaacctaaatggcgccaaaagaacttccacccacctacaaatcatgtcatgctacaagcataatgaaaattaggttgcattgctatatggcgtagcttcttgatgaatcatttgtaagatcaatgtgtgttttgattcttattttgtgatgaacaattggcatatgtgattattggttttgatatttggagattatcgtcgaagtggttttggagataatcaattttcagaaaatgaacaggatttactagtttgtcgggaccggtcagaccgggctgggtgtgccggtcagaccggcgtgtattgcgcagtcagaccggcgcagcccgcggtctgaccggtcgacgctgtgtcagtttcggtttcgggttgtttctttggatatccgtgattgtttcatggttatggcttctagatggatattatacgtatgtaatactgttgtttgctactaatgagtcaagttggagatagcttagtctcggaatatggtttctttgtttgtttcatgtgtaggtgactcgatgcctcgggagagtatttgcggtgatggaccgggagtcggcttggtggtaagacgatgtccgtggtggtcaaatatcatgcgggatactaaggctagagttgatgcacgtggttgatggagattccatatggcatatgatggaggtattgtatgcgtatgggatgcggagtcgaatttggaaggagtcaaatttggtacgattggttatgtaaaggttctttcttgtactagagggtttcctaaggtgtttaggactcttagtatgagtttgattcgtggctttaggctgcctacctcatgtataaatagagggggagcgtgagtcttccctgcatcgctttgtatcgcttttgtattgcttttgagagctagtttagttagggttttgagtttagtcgagatttttgtaaggagt

SEQ ID NO: 47567 - DNA, 238 bp, Oryza sativa
gcatgatctgtatgcgacggggagttgtttggcacattgtgggttgctaacaggttgtagtttgcctgctagatccgtagtgctgccacataccaattctgtttagtttgatactttaatgcgtttccaaacgattgcaggattactgattctgaggttccaaataacgtttaattgtgtggcatgtttaaaatgttgcaatctgaatttgtgacaggtttattggactctcctcagg

SEQ ID NO: 47568 - DNA, 267 bp, Oryza sativa
cttatgtttttgcatatttacacaatttttttaataagataaatggtcaaaggtatataaaaaaaacttgtgtgagtgcacaggtactggtatctgtaattttcagccattgaagtttcatattctagtggtgattggattggttttggcgacatatttcacttcttttcattttgttttcccagcagcaacaggtgttgagaagaggatagaatttgagggaaatgtgggaagtctgcaagtcatggtacccatttggtggctttg

SEQ ID NO: 47569 - DNA, 1501 bp, Oryza sativa
ttccgtcccctattgttatgtttgttgaggcggcgaagatcctttcctttttccggcaaatataaactttcccgagtttttcccgtcgatgtgggctcgatcccggcctcccatggctatataaaggaccccctagtcgtcctctacccatcccctcaagtcccgtccgccgccatcgccggaaacgctctccccgcgagctccctctctctccacctccggcagccgctccagctgccgtgcgccgtcgccccggccgtcgccggtcagcgccgccacttccctcggctccgcaaagtcgagctctaccccggccacccgttcttttgcgctgaaccccgccggaagtcgccgtcaccgtgaaggccgaaccgttgccatgttttgatctccaacgaagctttgccgtcgactccgtggtcgccggacctcgccgtatccactgtcggcatcgcagcagtgaggagaagcctggcagccacctccgcgaagacgcaagccatcggagcaccgtcgtccccgtgaagccgatctgttccatcttcagtcgcgccgttcgttgtcgtccgtcgtcgccctcggtcgccgtcgaatccattgggttcgcaggagcaaggtgaagcccggccaccggtttttcttcaccgaagatcgctgaaacgtcgccgccatcgctgacccgaccccgtcgccgcctctacctcgctgccggccgtctgccgtcatcatccatcgtcacgccgtccctcagtgagctttcctctctccgatgtcgttcatcggtgtagtttatccatcgggtcttgatccaatttaatctaatcttgtttggccctagcgtcgttgtcgtctccatgtgttgctatcggaacgttgtcatcatccctccctctccgatcattttggatcggtgagacgtctatccttgtctccttggtttagatttcaacccatcggccgcgcttgccaagccgcttcgtcgcagccgcagccgtgcccgttgcgttgttgttcgccgcgctgctgccctagcctgtgcaccgtcgctaccggttgtgccgttgttgcttgccgtcgccgctgcgctagtcgcctagccaccgttgtgccctccctgccacagtcgtgttgctcctgctgtgcgttaccgcttgaccgctagctgctgtttggccgctgctcgtgtgtgccaagttgttgccgtcccgctactgcaaccaccgagccactggtcgccgtgctgtgttgtgccgtgccgtgccgttgctgctataccatgtcgcagccgtgcgtcgcttaaacctagccgccgctttagccgttgctcggtaatcaagttgtctagccgtaggtgcatccctaggttcctaccggcctatcgtttgccataccggggctttaccatgaatcgtgtctagcccaccggtttagtcgcagccgttgttgagttgttcgctcgttcgttcgtccgtctagagtcgtcctttagttcagagccgtt

SEQ ID NO: 47570 - DNA, 1501 bp, Oryza sativa
caattataatctaatctttttccggaggttgttttaatcttttctctcagttataaatcatttgtaaatggtttaattaatttggaatagtcttttctttaataggtttaattggaattaaatcttgtaaaattcataactaattcatatgaaatcaaaatgaggccgttcaagtctctaaaatcatctaaaatcatgatctacatgtttgtttactttttatgtattgtttatttggtttttattagtctttttcctcgttttgcgtgttagcttgtcgtttccatcgtttcgaaggttcgtgagtgcgccggaagtattcaagaagattaattgaagatcgattattgcaaggcaagtcagacagatcccaaacacagttcctttgagcatgttgatcctatatttaaattctctatttatttcaactgtgcatttatttttgaatgtcaccgggtggtgtgaacctattcctttgttatggccagtttgcattgattaccctatttcttgattacctctggttataatttgactagttggatttatatattggttcaactagatgtattagatataattgcttagccatgcttagaaacattagcacacaattgggataactaatgtttcactactacttaaagatggacatgataatggtagctcacgatggctaatcgtgattggttaattaattaatgtgccaactaaaacttgataatggtgggttgtgagcacatggttttgatggtcgtgctcatgacaattaaggaccggttcacgagtttcggttgtgaaacattaaccgtgccaaccacaagccagaattggcaagggctggacactttgtatagcaaggctcattgtggagcaccagactgagaagtggcggagataagcccacgggggttgctggggagtccatgcctctggtttttgagggggtgactacgatccaggaacggtgcactgctttgggttgagttatgcgagggtcttgtcacaatcactcgtcatggtgacgtgtctgcgcggacacggtgacatgacggtgggttgtgtcttgtgggtacagtggtacacctctggccagagtaaaactattcgaatagccgtgcccgcggtcatgggcgggtctaacaatgtctttcgtgattagtcccacactactcattaataataatgtggtaattgatggtaattaatttagctcctagtttggaatggtacattcctagtttggagatagatctgtacagccgggtatggttgttcaggatggttgggcctgagcagcatgggtgtgctgttcagtgtttgatttaaattgatgattaattactctattgttttacaattctcaaatgtttgctaaatgctgcttttgcaaatgagccctgtattatgccattctttggtatccttgtgcacttgcatatttgctgtgtggcttgctgagtatgtcatatgctcaccttgcaataatcaatcaaacctc

SEQ ID NO: 47571 - DNA, 420 bp, Oryza sativa
tacagtagttcatcaacaactgaagcaaactgtcaatgctgcagactctcataagtcatagcatcccccctggcctacccgtgtacaagacaacactccaaaggaagattttgcacagctagaatcaacaaattggtaaagtaaaagctcccaatacctgccaaacctaaaaaaaaaagacattgaacaagcagtcacattatcatatggtgtactccaatatgctcttcttcgtcttatcttttatagagaaaaaggtatagcacaataattaaatgcactgtccaggtgaaaattccataggcttttctttggtatggaactagtattgatcaaggcctattagactgcaaattaaatagttgcaaacttcccatgtcgataggatcgaggaatagggtcaagaaacatgatacacaa

SEQ ID NO: 47572 - DNA, 441 bp, Oryza sativa
tgccccgcgcgttgcatagcaggtcattttgtcattttagaaccacaaaacatacttgcgcatatatatagtacgttagagatcatatcttatatttgataatggttaaggcataagaaatagtcaacaaatgaatatatttttgcaatcattgttcagtatattaaaacgtccgatcattgaatctttggacgtcaatttaacaataaaaaacaacagtaacaatatttagtaacgccatgagacttacggttccatctaagtatataaacagtctatgagattagccggatagcatacaccagttcaaaagaccaagaccaaagtattgcaaaatactccctccgtattttaatgtatgacgccgttgacttttcgaccaacgtttgaccattcgttttatttaaaattttcgtgcaaatatgaaagtatttatatcac

SEQ ID NO: 47573 - DNA, 217 bp, Oryza sativa
aatccatcggagctcgcgaaatcggtattggcacggggatgaggaagaagaagacgaagacctgattaggctcgctaggctggcagatgcggtgaagaagaggagatgctgctgctgctgctgttgctgtggaggagaacgttgaaatgtctaagcgttgggagggtgagagacagtgacacacactgaccgaccgggctgctccttgtaatgactc

SEQ ID NO: 47574 - DNA, 479 bp, Oryza sativa
acgaacttgactatttgcttcttttacttcttaatttaaaaaaaaagattatttgcttcttttcttaccaggaacagaaacaattgattagtacaaaatggtacttcctccgtttcacaatataagactttctagcattgttcacattcatatagatgttaatgaatctaaacacatataaatatttagaatcatttatatctttatgaatgtaaacaatgctaaaaaaaattttacattgtgaaacggaaggttgtacaaaacaaaatacatcttaaaaaaaatcacttggggttacatctgagaaaaaaaaatcttaaggattaacaaaccagctatgctctcattggatgtactagtatcatgtatgatatggaagcattttatgtaaactaattgagcacttgaggtgttgaagtggcgttaattagtccaataagcagacgatttgaccctaatagagtcattacaaggagcag

SEQ ID NO: 47575 - DNA, 645 bp, Oryza sativa
cccccaagttggaatgtgccggtattttctgaatgtaacaccgatgagtctgcttgctaaacaggaagcttataaatcagtgagtctaagctcaacaacattcttcagtgactgcttctgaatgaatagctgaacaaggggccaagactcaagaacagctgtgtgctcataaatctagcattaaataagacccagtataagccttaatcacatgtttcctcagctactacgcaattgcaagctctccatggacatggagatgcaattgccagtgatgacacatgatgcaggcaatttgatctttggaaagggttgtcatgggtcccatgcatttaatttaatggaataaaggttgatagagaagtttgttgaaagttcctgcacatgtttttgtgtactatcaatctgccagattgctcatgccttgccccaaatgccaaaacaatctcttaccagtagtatgcatgtgagtgtgaggcaagctgcttctcagtactgaacaaactgaagtagctgaatttttattgatctgcttatctctgcctttgctttagcttccccaaaaccataatctacaatcagacaagctattgcatctatgtttgcactccatttatcaatgcatcgcctcatttgaattatttg

SEQ ID NO: 47576 - DNA, 326 bp, Oryza sativa
ggggaatgtgtgacttgccttgcttcttcacttggatcttctgaactcttatccttgcgaacgcgatcttccgaaacgacgggaactacacgctggcacgcaaaacgaggaaaaactctaataaaaaccaagaaaatagtacataaaaactaaacaaacatgtagagatcaattttagatgaattttgcaagttgaatggctcaattcggagttcgaatgaattagatatgaattttagaagttttgagccatttaaatgaatttctataattattcacgaattattgcgcaattattatttattttacaaaggaaatggacctcg

SEQ ID NO: 47577 - DNA, 713 bp, Oryza sativa
attaattggctcctagaccaatgtatgccgtgcatcgcagacgatcccggtaacatgctagactgcagttcttctttcccttaagccagcatgcagagttccttcagctgctgtctaaacaggcagcgccgacaaagtgcccctggagggaaacgacgacggctaaattattttgttgatcaatcgaagagtagcacacactagctatcgctagctcttcacgtaattaaaagtgccatcattgttactgtaattccggtgattagtcaactgccacgaccagattaatctacctaatcttcagggcgtgtgcgatcgatcggcaggcatgcatgcagctttgcctaatcacatgttcagaaacctggaattcagaagacacgcacacaagctagctagccagccagatcgccattgcaagcatgcttaaagttgatcagcttgtggtggtgatcgatcagcagctaggtagcttgcggagtccacagctatccatccgtgcggcgcacactccctccctgcactccaggcttttgccgtgcaaatcaaccatctgcatctgcatatgacctctgactttcgcctctcgcgccttttctacagctataagcactcctcccccgccattttcctcccccattttcctccctccacacaggcgttcgccaagcaaaaacttcgtacaccacgcattgccgccaccgccgcgctcg

SEQ ID NO: 47578 - DNA, 294 bp, Oryza sativa
ttctttctttgtgaacggtaagcattcatgcatggaaacttttgtgaccatatagaatgcatttcccatactgaagaactttctggaacagcactaggggaaatgtctgctgttggtaaaaatatataatgcacatggcacttgcatagttcaaccattctagcttatacagtgaccgtttgcctgtcaaattgcaaaatgaatctacattcctactcttttgttgttattcaattactctttgtcgttaaggcacccattatttatgatgccattcttatttgtcctcgtagt

SEQ ID NO: 47579 - DNA, 447 bp, Oryza sativa
taccaaccgagattggcaagtactgtatatatatatatatggaaatctcataaacttttctgccggccggtgtgtgtacgtgtggtgtcgtttgcgtaagcgtagacgcgaaaacttaaacccagcaccagaaacttaccacatctgaaagatctcgtgagtacactataacttctagaagatctcgagccgagtacaactcgatctatccttaccagggtttacattaccatcggttaccggcttaccgcggggtacagtaataaaaaaccacgataacccccttaaatttaaataaatttgaaaaataatttgaatttttgataaattttacacggttttttacggttaccgcgtgataatcgtgcttaccgccggcggtctgggaaacctgatccttactgactagtactaactaattctacgtacgtaccatgcgtgtgcagt

SEQ ID NO: 47580 - DNA, 436 bp, Oryza sativa
gtcattaattaattttaaattagtgataactaaatggtttctcttatattggccatcccttttcccatcagtaacaaaatgaactatctcatacattaatacatatcatattgttccaattgctattgctacagacctactatatccttcctaacaacaagttccccctgtcccctctagcattcttgctaaatgattggttgaactatggctgataagccgtagaaatataaaagaagaaaccaaaaatattttgaactttttgtctgtattattcatggtttaaaagccatgctggaaaatagactgcaatgaagaaaaacctcaaaatcacctataaaattatgtttcaaaattcaattttggctatggatgataaaccatcaagcagacaataagagttatttacaattgttgcattaaactacttgtgtca

SEQ ID NO: 47581 - DNA, 1501 bp, Oryza sativa
ctgattcatctagtatcacagtttcatgcatccttaattccttatccgtgttttatgttgttgtgcatcttaattgctcctgctactgtcatgtgagtatgtgacttgcatgtcagcaatttttggatcgatcaaaatgattcacaactattacaacaaggcaagaataagtaacatgactgcacatctcaatcagttcaacacatatgccaaattgccatttacctctcacatgtgctcattagtaattctggttcatgtacatggctacgtactacatttctacaaacaatgttctgcatgtattaagctgctgacctgtttagttttgctttattaaccttgtgtgctacgttctgatgcatgacaacttttgacttgtgcagttggcatgattcaagtactaagtcaaagtgaaccaattcagctgaaatatcatcgaggtgtgcacttgttccattttagttcttttcttatttttgtaaatcaacaacaaggctcgtgactacttgcacttaatctgttctatgtagttcccaaggcggaggaagatctattcgagcaactgcctgacgatgttcagaatgaagaaaggaacggaaatgctaaacaccggtatcccgtttgggctcggtcgggacgggacaaattttttaccaatcatcagaaatcatcacgagcttatccgagtcccactcccaagagagacagaacgtttcttgtgcttatccgagtcccactcacaattctctcaccgtgggcatggcgcgtgagatctcgctggcgtcgacggcggcggtggaggagccggcggcggcacctgctcgcgtccgccggcggcggcagctccacctcttcagtgtcgccgctgaagtgcacgaggtcagtgtgggagagcggcgtgagcgtggtggtggcgccgacgccagcgcccaccgtgttttcttcggttgacggtctccatcaacaggaggttcttcattttcttgctttaagcagtgtcaagaaaatcggtgacatgaattggtacgagcacatagacgatacatcgatcgaatctgatatgaacttattcatgtccactccctgtacatatatttgatctggaagttgacggaagcaaaaatcgtttccccatatatgaacaaatgaagtgtattacatggggtagactttttgtggagtaaataccagccatgatactgaggaggatcatgacacctcccaagtatcacatgatcatacttaggtataatctatgaaactcacaggaaccatgataccagtcatgatactaagaagaatcatgatacctctctcgtatctcatgatccttctaaggtatcatctatgaaacctaatgatacctgagaagaatcatgatacctccctcgtatcacatgatctaaggtatcatctatgaaacatgatgataccagacatgatacctgagcagaatcatgatacctcctacatatcacatgatccttctaaggtatca

SEQ ID NO: 47582 - DNA, 806 bp, Oryza sativa
ctttaggcccgtttgagatatggaatgttatctcaatcaagcctaaagttgtggcccgtcactgatatgtgtcatccgtgacgggcttaagttttatacccatctaacatgtctgtgcgaccatatcttaatcgggcacttttcggcccgattgagatgacttccttgtgacggcccgctatttctaagcatattagagcccgtcacagatagaaggatctgtactagtgtgtggaaaatgctagaatgatttacattgtgaaacggagaaagtaatactaaaccgagagaatatatatcaatctacataccgaaatatacatgctgttcaaggagggcgcagcgtcaagtaaaaaaagagtccagttcaggtcgcatccgttaaagatgttgcggagatgcacgtctctcaggcagggttcactttctcgccggtaaccgcgcggtaaccgcggttaccgggcttaccgtgggggtcggtaacgaaaaccggcggtagggtttgggcaaattttgctcaaattcaaaaatttaaaaaataatcgaaaaaaatcaaaaaaaaatcatggatgtaaagcttgttttgtatgttgttatggtgaaaaaatttcatcaaaaagatgcaggtaaattcaaatttgagcacaaaacctattgtgaattataaaaaagaaaaaagattaaatggaatgggccaagtatgcactgttcatgaggcccaataaggcccacaatgggaggaaaatatctttggaagcctctgcttcgtttctctggcgaatcctaccgtttttcccctctttcgc

SEQ ID NO: 47583 - DNA, 1501 bp, Oryza sativa
gggagcctagacgagtgaattgaagacgagtttatgctatatatcggaatcccgttaaaaaacgggacgattctggtaccaatatggcatcgctcttagcaactgtcgtccgccacctgcgtgcattgcagcaaaacatgaacgacgaccagcactcgccaaacgccggcttccctgcatctcagcgaaacctcctcggaagcgcgcgcctccacgcgcgattcctcgcttcctcccgctggcgcgcgcaccgtccgtcggcttctccgcatcatggcaaatcctcctagaaagcgcgtgattcctcgcttccttccaccggcgcgagcatcatccgccagctcctctacatcccagtgaaacctcctcggaattgcggcgcgcgattcctcgcttctttccagcggaaccctcgccgtccgccggctcttctgcttcccaatgaaacatcctcggaatcgtgttttgcaaggatatgatcttgcaatcaaaacaatacaaggtttagctgagaaagcttgcatcaatgaacttgacaccaaagcttgcatcaatgaacttgacaccaatgggaggacaacatgttgagaaggcccagtctaaaaatcgaggtgatatgcaggaaaaatttgtgaatgagagtaacaccatcaagacagtgagtatcttggctgctatcatggtgactacgggtttcatggatgatacattagtagaatcatgtgatacctgggaggtatcacgatccttctcgatatcatgaaacctgaaggtttcacacatgatccctcgctaggtatatataatcttgtgtgatacctaaaagtttcatacatgatactgcaaagtatcattatgtgtgatacctgtgaagtatcacatgatcctacttaggtatcatgtatgctatcatggtttctgtgggtttcacatatgatacttgaggatgatcatgtgatacctgggaggtatcatgatcctcctcagtatcatggatggtattatcaggtttcactgatgataccttaggaagatcatgtgatacgtgggaggtatcatgattctgctcaggtatcatgtctggtatcatcaggtttcatagatgataccttagaaggatcatgtgatatgtaggaggtatcatgattctgctcaggtatcatgtctggtatcatcatgtttcatagatgataccttagatcatgtgatacgagggaggtatcatgattcttctcaggtatcattaggtttcatagatgataccttagaaggatcatgagatacgagagaggtatcatgattcttcttagtatcatgactggtatcatggttcctgtgagtttcatagattatacctaagtatgatcatgtgatacttgggaggtgtcatgatcctcctcagtatcatggctggtatttactccacaaaaagtctaccccatgtaatacacttcatttgttcatatatggggaaacgatttttgcttccgtcaacttccag

SEQ ID NO: 47584 - DNA, 374 bp, Oryza sativa
tctggaagtattaatttctttcttactacatgtgaacttttgttttaaagataattaacgatatgggaactttttttagataaggatatgtgactttttttaggagttcaaacttttttatagcaattctacagtccttgaggtaccatgaggtaccaaaaaaattagtgtaaaatttggtatctcttggtacatggtactatgaggtaccaaatttacaatagaaaaaacggtacctcatggtacctcttcaaggatcgtaaaattgctctttttttaagtacaaacttgtaaacgatctcaattgaaatgctagtttcctagaagcttttatccttgcgtgacatttccatcatttttgcttgtgttgaagg

SEQ ID NO: 47585 - DNA, 637 bp, Oryza sativa
ccctgcacctcagctccttgcccggcgggagagggacgaagcgcagcgccggcgcgggggcgaaggggtcgcaagtgatgaggcaccaagagaggtcgacgaaccagagcctcccggagtgcgagacggcgccgttgggggccaactgccggggagggaacgggtaggcgacctccttctcgacccactcgccgacgtcggaggagaagcagacgagcgtggcgtggtcggcgtggaggatgggctggagctcggcgaccacgtagcggccgccgccgtcgggggaggcgaggagtcccatgtggcccatgtgcatgacgagctccgggtcggggagagcgaccgcggtggccgtggcggcttcaaggacgaagtagcccgggacgaactggcgccacatgaactcctgacggccggggcggtcgatgacggtggggcccttggcgcggccctggtcggcgtggaggaggaggaggccggaggggtcggcggccatgacgctggggaagttgtcggacgtggtggcgctcgggaagatccgctaagggatggtgagcagcgagacgcgcgggggcgccttgagcgcgagggagagatcggcgcccgcagggatcccgcccccggcccccttctcgtc

SEQ ID NO: 47586 - DNA, 1501 bp, Oryza sativa
tcgcatgaaatgggcgcgcatcaggctgttaggttcttgcaggctaggtacggctttattgtccacgattacaatcttcagatgttactttcctaccggagaatagcagcgtctacagtagatgcagctgttacagcctcagcgtgccttgctaggttccagtcacgatatgctccgacagatctatcgtgtgctggtgttgtccagcgatgtaacactatatggttcaattttcttcatgaggaccacatgtttagcaacatgcacaacctttaggggtattttgtttcctttagagggtgttagtgtttttcgctactgagtttgtctgcaatgagagtgtgcctttatgatgttattacataatgttttgtattgtctgctttcgatcttatgttcttcttttgtgcattgctttcggttagttcggtgctctctttcttacgactgatctgacgacgaaaaaacagctccccttttatccgctgtgttgttgcctctgagctatgacgagtaatccctctccgcgagttcaacgggcccgtgagagccgtttgcgacgccgtgcttctattggccagggtttgtgcttcttaacttgatttagaggcgcttcttgggttagatcgataagtttgatcaaccagatagttggggtttatagcatttttgcaggctcctctgttcggcggcgtaaatcctgtggtctctaggggaccaaatggttcgccaaatgctggaatagatgtggagcagtcggttcctgaacaagctctggcttctgatgttcatgtgcggtctcaggttgcctttgttgctggcacaggtcctttgacccagaattccataaccaccgctagcagtaagttgagcgatagttgtcccatgggctccataactcctgacaatgtcgattatgcttagctcctttgttctcctcattgcgattaggaaagagaaccctactagatgtgccgcgccacactgctgcagcaaacagggaaaaacgacgcctcaagaggtctggttctcagccagaccacctggtaagaaaaatcctagaaggtatggttaaatataccttttgtttcccctgtgctcgcttagtgtggcagttatgtctgctaaccatttttgctttcaccgatgcttgcttcctgggatttcgaatgcataggtcccgttcctacagtggatgacatcttgcctttacctaaggattacattgcgtccttaaaaggtttgctcggtgtctgctgtcttacatagcttcctttctgtcaatcaatgcagttgttaatgcttgcaaacaatgcagctttgtgcccagagcgatcatactatggtggcccttcgcatgagtgtccttattgtggtgccgttttttggtaccaggagagggtaaagagagatagtgctgtttctcagagaaggattgtctataatctctgctgtaggggtggtaagatcagcctgcctgaactaaaatacccaccggata

SEQ ID NO: 47587 - DNA, 272 bp, Oryza sativa
gaaagaatttcagctgcacgtttccaattatccacacaaaacatcattgaacaagataagcatgaagcaactgacatctgaggcctcccgctatcataaataagacaactttgaggggaatacttttctgaaaacacattgatatgatagctatgcaacccacgaagacatgtttttatcccacataaactaaactggcaatatgaatattaaatcatgtgtagtgtaaactgacaagacatacacagaaagccaaaatatctctcaacagc

SEQ ID NO: 47588 - DNA, 1501 bp, Oryza sativa
tcatgggttagttgtctttgtgagttaaattaaaataagcgcacgtcgatcgtacgtacgtgcaacgttccatgcattctgcctgagcacaccatacggttttaattatttcttcagtcacactagatctctggtttctccataactgacctaatctctgaactatgattaagtaaattaaaaaggctaaaaagatccttgatcttcaaatatactacaagggaaccaatgaacacttggtgtggagtataagtaagttaattactagtctgcggtacatatgttcctaattacatctaactaatcataggattaaataagcattaaggttagtcctctgagatttaggccattggtaccgtggagtttgtgctagctgtctagtccctatggatgtgcattcaacagtcgcatcaaaacatttcgattactactaagttatccttgctttacctagttcaccatgataaaactttatgttgccaaatgatatgcgcggctgaacacgagtctactatattgttaaattctcaaaaacatgtgtatattaatgtgaaattactataatttagggagggaagtacaaaactgtaaatattatatactacctctatctgaaaataactatatgggcaatatcatttatattattactcggtaagttgctccccacgtgttgaaatcctggatccgccactgtgtctctcagctctagggactcagtatttacaacaatcctgatgatctcagccaacgataacagtgatagtatgtccccagcctgtttttcttgatatcaattagaaagaattatatctatcgtgtttatttcagctgtaacatctttttttaccaagacacccccttagctatgtccattttttcatattgttagagagtagagattcacaaagtatacgttgtaaaagaaattaaatatggagctaagtaaaaagatgtagaaacataaaaccgtaattgtccaatttttttatgttgaagttgctcagggctcaatgctccacattgctggtaagtcttatatatatatgcaagttgacatgcacaatgaattatgaagtatgatttctctctttttttttatgtaagcatcatcatatcataatggttaaaaaaattgtctgattgtaaggaagtaaccataaaaaattcttatgggaaaaaatgcacgaaaatagtacatgccatcaacagggagggacaatgtatgaatacaacacaatgagatacatccttttgagtacaacacatcatttgttttctagcatttctgactttttgatgatatgtaaagatgtacaaaatgatcgaattgctaaaatgtgttttttttgtcaccgtattttcgtgtttacacctatataaatgcaaaattaaagttccacacatctccaatggaatgcatgccactagaacgggattgcatatctgtgataggctgaaagcctcatcactatcgggtaaggcctccgtcactagg

SEQ ID NO: 47589 - DNA, 470 bp, Oryza sativa
gagtaaatttgagagtagaaaaatggaaattctcggtgaaaggaagcgaggagttgtctcggagagagaggagagtgcattattgcacactcatcgtaaggctgaagtccacgaggacgccattattggtaactatccaatccaatcaaatcgaagagagagaggcattagttaattttaccgaaccctctcttctcctctctctctctctctctctgactgcctcgcaagcctcgcctcgcctcgctaggaaggaaggagagagtggttgctaggctagcagcaggagcgaggcggagcggagctactcctactagcttccctttcgcggccatccatgcgcgcacgcgcgagcgaggcgtgaaatccgagcaatgccgatggtgatggcgcgcggcctgccccgatccgctcatctgtagtagaggtgggagtggggttggtggtggtggtggtgtggtggcgcgaga

SEQ ID NO: 47590 - DNA, 227 bp, Oryza sativa
gtcggttcccggtttcccagcactgacacgaaccgccatagcggagccacctccacgtcgaatacgtcaaacacaaacacggtcacgcacggataaagcggccttggccgcaccaccgaccggcgaccacaaagcccaagcccgtaacccccttcgataccgcctctcgcggcaccgccgcgccgccgccgcaaacgaggctacggaggccgaggccatggcggcga

SEQ ID NO: 47591 - DNA, 190 bp, Oryza sativa
ttatccggcctcagtgcatcggcaaaaccagccatagtaaaatcacagtgcctataataaggtttttggattgttgagattatagacatataacgatttaatctattccataaataaatcatgacattacagatgaaaactagcatgaacgcatcattagatctacacatgtaaactacacagtataaca

SEQ ID NO: 47592 - DNA, 1501 bp, Oryza sativa
caatttttataatagtagagatagcagaaaattagattatctttttaataatagtacagtgtcataaatttatatatccaactggatgattcccaagacagaagttcaacgtatatatctttactaattaaacaattattaataactttccgttcgtcacttttttcccgcgtacacgctattttttcagccatatactcaaaattttttcgtgagtgtccgctttgctcacgatcccctctacccctacacgtcctttgtccgtctcgccgtgagaaaccgaccgaatcagatgcacgacagtacaagggaagaaagaaggaaaagccaaataattccctaaatttgtaaatcaaattaacctgtatcaattcgggttactataagcctctgggaaacccgaccgtggtgtgggttttcaccgggaagcggcatcaccaccgtcgccatgcgggcctcatcttcgcccgcgcgtgccccggcaccacgcttgcctcctcctctctgacctgccggctttgccttgcgtgcgccgtcttggagccgccaccatcaccgtggtgccaggacaggaaggctcaacttggcaccgccctaagcagcgccacccagccgacgatgttggagacgcacgacggaatcaccttcacccgcacatgccacttcgccggaccgccatctctgccattgtcatcattcactcgctcattgggagagggaaacagtgaagcgaaggggatcgagagagattgaggtagggttagggtttttcccctcccccgatgcttcaacggtgcgggtgcgatctgaaccatccatcagatcggacgattcagctcgccctctcgttgggccgtcgcagttggtggaccgtgcggattgcaagctgtggaagcgcccataggccgcgctcggcgctcgctaccgcttctcaaataaaatggactggcccattttgggccgggttcgggagccctaggccataatttttctttatagaattgttgtcaaattaaatgtttattctttccagaaattcatttaaatgccttcttagctaaataaagttggtgaaaattattttagccaccaagtatacctacttaaaaaatgggagtgtctacagatcatgcaacagattttgatgtcttccatctgtcgaattttttgaccatctgatccagatccaacgaacaacgtttttttgatcaaaatagaaggaaaaaaaataaaaaaaaacacagatcgggccagatatatgcccgtctgactcgatccaaattaaatggaggcccaaacaaaaaagtctaaaattcaagcccaatgtaataaatcaacaaaaaaagcccaaatagatgagcacaatacacgtgacacatgccaggtgacttaattagaaaacttggcacccaagaagaaagtgtcacgtgatctggagataaaaagcaaaaagcaaattcaacatagggggaatcaaaatctgaagtcagaagaaaaaaga

SEQ ID NO: 47593 - DNA, 775 bp, Oryza sativa
cttttctgattcttccatcaagaatttgtatgctttaactgttttcgcaccttttgatgcaatttcagcaaatttccttgacaggatattaaatctaagaactgatgattctgaaacaggtatgatttccttccctttaattatttctgttgatttatgattctttctccatctatgcatgatgtatttctccggtatttctttgatgctaaggtgaagcataatcttcaatatatgagagcatagtatgccatctttctggaacattgcacaaatacatgtgtattcttctgtatccaagtccatcatcacaaggtattttctctttctgatttgcttgctgatcacattttctgcctcaaacactgcataacacttgaacttttcaatctcttcaacttgtaattcaaatgtcttcctgagttgagcctgaaatcttttgaatattttgttgttatataatttcactgcttggtactcaatggagtagtttgaccaaaaactagtcggcctttttgttcttgattcatgatggtcatgctgttctaaattttgaatagtatccataaccctttcatattctgtcaagaaacttctgatgctatattgggggccaacatttttcttgaatcttgagttagttccttcacttaatgctgttgattgaatgaaaggacataaatctattttgaaatatactggaataaacctttttctgatatgccacattgtgctagaaaatttatctattgcagatggaattcttgaatcatat

SEQ ID NO: 47594 - DNA, 1501 bp, Oryza sativa
gcatttagcaaacatttgagaattgtaaaacaatagagtaattaatcatcaatattaatcaatactgaacagcacacccatgctgcacaggcccaaccattctgaagcaaccatacccggctgcacagatctatctccaaaccaggaatataccattccaaaccaggagctaatcaaattattaccagttatagcatcatttattatggttaaagtgtgagactaatcacgaaagacattgttagacccgcccatgaccgggggcacggctattcgaatagttttattctggccagaggtgtaccactgtactcacaagacacaacccaccagcatgttaccgtgtccgcgcagacacgtcaccatgttgagtgattgtgacaagacccctcgcataactcaactcaaagcagtgcacctttcccggatcatagtcacccccttataaacaaggcatggactccccagcgacccccgtgggcttatctccgccacttctcagtctggtgctccgcaatgagccttgttatacaaagtgtccagtcgttgcccattctggcttgtggttggcacggttaatgtttcacaaccgaaaatcgtgaaccggtccttaattgtcatcagcacgaccatcaaaaccatgtgctcacaacccaccattatcaagttttagttggcacattaattaattaaccaatcacgattgaccatcgtgagctacaattaaatatccatcattaagtaatagtgaaacattagttatcccaatggtgtgctaatgtttctaagcatggctaagcaattatgtctaacatttagctgaaccaatatatataaagctcaactagtcaaattataatatcccaaggtatctaggaatagagtaatcaatgcaaacaggccataacaaaggaatagattcacaccacccagtgacattcgaaaataaatgcacagttgaaataaatagagaatttaaatataggatcaacatgctcaacggaacggtgtttgggatctgtgtgacttgccttgcaataaagggtcttcaattaatcttcttaacacttccggcgcactcgcgaactttcgaaacgacagaaacgacaagctaacacgcaaaacgagaaaaaagactaataaaaaccaaataaacaatacataaaaagtaaacaaacatgtagatcataattttagatgaattatgagacgtgaacggcctcattctgacttcaaatgaatttattacgaattttacaagattaaatctaattaaagcccatttaaaaaggattaaataaatttaattcaatttatggataattttaatatgtaggtctttattttatacaacttttgcaacttgaaccacattaaactgagttacaaagaattagttatgaatttttaaagattaaaccggattaaagcatttatatggattttaattgaattttgacgcaataatgaattatttttgaaaaggaaaagggaattattg

SEQ ID NO: 47595 - DNA, 497 bp, Oryza sativa
tttttcctagttaaatcaaatttaccatggaaattttgattttaaaaaggaaatcataaagaaagtcatccaatggtagccagtttgcgactttgcaatactaactaaacagacaccagttcgccataacgaagattgattgcctaaatggatcaaatcaccacatacgaatacagtcccgtgtagcacattgcaaatttgccatgaacctagtctaagatccagcaattatactcgaccagaactcctaatctacgcatacaacagaactctgcctacacaaacaacaggccaacagcatgggccacgtggttcaaggcattggggagtaacttccttatatttcatagttacttctttattaaaattcctggatgtaaaatggatgctcatggttagtaaatggagaaatggggaacgtttgaaattgcaagtaatcagatcctacaaagtggcctagtttatatataagaggtcatccagaatccgtcaaaaca

SEQ ID NO: 47596 - DNA, 1501 bp, Oryza sativa
ccctcccgctcctcccggtctcgctggttgaggtggagcggagtcgtgttggaggcggacggttccatcggcctcgcctagcgagggttcatggcaacaacgaaggtgaactggtggtcgataatggtgtcgaactcggagttagggaggcatggtggcagtggcagaagtcagaggccagtcaataccggcttgttgatcggtagtggtgggcagctcatgatgatgacaggttcgttcttagaggtggaagggccggcaacggcgacacactagcggcgtgcacaatgacggtgctaggggcctaggtgacaatggcaatgttggtggtggtggtggtggttggtctgcttggagttgcgctaggagcaaagccgaacacagttgacagcgccaagggtagtggcagaggtcagcggcgaagatggcgtggtgatcgcgattctccagctttcgacagttcggtggaggcaaggttctacaccgacaatggtggggtagcgtgatcgttttcgtgtgatatggcaatggagtagggcaatggcttttagtgagataagctacagcaactcggtgaagatggtaccctatgacgatgatgccatgccagcaatgaatacgttaatgctgaggggacagattatctgctggcatgaggatggtgcttggtgacgacaagatagttgggcagactagctctatccgcttagctcacggtggagcggagaagcttttaccgttgctacagcatcaacgagagcatggattcctccgcattccccaatgtttcaaatgttgagaaaaaaacttgaagctagttttctgttcttttcggttgtttgttttgtgcatctctattataagatgtggagtgtaccagtcatggcattgtagcttccacttatttattcgcacgaacaaccagagctagcaccaaacaaacatcatttcgccatgcaactggcctgataatcttaaaacatatggaacgccagaatgctttgatcagcatgtttacaatcacaaaccacactctgtcaccatgttcacaacatgggacatgaggtcaaacacatgcacagggtagtcagtaatgtatacaatccgtccagcttgtcctgacaatcaagaataatctgatagatctacatttccacagcatgtaaacatgagtaaaaagttgggtaaaatgtacaacagtccgtatagtggtgactttggaagtacatgccgctgccagctcttcgtttgctccaaagtccagccttgaaatctgacaaacatttcagagcaatagttccttctgacagcacttgtgagaactcatattctaacaaatattacttgagctcagtatcaagaatgggacttgacaaacacatactaggagcttttgctgtttacttccagaatcctggcatgcagtcacctgtatggatgtgttcccaaatgatctagattttgtctagaccaaggctcctcacaatcatgaccctgactc

SEQ ID NO: 47597 - DNA, 1501 bp, Oryza sativa
aaaaaccatagaattggcacctatatggtattataggtgctggttcctatcaataaccagcacctataaagcatccaggtcatccccgagatcactataggtgccggttcgttcctataatgcccataggtgtcggttcagtaatcggcaccaatgtcttgggtaattggtaccgggctcgaaaccagcacctatgagggtcttcgaactggcacctatgatctttcctgcagtagtggtttttgtctatcagagctacttgagcttcttgtagtgactagatcaccttgcacggttgcacctgtctcaatctgcacatacagcaaagcacatgcaatgtagggaatcagaatcatttctagggagaaaacaaaagggatcccaggcatatgatcttttattggaaaatcttctaactttattttgaggggaacactcccaggccttttcgtagctgcaagccacgtatattcttgatgtcactaatcattatccggaggatgctatatactcaactagctttacaaaatattcgtagcttttgcgtctccctaatttttcaaaggttgcaagcccatgtatggagaaaaatagatattcctttatgtcctattataatatatcacttctagggtaacataactcccgtaaaactatagatttagtgttataaattccatccacaatgtctcaaactatagatatttagcactggtattgtcacaaattaatctacagattttaaaggctccatgcggaaaaataatgttaggacgaaacctcgatcgaaaatctgtagtttgagatattcatatgctaataaatctttagttttaagatattatatattcttaaaatctgtagttttattaattaagatacccaaccttagatgtgtagttttgtaaaatctacaataatattaaataatattaatggtgtggtttatcatggtggacacacttacgctacaagcttgtacatctctcttagtaagattttgtgagattcacctatgtagccaccatctgggtaacatgtgtaaaagggattgagatcctctgatgtaaagtcagaggaacgtggtaactgacatgtgggtcccaccgctcgtggggtcactgggaataactttatattataggttccgcaaaaaaaagatacaggctcaaaaccggttatatatatagacacacacgcacacacgcgcacacacacaaaactgcattgtagggcctgttcactttgataccatttttaatcttaccaaattttggtaaagttacctaaaaaagtggctacatttagtttgctgctaaattttggtaactatataagaaatcctgccaaaattttagtaagttgccaaaattttagcaatgccaaattttagtaaggtttttttgacatcaaaagtgagcaggcccgtaatttgagccatatgaaccatacacagcaattgctaccttataattaattgcctatgggtcgcttttatagt

SEQ ID NO: 47598 - DNA, 968 bp, Oryza sativa
gttacaatgttagctaaaatgagtcgctacagaacaccgatgccaaaatatgtataaaaaaatcccacaccgttgtacaaattaccgtaaatttaccgtttacggcaattttcaattgtatcaagaaaattttctttggtagggacggaaacaaaagtagtgcacctattacactttaaaagttaaaaaaataaaggtaaaatcatgtaaaatatactaattaatccttatagttaggaagattgtgattctgccattgttctttttttttggatattgtgccccatttttctttaaaggtgaccatatttggactggttttattctctcttttttggactggttttattctcctttttttggaatggttttattctccttttttggacttttcatatgtcatacaatttaatgtctctagaaaatgtctctaccattttatagacattttataaaatatcttttcgtttatagaggcaattcaccataagacacttattagacatttttttaaaatgcctttatagtattgtaaaggtatttgaaaagcatatctatagttataaaaaagtctctataaagcatttttcttgtagtgttatatcaacacgtatatatacttgtatttgtgattaattatttttttaagtaatagatgatgtacctaaataacgatgtatctgtgatctgtgatgaagtttaatattaagatacaatctttccattgtgtttattggagttatgcatgtactgatgtgtgtttttataatcatgagtatgcgtattaacttaacatttgtgtgaaggaattttctatacatttgtcgacaaattttcttttagaaatttaacaaatgtaattatagtacaattgcgatataattacactgtaactttccatctaactataatacaacttgtatgtaactttcaaaagtctctatgtaacatgctatatttcggcgaaa

SEQ ID NO: 47599 - DNA, 242 bp, Oryza sativa
aacaccaaccgagaccaaagagaggtagcagcggtgagatggtccttttcttttttttttctttttttttctctcgaattaagtgggatacatatcccaaatcaaacctcaaatacccaaatcaaacccaaaccaaagtaacatcacaaatcttatacatcacagatccatacaaatgtacaatgaatcacaatattgtccatacaaaagtacatcacagtgaatcacaaataaaaaaacaa

SEQ ID NO: 47600 - DNA, 1501 bp, Oryza sativa
tactccctcgcattaatcatgcatctcccggtgggacttgctgagtactatggttgtactcattcttgctcaatctcccccccttcagtaagagaagctttgaagaagaagtcctaggtggagtcctggcttataccccagttgagcgcctgtgaagatgtagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacaccggccgtgtgtcatcctgcctgtagtacaataatgttgtggggatttatgtattagtatccgtagcgtttatggtcttgtgtgtacagtaggactctctgatgatgtgtgtactgtgttttggccctccaatctcttccttttgttatatagaaaaagatgcccgcgagttggtatgggaaactgatactcatttggaaccgtgatatcttatatattatatattacaagagaatctattctatactcctgagtttactccagttaaacgatttggcgtcattgactttatctctctataataggccaccgactttgataatttttttacaatatgtcactggggtggatacttttttaaaaatgcctaaagtgtgcttcaagccatagagggttgacaattaatttacctactagaagtattgcaaacatataaaactttttacatagtccccacacataatatgaagtgtgtgtggattttaagattttcaatttgcatgtattaatttttttgaaaatatagtttatgtttcatatgctaataaatactctagcgttgagttcgtttatgtaaatcatctttcatatgctacacaaaattatttttctaatgtagctatgttttgtgtatgtgattcatctttcatataccacataaaaatatttttgaaaaaaaaatcttgaaatatgtacagaaactttatatcgtataagaaggctacactaaaactttcatattttttcaaaacttataatgagccaatcaatcggcaatccttgtgtgtcttgaagggcattttaggtatttttgaaaagtatccattctggtatattgtagaaaaaattatcaaagtcggtggcatattatagaggaagatggcaaatcattgaactagagtaaagtcaggggcatataatggattctctatgttgtgaattatgatctttgctcataaggcttgctaccgcgtcgtatcatgctcacccccgattacacaaagtcatggaacacaaaaccatctgatacatctcctaataaaaatgtatgcgacgtgacttgttatgctagaagaaaaacataataagattttcaaattcataaacggtggtacgtgctaattaagcatgagatagcggccacca

SEQ ID NO: 47601 - DNA, 1501 bp, Oryza sativa
cgttcctcctcgccggctcgtcgtctcgctgcgccaccaccctcgtcgtcatcgcagcggcgcattccacgccgtcctcgtctccgtgcagcactgccggctgcccttgttgcctcctcgccggttccggtcgtcgtcctctcgtcgttcccggtcgtcgtggcgttcgtccctccgtcaagccgttctcgttcgtcgtcctcactccctcaagtgccgcagccccgtcgtcgtcttcgtcctcgcctccgcgttgccaagccttgtgccggccgcgtctcgccttcgtccaaagatcgccgccgaagtcgctccctcgccgttcgcctccgtcgttcccggccgcctccgccgcgcccgttcgtcgttgtcgttcccacgcctcgtcgcatggtggtaaggatccgtcctctcgctgcccccgtcctcgtcctttcggtgtcgcccatgcccgttgtgcggttgtcgaccccggtacccgtgtaccggtgtcggtagtcgttcgcttgtgtgtgtggtgaccgtgttagtgtgcccgctcggtagccgcatggtttccacgtgtgcaggccgtgtggtgtctagtggagtccgtttgtcggccactcgcctcggttgacacacgggatccgcttccgtcgacccgtggaccgtctctgtgtacccggtctgccgtggtcccttaggttgacatgtggggtccgcatgtcaacagcgcagccttcctgtcttttccaggctagcgcttgcacatgttttatagttgtaaaacctaattataataatccgcaaatctccatataacagcattaaacttcggatgaccatgtcttggtcatacgagctccgaaccgatccgttcaagtctcctaatgtttgttataacctaaagaaccgcgtgctttctttttatgtattgttattgcttctttataggcttgtagctttgcttgtgtgcttcgcgtagcttctgtcgttccggaggttcccgaagcgtggttcgtggtcgtcgccgaaggttcggaaggccgttgtctctgagcaaggcaagtcacatcatccttgagcatattgaattccagtttataaaattattttgatttaaattaatgcattatcgctttatttaaattccccgttatcactattttatttagccatgcctatttatctttgttatgaccttatcattgttgttattgttattattaccttgttcaccctaggaaaataaaaccccaactagtgggtactctattcatggttccactagtatgaatttaggtagatgcttcgctgatttattaggcaacattaggtggttttataactttagactttgggaattctcatatcatttggacactatggaatggttggcttatgttggaattggacacacacctccccctctattcaaaacccccaaaatggttttaggctgggctcgaggtgcatggttgggttttgttagtcgtacctcgggtactataaggattaa

SEQ ID NO: 47602 - DNA, 1389 bp, Oryza sativa
ttcctgcagccctatcgctttttacagcctacactaatggacgtacacatcaacgaattttcgctatcatgaaaagaaatattggagaaggggaacatttgtttcgaaaccaaacagaaggctgcaggggcagatcaaagaggcaaacgccattggatatatacatatatgccttttgtgttatcgtcaacattgataactgttacagtgttgtgtctgccctcttgtacctgtggaccacatatattccaggccagcagttagttgtatgcaccatcagataattaaatttctcagcaagatggtatttattttgagtacgaataacctcaagtaatcctttccgaacagaggacgtacgatcggtgtactcatgaagaaattgacactggcagacctaattaatatgggtttgtaaaagcatgaggatattgcaatatatacataacaggtgaggagtgcaggtacgtggcactggtttactaatgtgattattaaatgaagtggaacaaaggggtatacaaatttatcatcgttttgaatagttattgtaaacttgtcaaattaccgtaaaaatttgacaattgtttacggcaatttgataagtttaccatcaaaaggcatatcatttcgcaaaggcttgagaaggaatatactaaggttgtgttcgctgggaggatgggaacaaaactcctacgcacggaaaacggagtgattcattagcaagtgattagttaagtatttgtcattttttttcaaaaatagattaatatgattttctaagcaactttcgtatataaactttttataaaaaacgtaccgtttagaaaaacgtacgcgctgaaaaggagggagaggggttgggagctgggtggaaggattgcagcctaagaatatatcgaaccccctaatttttgaaaatttgctgatgaacaattcgtgttcgacttgaacatctcttatatctccgttgaactcttgataatgcacatgtactctcagtgaggcattgcaactttgcaagctatcctttctctttcaatttcttcttatcgttagtgaaaagcggtggccgagccagccagagcccacccctaggtaggggtgcaagtgggtcatccgtaaacccacttatagttcaaaataaacgagttagtgagttagtttaatctataagtgggtttttgtgggtagccgcttgcacccttacccctagggcttattcccattacctggttctattcatatacaaatgcatataaattttataaatttacatgaaatttacatggggtatagaacccagacctaggacttaagccctagctgccctacaactggatccacctcttctttctgataattttttttcttattcggtcctttagt

SEQ ID NO: 47603 - DNA, 949 bp, Oryza sativa
tatttttctccatacaaggaattcacttctaatgttgtaacaatttacttccattttgtgcaaagttacttttatgatttatgtaaattacctttagactttattgaatttacttttataaatgtatttacttgaaaatcttctctacactttgcttatgaatttactccacatagtttcttattttaactcagtcagaatgtaattacttttcatgctatagggaagttacttctataatttaaataaattacttttaaactaatatgttttttaatatattcaacatgcatctcattttgtcacatattttgagcagggtacaatgatgcaaatagattttaaaaataatatgtgatttaaaagatataagtcattacataggttaaaaaagaaatgcaccattgtattttttttaagctaaagagagatttatatgtgtatgaagtggttgatgattaaaacataaatcagcgaacggccgctccctagtctagtcgcgtcctattttttttagttcctcatgtacatgtacaaaaaccatttaatccgactggttcagagagtgcaaaacggactacgaaacttggatctaattacaatcaaagtcatcaaccatgtcaattaacgaaataaacgcgacttccaacctgagtctgttccggacaggcggccggccgcgcaccacgtcacctgaacacatcttccctatatatattccccacgttacgtccagcagcctgcacgtacgacacaatcattgcgcccgtgctccattaactattttagacgccacgctgccacgccgccgccgcttgtcttcgatcgatcgtgcgccaagcctagctagctttgtctccaaccttttttgcagacttccgagtagccagcccacctgcaggtgtcccaactcttgctgccgcttcggtttgtgcacgtgcgctcgcca

SEQ ID NO: 47604 - DNA, 804 bp, Oryza sativa
caaccatctgtgacgtttaatttcgtcacaaaggttgggcctcggctagactacactggcccataagcgttttatgacggttaaaaaacgtcatagattgtgctgatccgtgacaatttcggagaaaacgtcagacagatttaatctgtgacgctcaatagatgacgataagtataatcgtcacagacatttcctgtgacgaattttcagtgatccatgacgaattttttcgttatagattaaatagattcttgtagtgggacaaatgtcctccttgggttgatgacggcatcgtacggcagtcgcgtatgtaaagatggacttacagctccactcgtcagttgggtcaaagagagatggaccaaacaacgagctggacctacagctacactcgtcagttgggtcaaaaagagacggaccaaacagcgagttggacctacatctatatttgtgggttgggtcaaagagagacggaccaagcagagaaaggtagcgggctgggctgggacttaaaattagcttaatgtacaaaacaaaagagtaaaaatgtacagcgattcaaaaatgtttttacccgttgcgttgcaacggatattttttctagtataaataaaaaatggagagaaattgacagggtaattaccgatcgttgcctttctcctcacaggacctcacccagtatacataactatatatggcagtagaaatcatgataccggtaattacgcaagttacgcatcatgtttccttcaaaaaagaattcgcgaaggatgagctatatatgtgtcgcgtcttcctcccgcc

SEQ ID NO: 47605 - DNA, 1501 bp, Oryza sativa
aaccgccaatgccaccttcatttggaggtgcaggccacgaaggcgtcttcgtgcctcccatccgtcctcaggctccggccgcatcgtaggcgcgaggccgaggcaggggttgtggtgcacggcgtcggctcatagaggtaagtaaatattttggttgtgcaatgtgtggattcgcaaagtaccataagtttacaagtgttatgtttagttccgattgattattgttctgtaaacttcatattgagtttagagctctaacattacttgcgcttgattatagtactctaacagcacatagtcatcacatagttcattccgatgccgctgcttacttctgtttagtggtaaggtcattgctttgtcagtttaattgtgcctctaggaagtgaacgacagggcatagtggaccaatgaaaatacgaaacttttttgcgagctgtattgcaagcaaattgaaaacggcaactgcataaggggaagcatgaccaaattcggttggaaggagatcagaaaggggttttacgctgtcactgggttgctccatgacaatgagcagttcaattttagatataggggtttgaaaactatgtggtccttcatacagaagttgaggacatatactgggttgggccgctggcctgatggcaccgttgtggcttctgacaagtggtgggatgacaacacgaaggtacaatgcttacattgttcattctgatgttttgtccacaataattgtccttcacctgaccgctttgtgtgatttttgcagaaccatgctgagttgaagaagccgaagaatgggatgcccaagtatctggacgaactggaccgcatgttcatgggggtggcagtggacggctcgacttcctttgttcctacctagccctcagcacagccggccaaccccattgaggacattgacagcgatgatgaagatgactccgaggaagatgacttggacccctaagccccttaagcgttgggacgaagaggacgcacagcatgaggagcacaccaagcacgcgcagtacagctactagtccgagcaaaaagttgaagagcccagtggtgcgcgccatggtgtccgaattgaaggtccacaacgagttgcagaaggacaaagtagcagccatggacaactacttgggcaggcgtgagaagaagaaggatgatgagatggcacgcgtgcgggaggtggccgagcgtatcatgggattgagtagagagtgcggggtcactgatgagaccccaaagctgtgggttggtatgttgaagatggtgaaggacccagtagacattaatgtgtttgagctgtcgaatcctggaggaacgaagaccctcattgagaactacgcaagggtcgacagctagaccttcttatgcatgctttacatgttcatgtagcgctgtttagggtgccttttgtgttatgtatgtttagcaagctatgtctgtttagcaattagtggtgctatttgtgttaggtatgtgctgcctcaga

SEQ ID NO: 47606 - DNA, 1501 bp, Oryza sativa
aaatatattaatttagttttcaagtttattaactgatgcttaattaatcacttgttaatcaaccgtttggtttagcgtaccaggtgtgaagggttttaatccttcccaccaaacacatacttcctccgttccaaaaatataaggagttttggttgtgttccatctaactaaaactccttatataagtgattaggatgtgttccatccaaccaaaactccttatattctgggacggagagagtacttagttttgtacgctactttcttgtctattcggctttattcataaaaataatcacttgttaattatagataagagataaggtggattctcccaaaaatatttgaaaacacttacataattaagaatttcaagattgcattaggtaatttgagccacattgccatatcactagcgataaaacagagtagataaatacagatacaattcaatacggatacaaatacaaatactaatagtttttcctggatatgtatacaaatatgaagtcgaagcttctgacggatatggataataatactaatatctggtgaacaatgttattgaaatatctaccaaaggaataaagcataccctatttcttactaattctagaccttcaaactacacctttaaactttaatactagcccacactactagcactagttcacattattaatattatttaaacatgtaaatattttaaaaaactagatttatatgttataatatcagttatgcttccatatatatatcggtaatgttatatgcgttaaacttaatggacactatttacactttaatgaaactttttatatgaaactagctaattatgtgtgatgatatatgtttctatcataagttaggtggttttcttgttaaaacaaaatccttatttgtattcgagataattcgtatttggtttcgtatcaagctaaaaatatgaaatgaatatagcacaagtatgatgcatccgtatcagttgtgttttcttccttgcatgtcagtgccacattagataccactttgtgtgtggcccaagattgaaaatgatctgttttgagttttcacaatttactactgaattccacaggattgtttttttctagatgttaatatttaactattgagtttgtaaaatggattctcctaattccaaacatacacaatgcaatgcacaggaactaaataataacttttattcgttccaggattcatgagctactcgatcgatggtaccagacttttttttaagaaacatattatataatggcagtgtgttttgaagtgcgataatggaattgttattcggccgctgaagaatcagaataaaatatctttaaacaacagactgtctatcccacattcccaccaacctgacaataggcctcattagccaggcacacccacactcgcagatatagatacccaaatgggccgcctgacccagcacggcccaagcacgactgggcctaggctgaggtcagtcgggccggta

SEQ ID NO: 47607 - DNA, 413 bp, Oryza sativa
tagattttgttggaatgaaggtatgaggctgccatctattgaggactgtcctgggtgcagtgatgttgcggagagctcaagccgatcatatagtaggggcaatcggctaaggcagacaagacttcctgttcatcaaagattgggtccagtgaactaagatcatagccaggaggacaatgaaaacaggaaaactcaatggtgtccttctggtatctttacgaagaatgaaaagagaagggttcaaagattgaggagcagggagcgctttcaggaagtcgaacaggaaatcaaccatcggctgaagaagacaaagccgaagcaggacaggcgtcttaagaatcaagttcctgtagccgatgaagccacagccgatgaagcaaaaaggttggctaaaggaaaaagtgttgtaactg

SEQ ID NO: 47608 - DNA, 280 bp, Oryza sativa
  unsure (1)..(280): unsure at all n locations
ggggagagaggggaaagggccgggggagaggggaagatgggccgagaganaatcggcccatcgaccccgggggaggcaaaatggacttttgcggaggaatttgatttggaaggatttggattcggaattgaactcgacgatagatcggggattgagatcttgagatggcacggacactagacaacaagcgaagaaacaaatttcgcaattagggtttttaggagataattttcccgctaggcgccacgacggatcgggcgctacatgttgtttctggaga

SEQ ID NO: 47609 - DNA, 446 bp, Oryza sativa
caatgtgtcaattgccaaattccaggtgcccacccgtttagttccaaagtgcagactgtggcctcgtgccagattttttttggcactttggccctatctaaacacggcttcacttttgcctcagattatttcagttccaataaggccctgtttagttcacaccaaactttccctaaactctcaactttccatcacatcacattacacccaaaacttttctactcacataaactcctaactttttttccaaactaccaactttccctaaacttcttcccaatttcagaaaaacacagcctaaccccaaacttcttcccaattttagaaactaaacacagcctaaacacagcctaagatcacttcagatgagcaaagtacgagagaactacactgaggccgtttgaattttgggcagccaactaaacaccccattccaatttggaagt

SEQ ID NO: 47610 - DNA, 363 bp, Oryza sativa
atgtctggttttgtggttcaggagggtaattcgtactttttcccatattatttgtaacaaaccaagacatgcaacggccaaaatctttgcttagtttggctttgcaagcaaatcaaggtctcctttagaatgtatcctaaaatacaacaacttctccactaaaagcatcacaaacagcttcccaaaattatatcttaaaaattttggttataggaatcctaaacagatattaaaggtgttaaaattttcatcccaccacaagattgggtaaattagctttctaaaaaaaactaaaagtaggacccacgagaaaacttccaacggaaaaatcgtttctagttccctctctctctccccgctaga

SEQ ID NO: 47611 - DNA, 1501 bp, Oryza sativa
agagaatgtttactatagcatcacataggctaatcatagattaattaagctcaatagattcgtctcacgaattagtccaagattatgatgggttttattaatagtttatatttaatatttataattagtgtccaaatatccaatgtgatagggactaaaaagttttagtcccatctaaacagggtcgggaaaccaatatcggtgatgggtttgatcgaacaggtactatactaatgtgttgttctatgtagtaatgggaacataatgattagtctattgcagaggtagaacatatatttattcattcaattattccgagacttctaaaggttaaaatagaaaaattgtaatgtttcaaaaaccaaacgaaaaacatatgaaagtaaaaaatgcataggacacacaagagggagatccatttctttgttcacccttaaaagatatacttggtcccaccggttttcaacatacgagcttgttgaaattagacaaatgttttactattcctcttactggaaacattttgtaattattatttatttttctatgatttgttttatcatcattgatactttaaacatgttttatattttttatatttacataaaaatttaaataagacaaattaatagttaaaatgtatccaatagttaaaagtgttgtaaaatgaaaactggaggaagttatattttaacaaaaaaaatatagtctttaaagacattgtcctagtgtagtcgggtgtacgtcagagcatccaggattaaatttgccgataaaactaaattaatttagcaggctgtcagcatgtcacagtcagtaaatttaaatacggagtactccactagactgttcgggaagggaactttaattactcccggttagcaaccctttctagtcccggttgtctaaccgggatactcaatctggaactaaagatgtttatttttctgcaatcgagacgtccgatccgggactaaagattttcatcttttgtgcaaccaggactaaaaatacatacctagtaaaaaaaacccagtcttcatgcgcgttaacatcccatctactacacacatttgacttggatagatatgctttctttttaaactaaccctggaggcatctttagtctgggttggatggtaatgttgacaaagatgattatggagcatatctgtagagattattgtggattgaatagtgtatcaccttgcattacttacgccattatatttctagctaggttgtattgattcgagtagatgttttacagcaaacaagatcaaagaagatagtgaaattaattgtgaaagaatccgtcgtgattgtaatggttgcacagcgacaagcagccactgtgtgaagatttcaaaaaaataggacacgtggcattggcgttgtggtgatggaggatgtacgggctatggtgcacttacaaggtattcgacgcttagttcattggcgcaaaaaaaaaggtgacaattaatggaggggggaggggata

SEQ ID NO: 47612 - DNA, 214 bp, Oryza sativa
tgtgtgtttttataatcatgagtatgcgtattaacttaacatttgtgtgaaggaattttctatacatttgtcgacaaattttcttttagaaatttaacaaatgtaattatagtacaattgcgatataattacactgtaactttccatctaactataatacaacttgtatgtaactttcaaaagtctctatgtaacatgctatatttcggcgaaa

SEQ ID NO: 47613 - DNA, 259 bp, Oryza sativa
actttccatcacatcacatcacatccaaacttttctacacacataaactctaaacttttttttccaaaccaccactttccccaaacttctccccaatttcaggaataatttatttatgactgttactgtgtttcaactttcaacgaaccacttactatagtagtactacctaacatcagagtctaataagatttggttttcatggtgtttcagaaggtgcatgataacgcgccacacgtgaaactatattcatgaggga

SEQ ID NO: 47614 - DNA, 1501 bp, Oryza sativa
aggaagcgtaatcctggattaggtaggcccgtcaaatcgatcacgggctgtaagctggatggctcgctgaactaatcggtggagtgctaaaagggcccgatggttggacattgccatttgccaagcaagcacattccatttccacggcgagaaagggtaccactaccagttcacgattacgtacaggtacctttctgttgcaaagtcgagaaatcaggagaagcggtgaaacagtgcaaggaattagcggcagtgaacgctcatgtggttggtcaaaaaagttaatatcaaagcgagtaaatggtcatgtgctaaaatagcttatcgatagggcaaatttaagcctgaagcttccatcaacggatgaattcagtcgtactactacgaaccaacgagcttggaaagctatatattcaggtgcgccgatcgagcgccacgaaattaaaaattgtacttgttatcatattcgatcgtactactacgaattaagagctctcatgttctgttcgctgttaattaatcgtctaatcataagttcagtgctcgtatttattaatcaaggacagaattctggcagttcccttcggtcagttcggacttccgacgtagatgcatggccaaaccacatgcgataaaaatgaaagtaaaatcacatccgttccgtgcagaaacgtataggggtctaacggctagctttataaggtggtgggctagacgacctggattcaaagcccaccccttctaattacttgatattaggtcattctctaatattcatattttttttaccctttgtgatgagcacctgcatctctgcacgtacatgttactttccccatccaaaaaaataaaagattttatctatatgactatatgaatataatcccttgtatttagagataaagatgttgctagtacgtatgatgtaaatactcacacgtgagctctgcaattatttggtggagtccacgactaggtaccgatatgctcacgtagtatgatccaacgagcaacgagacaaggccccatcttctgaaacaatagccatattcatcactcattcactctgtcacagtgtgagtgaatggaataatggagtgtccctggggagtaaatgctcaaagtgaatctgtgaaggagacttgcacagcgacctgatggatgatgatcgatcgaaccttcctgggtaaagtggaacacgcaaattgacggctagctaataacccaacagcctcccatgcacgccgatattgccgccttcgcgccccccgtgtttatatactacaggcgcctgcgcgccctcaggaccaaaggccgaagccgctcgcgcgcgctcactcgatcgaccagtcgcgcgcgcgacgagagggagagcgacgcggcgccgaaccggctagctctcgtaggcacaaaagcccaaacacgttgcttctgcagtagctagtgtgccgtgcccgtgatcggagatggcaggctcgttgtctgccgcgctgtgcctcac

SEQ ID NO: 47615 - DNA, 268 bp, Oryza sativa
tgtgatgtaatgagtgttcggactaaatacttctatcgtgtaatttcaattcaatgttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcag

SEQ ID NO: 47616 - DNA, 195 bp, Oryza sativa
ctaccattgccactgtatattttttttatagctatgacaagaggatgaattgaacatgcaagtttgcttaatccgtaactccatctaatgcggcattatactttctcggggcttaggtcaattcctcaaccacttgattcccagtacggaacccatgtataatggtgtgataaacccacatgacccacttccagg

SEQ ID NO: 47617 - DNA, 1501 bp, Oryza sativa
ttaggggctcgaacctgtataaaaatcctcgtccctatatcttttattacaatctcgcatatatcataataccaacgatcctcatactatgcaaataccggaatcgcgacatcaaacgtcgacaaatttcatctagttttcacatttaccatgtgctatatgtgttatcctagggtggccgtagggtttcaattatcaaagcacaaggtcactgataagtccgattttcccgtttatcgctacccccgataaaatctcctatcggccaaacatttcgggttttttttgaattttctggacatagcgtcaataactactacaaagttgctttgattaattcgttatgacctgtaggttttaatcaataggttttgtgttcgattcaagcaaagatatgaatttcttctctctctcttttttcacttccatttgcttgcgttgtgtgtgctataaaaatgttgatattatctcatttataaagtatatattaattttttatacaaaatggtttggatataatctgtatgatttcctaacaacttttgttcaatttcttttcaaattttatccaaattttttttctatcaccgttagaattccgataaatctgataatccctttatcgctacccttcgatattttttagctatcgataattaaaactaactgtggaaactactagctttttatttttttttaaaaaaggaaacaaactggccttttctaagatacaacaaataatttggttagccccacctaaccattatccacatcaccacccaaatagtccatcatggcacgcattaagcccatccacaaccaagatatcatgcatggtaactaggtttacaaccacgcaaggccttcttcgtttagtcaacaagagagggattagagggattgtgaaaaattaattccacatctcaataggtgtggaattattctcctccaaatcctcctcgatccccttgtgggtgggattaactgaacaaggtctaaatgatagccaatctaattagttgtagtcacagtcaaagacttagtgcaataggtgatgttgtcaagctaaatggtcttatgggcgagaggggatagatgcatagtactccatctatcctaaagtctttatccaatttcattttttgtatttttttttcaaatgagatatgcttatctgtagtcttcatacatctaaaacttaaataaaagggctgtcttttcattttacaatgctaaattaaatttttgatcgaaactagagcgaccatcttaatattcattggttgcatgcaaacatataatttcttgattttgttatatgagggatgaattaatccctccttaggttgtgttcttctctcaactttcccaacctcttctctcttgttttccgcgcacacttcccaaattgcatttttttcgaagattttctatagggaagtttgtcagggttacggataaggtataccctttatccttggatgtatgttgtatactgata

SEQ ID NO: 47618 - DNA, 1501 bp, Oryza sativa
accacgtatcgagaaaaaaatagaagagagagaagaaagcgggctatatatttgtagccagctgcagcatgaatttcaagacgtatgtgtgtatgagatgtgagaccggatattaataggagtaatatatatttttataattaactattatataaataagctattaaattagttatagttaatttgaagtctgtagcgggttatactattgaacttgctctaaatacgcgcccatgctgctactgcaggccttccaattaattgcccgcaggctgcctccaacaggcccagcctgccaccatcggcccaccgcttccgcacccgcctgacgtgacctgacctgacctggcggccatcttcatcgacgcgtacatttcgtagcacgggcggcgtgatttttcgccagtggggcgcgtgacaatatgccggcagaaggcttcagctgggtgttcggctttcgctgggtgagtgaggatgtgcgttcatcgtggcgtcgcactagctcgtcacttccgatccccgagaggcaacccaacggctatgggaatcaaggggatacatgtatgcgggcatgcggccatgtgccggactgcctcgccagctttcgctggtccacgattcccgaagcgtaaggagaatcggttgcctctgggcttctggttggcgctttgctcgggtagagtaatcttctggttcagatcgctggtcagtcgcttgtggtaggtacttctacgatgttagcttgtgtgcggttacagtgcactggatcgaactacatgtctagatcctctccggaaaagaaaaactctgagattgttagggtagcgaactacttcctctatttcataataagcctttctagtattaaccacattcatataaatgttaataaatctaaatatatatatgtgtgtctagtccattagcatctatataaatatgagcaatgttggaaagtcttatattatgaaatggagggagtaccgatcatacgtgtcgtagttaaatactcaatccgtcttaaaatataaaatattttaattagatggaatacatcgttatattacaaatccaaagtatctatattctttatattacagcggtgggattatcgtgcagtcgccaattagtcttcgacggaatggagtacgtgcaatgcagcgtaagttgctgatgagcgcacatcgcaggctggcagcaatgtccatcgttgaaaattgcacatgatcgcaagaggaaactttatttaattttgtcaaagaccacacaatattttacaacaagcaagcaatcccaaaaattccactatcaatcatcatcagctgataaaattatcgttctaagatattcataggtacattgcttgcctcgcctccctctcgagttggcttgctctctctgtcccggggccactgatcttggcaaccacgagacgctactgcggcgagccccacgccgccggcgaagccgctgcacctgccactgccagcctccatctcga

SEQ ID NO: 47619 - DNA, 427 bp, Oryza sativa
acatatttaagcctacccagagctccatagatttgattgcagccgtacagcaagtgtttgccgaggcatcgatatatccaacctctattggggtgcttggttgagtcggtgtacatcaccattccacttgcattggtaagatcttgtaagagcttggttaaaagcttgagtgtgtgagatttgagctgccactacctagtagttgataggagcgtgtatattcttgtgtatgtttcttgtttgctgctaaccatggcaggattgcgcaaggggaaacaagatggtcatgctcaatgtcaacatcttccccatcaacgagatatagcgacttcttcacgcatgatacatgataatgatcttacaagggtagaatctaaatcatgatacatgataatgatcttacaagggtagaatctaaattgccagt

SEQ ID NO: 47620 - DNA, 1501 bp, Oryza sativa
tcttctcttttttttctctccggcggccgctgcaccgcgagctccatagccgcgcctccatctccttctccattagcctccgctccactcgccgagccgccatgctggaggtgagcacgcgatgggaaggaggacagcggcgcggacgagagagaggggaacggtggcaactcggggagaaggacggcggcgctgatgggagtgagggggacggcggcgcatagatgtcctcctcgatctcctccggggtgagaaacaccaagaacgccgcgcgcttctggcgtcgggatgaggatggcacgggcaccgctatagcccacgacacgtaggcggctgggcgccgccgcgtccgctgtcgcaggtttcacggcctcgctgcaccatccgcttgtggctgtggcagggcaagaagtggaggcgaaggtggcgccttgagctcaggctcggagtccatctccgcaggtaggctcttgggtttcgtcggcggccgcggccgcggcaggggtggtgggctaggctggggcacgcggagatggccagcggcgtctcgtaagtgacccatgagcttcaaaattatattgtgcaacaaaattatcttttacgatcttgtgcggtgttgtttagtactcctatttttttaaatagataacattgtttatatttgactattcgtcttactcaaaatattttataaatgttacctattttgttgtggcatgttttaccattaaataaactttaagtatgacttactccctccgtcccaataaaaactcaacttagaaggggatgtgacccctcctagcacaacgaatcttgataaaggacatcgcgacttcactgtcctaggaggggtcaagttgagtttttttttgggacggagggggtatattttagcatttttacactaagtttttaaataagatgaatagtcaaacgttatttcaaaagtcaacaacgtcatctattaaaaaggcaaattttgctacaggacatcgcgacttcgtggaattagctccagaacaccgcacaaagtgagttttggggcaagacactctcaaaacatggctatttgccagaggacaccgcacccatttgtttattatattcgtgctgactaggcttgagcaggcccacatattgacgcgaccggaccaaattgcccctgcgcatattccttaggcccagttgaatctgttcaccctcactaaagaaaaggattactggtaatccgtttgccactgggggttggtggctgcggatgtaggatcgagatgtcgactagaggggggtgaataggcgatttaaaactaaatgaaacctaatcaaaactaacataaattgctaggcttggtgagggtcaactctaactaagcaactaagttatgttttgcaaacctagggtgatagtggctcaattatatctctaggaaagtaaatcacactcctatatcaatgtttaacaatcctaggatgatatgatctcaagtatgtctctaga

SEQ ID NO: 47621 - DNA, 1501 bp, Oryza sativa
ggcaacctgatgaacaacagtgatgattcctgtacgggcggcggcagcggcagcagcagcagaaccagctcagctatgttcgttcatcgtgcaaatcgaccgtcagatcttaccctaaaattttacaccctatcacattaaacattagaacacttacataaagtactccctccgtttcgaaatgtttgacgccgttgactttttatcatatgtttgaccgttcgttttattcaaaaaatttaagtaattattaatttttttcctatatcatttgattaattgttaaatatatttttatgtaggcatataattttatatatctcacagaagtttttgaataagacgaacggtcaaacatgtgctaaaaagtcaacggtgtcaaacatttcaaaacagagggagtattaaatataagctaaaaaataactaattgcacagattgcaactactttgcgggacgaatcttttaaacctaattgctctatgatttgataatgtatgctatagcaaacatgtgctaataacagattaattaggcttaataaattcatctcatggtttactgaccgatactgtaattatttttttattagtgcccaaacattccatgcgacaccctatataatacccgatgtgatatgctaaaattttaccccccagaactaaacaccccctaattctaagatggagatcttttttttttgtcaatgcgttcgtgtgcatgcagttgtgcagtggtagcagttatcagtgctacccctaaatagtagcttgctaagagccagtggtagcagttatagcaggctatataagtcagctataacatcgagaagaaaagagaagagagaaaaaaacgggctacagatttgtagccagctgcaatacgaactctaagacgttatgtgtgtatgagaggtaggaccggatattaatgatatagtatatttttatagttaactattgtatgaattggctattagattagctataggtgaattggagccagtagttggctattctattaaacttgttctaaaaatataagaatatataatgtttcttagtacaatatatttggacatgtttagatttattgtactataaaatattccattcagttttagattattgtatttcgggtcagagggagtacgggtttaacttttgtagcctgatcgatgatacggtagaagcggacgaggcttctgtttgtgtagtttgtacatataccactatactgtaggctatagaaagtactccctccataagaaaaaaacaacgatggtagaatgtgacacagtagatttgttgtaataagattgtcacatcaaaatactaggttgacttttttttatagagggagtacggctcatatattagtgatttaagtgcaaaccgcggatccacttttatcataagcatgtattgtgggttttatatgttctagccctttttaattatttattattactatttccattatttttgaaaaatagtatga

SEQ ID NO: 47622 - DNA, 301 bp, Oryza sativa
ttgtgtgtgatgtgaatgtgatgtatctgtgttgaattttgtaaaatttgtgatgtatcgatttggggagttgaggatttgaggatttggggataatttatttgggattttgggatggggatggggtgaaatcgatatattaaaaacaatgaagaaaagaaaataataatggagtaaccggatctagctagcctagctctatctttaatcccggttggtaaaaaaatgttctatctttagtcccggttggtgttaccaaccggggctaaaaaggttctatcttaccaaccgggactaaaaa

SEQ ID NO: 47623 - DNA, 1501 bp, Oryza sativa
tgtagttatatgtgtagatctaatgatgcgttcatgctagttttcatctgtaatgtcatgatttatttatggaatagattaaatcattatatgcctataatctcaacagttaacctgcgagagtcctaactctagtcaccttctcatatgttattccgaccgcactagcctctgctcctccctgagcatagtcccgatcctcaccattgaccaaggctgatctcaagtcacatgcacacaatcagacaaaacaaccgtttctggacacatatatcacaacctacctaacccacattagtcacacgcactcacaccaacatccacacatcttttcaaatcaattcattaaataaataatttgtaaagccaattattcatcacaaatattaatcatgataataatttcacaaatgcatcctagtatccatgttttttagaaaacgctatatatctgtatccgtatcggtatcttatctgtatcccttatcggggtaacataggcaagggtaaattaattggagaacctatttcgttttttttttcaaaataattacgtcctctcgtaagcggattgaacaagtcggattggtcacccactccgacgcggattgtgacagatcgccgtcccgccgcggccgccgtacgagaagcagcggctgctcttcccatcgattagaggttaatacttcgctcgcctaatcttgaataatgtttttgattcagaaaacattgtgtggttataaggtataactagatgttaccgagttcgttcattttgtaactttttgctcagtaccaggtacatttgcaggccggccgggctctatgtcagatgaattttcttactgcattatcgggtttagttggtcgttctgaatatggtatgagcagaaatgttttgcgaaaataagatttggtcattctgaatatggtatgagcagaaatggtttgtgaaaataagatgtgaatactcaacagtctcaaggaataaatgcagatttgctcatgccacattgccgctgttaatggatgtcaattaaagatcactatgttctacaatttgcaattgtcaaaagtgcactgtcagcatatttcttctttattacatacattacttgtttgagaatgctcatggttctccatatgcattcattataaaggtcacatactcacattagttcaggcagggaaatatagacactgctacaaaatcgatttttagtgacaccaccttttttttttttgtctggcggttatacgtggaaaccgtcagcgaaaatattaaagggattgaggggctacggaccgctagcaaaaatagatcttcgctagcgaccgggttaagagggccgctagcaaaaatatagctattttcgctagcggctcacctaaacaaccgcgtgcaaaaattagatttttctaggtggtccactttaccggcagccagcgaaaatttaatctacgctggtggctgttgagcaccgactggaaaatgcattgc

SEQ ID NO: 47624 - DNA, 719 bp, Oryza sativa
tttgcaattttgttttgctgcaaatttggattcgtttttgtttgttttgctgcaaattcggattcgtttttgttttggaaacgttccgaaaaatccggtgcgtgcaaacggcgtggagtccggataagttacgcgcgacttatccggttcggttacgtgcagtggagatcgtgcgggcgccctgatcaagcgacccttctttatataaaccgagccgccaccttcacgcaacacacgcgaaatcaatctagggtttgcctccgactctgtgctgcgccatcgctcgtagattactccatcccgctcgccggcgtgcacctgcgatcgggagagcaggtctccggaacctctgccttcgacgttctgcaccgggagaaggcggcaataaggtttttgggaagcgctttgcgcgactgctccctgttcgtccgcgacggctcgtcttcctcttcgctcgcgtgctgcgtgccttcgtagatgcctgcgaaaagtttcgatcgagcagccggtctttccgccacctcggtacgtgttcaatatgttgcgcatatttgatatgttcatgttatactgtgtagtttatatatgtagatctaatgatgcgttcatgctagttttcatctgtaatgtcatgatttatttatggaatagattaaatcattatatgtctataatctcaacaatccaaatcccttattgtaggcattgtgattttacta

SEQ ID NO: 47625 - DNA, 995 bp, Oryza sativa
tgaggaggataggattgttaaatactcgttaaattgtttccaaaaatcttgcggaaataatgtttcaaaaaaaaatcttgcaggaggaaaccgattcggacacgataaagaaacatgccaactttgattttttttactgccatgtatacgtattttgtatattcgcgatttccaaataaagaaacaaatctggagacggcaaagctcgccgctgcccttcatccgccgccctccaccgccgggcatagaaccaacggccatcgaagcacggagcacctcttttcctttgtttcgctgactccccgtgatttttttagataatagaatataatatcctggcttttacttaaaaagaactacaaccaattattacaaagatccactccataagagagtgtagtccaagacaagttgaacacaccaaacaagagaagagaggacccaaactgagaaaagcaaaacaaaatatggagctagaaggcctcgtccaggcctaggactgaagttcgaagccagtgcatagaccaatgataatatccttgcacgaagaggtttctccaaagcggtgcccccaaggaggatgcgacgtggatcgccgccaccgctcgttcggaaccgaagcaaggttttcacccagagaatatggtagggaaaggaaaggggtacgctaaaacaacacctccaaggaggggaacaacgccaaacggcgtcgccattgtcagccggccaaatggctcggcaaggctttcgcccgcgattccctgtccaaacccacaccaccaatccgcacaagaaggatcgtcgtcggtcaacaacattgtcccttcagcgattcggccaaggccaccgcccacaattgttcccgccgtcgatggcgcgcccgcacccggactcctccttccccgctaccagaccctttccccgcctccacataccaccgctgacgacgacgcaccgtcagccggatgatggccttcaaccatcgccgctatagg

SEQ ID NO: 47626 - DNA, 360 bp, Oryza sativa
ctatagggcgaattcgagctcggtacccttccaacaataacttcggtcaacggtgcggatcgggactagactcagggagaagttgagatccatatggttaaagataccggatgacaaagttggatacgagatggcacacggtggatagacatcgtgtgagtgagatctttgcagcgggcttcacgaggtttgcatgcagacgtcggtgttcgcgaaggagattggaagaaattgaggaggggtatatatggtgctacagtgcttcgggttactgtgtagcatgcatatatgtatgtgtactgtggctagcagtatatattgtatcgcggcttgcgtgcatgcatgtatgcgtgatataca

SEQ ID NO: 47627 - DNA, 1158 bp, Oryza sativa
cctgcacccccaagcactgtgtgtgcttgttgctaggcgtaaatgccgttggccccgtcggcgtcagtcgaacgcctgggtgctgggaaaatgcctcggtgccattaatccgaaacgtgaagcttgtcggtttttgtctactcctttcctcttgcgctacgctcttttgcttcggatgctcatctttggcacggaaacaggggaagagtgagcccagcgtggggatgcgtgcattcgttcagtttttgttgtttagcaccccctgagcgtctctgcatttatattttcgtacagcgaaatcttgatacttctgctcatgaattccagctcttcatttcaaattcaaaaacttcgcactatcgatgtttgcacgcaagcatgttaggcatcggtttgtgaaaacggggggtgtgtgggggtgggggaacgttcaccacgaatgtacgagggagagtttgtcctataaaaaaccgacttagaatgcttaaaaaatagaagcattcaatgactctggcctctctccctatcattcacgctttaacaccacaaatcttatctccgccccatctctcttctcttgcgttttgtatgcttttcatttacaggggatctaatcctgactctcgatgcacaagcctacagtggtaaaggcaaataccattgtatttttttctctattcttttttgtctttcttttttctttattcttggtttttgccgttgtttgcagtagtagttcttacagggggaattaagagcatttttcccctcagattggagagatcgtagatgttttcttttcttccagcaagtgaatttttttaaatttttttggcgttgtttattatgcataagatgtctcttacatacatgtgcatagaaacggcatagttgataaatggatatagttaatgagggcacttttgtcttttcacgtttatacaaaatttgcattggggatctaggaatcgactctttttaaggacggaggaagtagatctgttctatcacataattttttcctccctgcttgagttcctctcacacttcctccaccactatcgcgacaaatcaagttgtgtgcatactccctattcctcctcacctcttcggtaagagccctgttcccccctcccctctcttctcaccttggcgaga

SEQ ID NO: 47628 - DNA, 1501 bp, Oryza sativa
catccggcccctcacgtgcaactgcaagctcaaccggtcgctgcccaagtacatcctcaaccgcctagccaagtgccacaaacaatggcagaaggggcttcagctctgcaggcgcagctccaagctttccttcagcagctcagccaaccccacaacatttcaagtacagccccttcggccctcccggaggggaatacaagtcaagatgcgcctagttggttgccttcaaatcaaccaggtctgggggcttcgccgtggagtcaaggaccgcaattcgactccatcaatgctgctcaggcgccaaccgttcggccgcaagcaccaacgctaggcttcagagcaaaccaagcaccaaaccagatcaccatgacatggtcacagccaactttcgacccattcatggcggctcagcaagcatcaccaatcggggctgtgtagccgagtgccatggcccaatctcacgcgcaagccgtgatttcacccttcgccacgccgtacccgcagcaaggtgctgtgaacagggcagggggcgaaaaggggcaaccgctgagtgggggaatcaagacccgcacaatcccaccccagtgcaagttcccacccgtcccacgctactcaggcgaaactgacccaaaggaattcctctaaattgacgagtccgcgatcgaagcggctcatggcaacgaaaataccaaggcaaaggtaatacatctcgctctagacggcatcgcccgttcgtggtatttcaatttgctagccaatagcatttactcatgggagcaattgcgcgatgtctttgtccttaactttcgatgtacatatgaggagccgaagatgcagcaacatctgctcggcattcgccagaggctgggggagtcgataagggagtacatgcgtcgcttctcgcaagctcgatgccaagttcaagacataaccgaggcgtctgtcataaacgccgcttcggctagtctgctcgagagcgaactcacaagaaaaatcgccaacaaggagctacagacacttgaacacctacttcacatcattgacgggttcgtaaggggcgaggaggattccaagcgacggcaagctatgcaagctgagtatgataaggcttccgtcgccgctgctcaagcccaagcgcaagttcaaattgccgaaccacctcctctcactgttcgccagccccagccggcgatacaaggacaaccgtcaaggcaaggtcaagcccctatgacctggaggaagttcagaaccgaccgtgcgggcaaggctgtgatgactgtcgaagaagtgcaagccctccgcaaggagttcgacgctcaggaagcaagcaaccatcagcagcctgcccgcaagaaggcccgaaaagacctctactgcgccttccacagacgctcttcgcacaccacggagcaatgccgaaacattcggcaacgtggtaacgagcaagattcaaggccacagcagggagcagcagtcgaagcacctcgcgaagtagctcaag

SEQ ID NO: 47629 - DNA, 1501 bp, Oryza sativa
gcaagttgtcagtctcgttcggcgtcccgctggcgtgatgcttctaggttagagcggagagacctgttttcgacattcgccttcttcaacgccaccacatgcctttcgtcttccttgtggtgaaaatcttcttcggacttgcgaaggcgaaggcgatacccatctagttgctctaaggcggacttcttggcactcagatgcgcggcaaggccttgataaaaaaaacaacatacattacgtcagagagctagtgaaagagcaaaattcagcacgcaaagatgggccatacccgcacaaataggctctccacagccgcgcagctttcgccgaactcgttcagttcggtgaaaagcccaaggcctttggtcggcgcaatgacctggcacaccccgtccatgaacggagtgatctccggccgcgtggcgatgtcggtagggacgaaatgcagggcggtaagcgtcacgtccgaaacgctcgcttcaaccgccggggccttcccctcgcgttgaagaataggtgaaggaaccgcatcgacccgttcgtcttcagcaacgttcgacccagcggttggggttgaggcactcccgcccgtcgccgcttcggcattgctagcgggtggcggagcatgcgcctaccacggaaagttgcgcgtcgcaacaccgacgaagtaggggtcccgtcggacccttcactgtccgaaaacccatggccgacctgcacgacctttcctttcttatttttccttctgacagccatcaccagtttcgcggctgtactagagatcgccaagagggtgttcgctacgacgatgtcttgaggtcatgtaggcgaaacatgggagcctgccctggatttcgcaggggtagggctgggggtataaccacgagagccatcctcctcagaaccggcatcagcatcctccttatcctcctcctccctatcgctttcgacggcggtcttcacgctacggcgagttcggacttggctgcctttcgagaccgcacgcttgcgctttttcgaagtgccagcctcgtcatcgccggcccgagaggggttcgatcggctcggcaattcgccagtatagacacgattcactcggccatcagcttggcgttggtgcaagcgggcaaacttggctgtggttagagccttgatcatcttcgacgcctcaatttcagcgtcttccaatgtccgcactgcgaaaatagaggaacacaaccgtttagcctgaaaagcgctttcatgaaggaagcacgcggcctaagtcaaaaacaaagaaccttaatttcggccccggtggggagaactaggcggggaagcccaagaacctctttgccctcgttcacggaaacatcccacacacgggcgagaggagaaatccgaaggaggcaaaactcctcgcaaaggtcccgagtgctcagccgccgggcaaccttgcgaaggagaatgagccgggacttgagagtcccgtcgatttgcatgttcggcttcacgttgatgg

SEQ ID NO: 47630 - DNA, 225 bp, Oryza sativa
ctagctgatggattggtatatagctcggcacgggcagatctcgcggagttttgggggaaattttttttctcttttttcttttggtgtgatactagaaattttttttttttgggagtagtttttggttgcgggatacaagaggccgtaggcggagagcacgcggcggaggcgagactctctcaacggtgggcgaggccgacgggggaaggcgttgcttttatcagc

SEQ ID NO: 47631 - DNA, 302 bp, Oryza sativa
gatcactattactcaagaaataacacttatattttcttaatataccagtattctcttgtttctgtcattaaaattgccgatgatatgagactagatgcataccagaatacgcttttgtttcacttttgccatgttgtttttgttcaatatatatgtttacgccgcaccaagtggaaggtgtacccacttgattgtattgatttttctggaaacatgtcagaagtctgacatcattatatactatatatgctaattaacacatgaagtggggagctttcctgatgttcttctgttcttgtaga

SEQ ID NO: 47632 - DNA, 319 bp, Oryza sativa
agctctcttaggcgtcgtggtctttgtggtctacagccatcgatgaaaatagttgaagatgatcagatagggatgagagattagctctgagagactgactatgggccatacgcccaaagtgaaaggttttggtataaaatctggcctaagtgaaaacattatattaagggtagcccaaagtgaaaccatagtaaaaaaatatagtccaacatcacttttacaggcaacccagattacttagcagataagcctcctctttctcctgatcccggttcgaatcacccactctaccacgtggccccgctctcctccctccagg

SEQ ID NO: 47633 - DNA, 381 bp, Oryza sativa
cagtagaagtaaaaccgcggggcccacgtgtaggccgcagaacggaccaacagtcgcgggcccacaaaaccggcagcacaatccgggggatgccgagcgcccgcccggtactcttttgccttatcccttccactcccctgtggcccccatccccccaacccccacagcgccaccaaccttcttacccactccacccactgacaacgttggccacctttacccctaccccacatgtcagtgacagagtctgcggggcaggcgtaccagctcgggcctccggggcgacacgtggagctcccacgttgctccatctctcgctataaaccatttcttctccacctttccttccccttctcgagtccctctcctcccccctctctc

SEQ ID NO: 47634 - DNA, 1501 bp, Oryza sativa
ggcttattagcgatggagaccttcttcgggtctgttgtcgtccatttccatcaacttcaagagccttgcatcgatcctcgcttctcaaccacatggctgatggctctcctcctcccatctcaacaccaaccctcccatcatcctcctctatccatacggcactaccggtcttatgctcttagcctgtattcggtaaccttttttaacctatctccctcgtttttcacgcgcacatttatcaaactgctaaacagtgtgtttcttttgtaaaaagtttctatacgaaagttgcttaaaaaatcaaattaattcatttttgaaaaaaaaagctaatacttaattaattacgtgctaatggaccgctccgtttttcgtgcgtgctgtttccggttgggaacaaggaattgcgaacacagcttacaacagcgttgttatccctctaaagctaccctaatcgtccccttaccccctcccactgactccaacgccggatcgtttattcgtgagttcacagttggagtctagggtcgtcggtcagccgccagcctaccaccattgaggactcatggagaagttgctgccaatgtcgctgactcactggcgaaagtccctctcccccccccaccacccatggcatgctctctctatcgctctcttatgtctccctggactagagatagacgaaaccatctggctaccggatcaacagccgacgactttgaacaacccactgagatttaggaaaacttgagtctgatagtaaagatggtatagatatttaaggcccccttcgattcatatgattaacaaatgagtttttatagaatttaaattcctctggattcataagaaaggaatacaacttctcataggattgtattactatgctttacatttcatagaaaaatagcaagaggtacgtactctttgtaatatttcctttgtttttcctatgacactatcaaagggtttgttggtatttcttaacgacaatactagaaatataattcccagcaataacgtagaaatacttctggtatattatggttacagagttcatccgcaagcgcatggatataccattgtagcatttcactcaagagtattctaagggtatcgtttttattttatctcgtaggaagatcatgtagagagaactcaagtaataatttatatattacttgtggtaatcatattctaagtaggggttaagataattcatgggtagagtgacacacaagcattactactcatcctcataataaataatctaagctaggtggaaagaaaagagaaagagaatctattcctatatttctaatatacatagtatatatacattctagttaattgatatactagctaatactctctatccgatgccctcctggtacttcgagaagccacccctaactgccgagttccttatgacagcccgtcatgaccatccaaccggggctaaatacggaggaataccctccccaggaaattaacttaggat

SEQ ID NO: 47635 - DNA, 1501 bp, Oryza sativa
cgggggtccggcgctaagctcgagagattcttctccggtgagtccttttgctttcttggagctctatcctgacgcgtggtgtttctgtggtggtttggtgtaatcgttattgcttgtttacgcggttagattgcttcatctaaaacaaggatggttttcttgcttgatggtgtggatggcaaaccgtaggaggtttgtcgcatcaccgatcgcagatgattctaccgttgtgttcttgggacatcgccatgggagcctctgtggtagtactagctttcttgatggttaccctgtgccgtcttgtatgcatttttctataatggacagtcacctcgcgttaagattgcgtgttagactttctgaagctctaattttgctataatagcgaggggaagaggggaatacctcgtttggtgctgttctccatttgcgggatagctcaaagtcaactctcagtcaactcatttctttgcctgctttctgtacacatgtgttcgtctatgttataatgatttggttgttcaacaagttcattaattgggaccttatcggtggtgatgtgtgtagtaggagtgctatgcgtactacatagcacgattttgcttttgtaatctgcattcttgttgcatgcattgctcagttgctcaacaagatactcgctataaatatgtagaggtcaaagactggcacttaaaatgcattgtgcaaggcatacgccaaaaggaagtctacctatggtttgggagataattcattcatacaaagtgtaactaatattgcaaaatagcatggatgtctagaaccgaattattcttctactagatggtaaattgttgttccactcattatgaatcttctgattacacgtggagaagctgagagttctcctttcttgattgatcggtgcatattttggtgacaaatatgtctatttctgctattcattttgtactaatgtactaccgtggactcatgttatcgctcctcgtatatcttttagtggcattctttccaaaatgctaaactgaatgcttcgatctttttgcagtttggattgcacttgtcagagtaaaagggctaaggacactatgctaatttaagacatctcatccaaatgaggcgcaccacacttctttgttggcaaactgaaatcagatagcattctggtagccactaaacctacagggatgtttcttgtgtgttttgaagccatgtgcccctgttttggttcaagaaggaaggatgggagcgaagaccctgttcttggaagggatggaaattcctgtaagttaaatagcaagctttcatctattggtgatctaatctgttaacacaatgaaacaatgtagatgtcacgtttggaagtataaatgaccatcatgaattgtgacacattccttcatccttgtttttccagtgaattcttctgagctgaggtcaatgtctgatagagttcctccaagccctcttcgagtacctgcaagtccatctagattttcat

SEQ ID NO: 47636 - DNA, 1501 bp, Oryza sativa
gactaataagcaatcactgtatcaaggccgcattataagatgtgcagtacaatgacaatatagttttcacacgatacaagcggaacatatgtcacaatcgcagaagaatttggtatcttagctgaaccagtgtctgaactgccgagatttttcatgggtcattcataattcacattatgcagaacgatgttctcatcactgggatggcagaatacaggtatgcaacaaattagaagaacagatcgatcgattcagaattatccagagaatgcaccataataccctggcctccagtatcactccgcgctcactgggacataaaccttattgccaccatttgatatcttgtagatgtagaatatcagtacaagtgcactgcaaagacatgtatagaccatgttaaggcgtcatctatatatatttaaattagagtgcacagaacagcaaggcaacaaccaaggcaccaaggatgggaataagatatcatggagtagtatctattatctagtatatgaaagaaggaaagaaagacttgactaggtgaagtattctcaaatatgtgtagtggttgtgggctccatgcacaaaggaaaaaatacttctgagaatcaaagccaaagggctagttagtaatattgtttaacatatagcacatataactacactttgctgacaatggctatggttaatataggctatgaaaggcacaatgaaatatcagtacagaactacagaaggattttattaaagcatagcaaatttagaacctgacaaaagggacacaataacatgagagagacagagagagagagagagaatacctgacggcagcaattattccagctggcattacctttcttgttttgatgtatcttattcccataacgacagttaatgctacagcacaaactgttcaaaaataaagcttataagataaattcttaacaagaaaaaacaaacaagaattccacttcatcgaagatggtccaaaacatcagattaggatatgtgcataaattatcatatgaagtccatgttgatatatacaattagttgcatttgctagcggaactggtacagatagccctggagttgtactgattttcaggaggaagacaacatgacatgccaaaacaaaataatgttatatgttcaggtttgttgaaatttgcgaggactttctgaaaggcattatcctatgctgctgtgctgttttgaagcaatacacaatccaccacaagattcattttatttctcttagcatggatgtcatgggcattgggccgtaggccaaggcctataggtagcgcataccaattaagttaagagataagattattagttagttagagataagataagaagattattagttagttagagataatataagattaggttcttacttaggggtcaagttgtacattgtgtctattatcaggcaagcaatgaatatcaattagtctaatctctccctctcaacaatgttcttctccctagc

SEQ ID NO: 47637 - DNA, 386 bp, Oryza sativa
attttttattgtataataattaattaaaaacacttctgaagcgatatatcttaatcgtaatctctatctctactacttaaaaaattgaaaacgtttccatcgccgtaattacgaaaaaagggttataaaaacatacaaacaaaaaaacaagagaaagtccgattcaatttaacacttaatgcgagtccgcatcaaatttggacccaactcctggagaaaacaatactataagaacacaagaacatatttcatcaacaacaacgacaacacaagacacatcataagctcaaacaccgaggccggaaggggagggtgctgccgtcgccatagaaccgccgccgtcatcgcagggatgtcaggctgacgctgcctcccctcccactaga

SEQ ID NO: 47638 - DNA, 360 bp, Oryza sativa
aactcagccctaagggatcaaaattgaacttattctgtgcggagtgtacatgcggcccataatgcagccaattgtgtggagagccacagccatctgatctgatcttcggtcccggttgatctggatctatataaaagttcggcagcccaaaccctaaccctaaaatcatttcccctccccctctctcttaaaacgacagcgtcaacggcgcctcttcccgtccgttgtagcggcgctgctccccctctccctcccacagtggcaggcagcggcaagtggtgacgccctcccttttgggaggagcagaggtagcgagcagggtggtgccctcccctccgctagatctagcgggaggggagg

SEQ ID NO: 47639 - DNA, 194 bp, Oryza sativa
ttttggaaacaatttaacgagtatttaacaatcctatcctcctcaacctgcaaattgcattgatcgagtcgagccttccagggcagagcacgcaaagaaggaagaagccgcaccgcccacgcccccgccgtctcctccgccgctgcctctgcctcctccgccgtcaacgcaagagccagccatgggtcggccgc

SEQ ID NO: 47640 - DNA, 511 bp, Oryza sativa
tgttaacacaagtttggttacatgtcaggctgcattttttacattgatcaattatatatggtggattaccccttttgagtttgtcggatggcaacaatagtagacacattgggtggatcatgcatcaataagttgcaagcgatcattacagacaagacaatactcattttaggggtaaaagatgagcttgaagaactgcaacgaagaacaaacgtcataagatcttctcttcaggatgctgaggcaaggaggatggaagatttagtagttgaaaaatggcttgaccagctaagagatgttatgtatgatgttgatgatattattgatttggctagatttaaaggaagtgtcctactgcctgactatcctatgtcatcgtcaaggaaatcaactgcttgcagtggcctttcactttcatcctgcttttctaatattcgtatacgtcatgaagttgctgtaaaaattagaagcctgaacaaaaagatcgattacatttcaaaggatgaggtat

SEQ ID NO: 47641 - DNA, 1501 bp, Oryza sativa
tgccttcttatgtttaccaactcctaatatgtaccccttttcttgtgcagcattgctcatccatatcttcttgctgacaatagacactacaccttttatatttggaggaaggttatccaagttcactggatgatgaaatacattttgactccagtttatgtgtactcatggttttcaattgttaatatcttaggtaaacttctctatataaattttgtagaagttgctactttaaagagtatatatgaactgatatttattggatttttttgtttcatcttacagggaagtcacagacaagactttgggtgctgtcctttgttctatcagttgcccttgctctcatccctgccccattggttgaatttagatactatacaattccattggtcatactgttcttcattctccagtgatcagcaatgttaaattgcttgctttggggtttctttatgccgctgttgacttcttcactctggcaatgtttctgttcagacctttccagtggcaacatgagcctgggacacaaaggtttatttggtagtttaggatacagaattagagaggaggcaaattccggtgtacaaattccctagagcatgaaccgctagcagggtttatatatatgagggtgaatccctcggagaaattttagacttgagagctttgtctgtacactaggatgtcttgcgaagctttatgcaattgaacgtttaagccagatggttccttgtaagttaccaccgtttcaatgaatgtactactttctgaagtttatccatgaccaccacctttaacgatgtttttccacttgtatgctgctgtaatatttccattttagcaggagcaaactaaaatattcagaggaatgaatggatggaagagcttgttggatgaaggaagaatctggcgtccaatgcggctgtgtttagtttctgaaattggggagaagtttggggaaagttggtagtttggaaaaaaagttgggagtttatataagtaggaaagtttcggatgtgatgtgatgtgatggaaagttaggagtttgggggaagttttgtgtcaactaaacaggggaattgttaaatccagaactggacagccttttattgtcagggatagtcagcaatgtaagacagtgccatcaactttcggcgaataggtccacaggtgagatcctcatcactgttggaaatcctggttgttattatgccttgactcatccctgattttttttttggcactagagcaatttccttcaattggccagtttttcaagcatgcatgagaatgcctattcatggactgtgtgaagccgtgttagggaaactgaactgggaatgcctgtccaggcttcatccaatatatagaacgtgatagatttgtcaaactttgtacgaaaatagtttgggtgcagcataaaaaatgcttatgcactacaaaaatgcggtatatctctcaatacatcttcaaggactgtaaaaggttgaaaataatgttt

SEQ ID NO: 47642 - DNA, 505 bp, Oryza sativa
cgctcaccgtgggagggggcgattcacggcgttggaaagttcgccggatccgcccgcggccgccttcgtgctcggatctcgggtgagagatcagagccaagggggagaggagagagatcggagagactcgcgtagtctcgcactctcttcgactcttcctcctttcgggctactgggctgggccggcgagtttgcgcagcctgcctcgtacgtaggcctggcccaaaatgcccagcctagcctgaaaccaaccgcaacgaacgccgaggcgagactctctccggcgagggagttgtactgcgccgccgctgcaccgcacctcgtcagtcgactccgggaaactgctcccgagccccagcgccaaggcctaccggagcgcctccggtgaggtcgtgacgagctcagggttcgtttggtggtaagctctgtgctcccggggcgcgcggggctggatctggagcggggtttcgcagcgcagcggggaggagccagtacgggtggggga

SEQ ID NO: 47643 - DNA, 879 bp, Oryza sativa
cctgcaccccaaaaaagagagcggaaaaaattacatccaaaaaaattgacaatctttaaaatatgacaataccttaccttctgttcgccggaaagaaaagaagaaaccatacgaatgtacataaaaaagatagcaacaaaattacatccataaaaatcgacgatctttaaaatatgattttctaaaatatattacatcacaaatataaatatatatagttaaactaagatctataataataatattaaatatccaatcaatgttctttgaaccatcttttaaataatttttaaattatatatctaatttgtgattccatggtattcctttaattaaattataaaagttgtgttgcgatcctaaatatatcacaacacatgaggccgtcatataatagttagttgtttaatattttttaaaaaagttcagatcatattttggggtgtgaaatatcacttcacaaatatacaacaccattttaaatctacatatataaaaaattaaaaaaaagacaatttagttgtgttttttcaagtagatctgatttaattgtaatttgtttgagattaagattctcaaacttttttttgacattttcagaattattttattggtatttgagaagtgagcagcatacatagtacatagatatgaaaagaaatatcaaaaatagttccactcaatgatctttgctatgattcaaccccttaaatcatcatgtgatttatggtcatattttttctttgccaaatagttttgacacaaatgaacaatgaagtaacatgcacaataaactactcatgatatattttcttgtacttaaggaatttcaatatattagacataattgatggatatttatcataaactccactgaca

SEQ ID NO: 47644 - DNA, 358 bp, Oryza sativa
cccgtgctggcgcaagggcttgtcattaggaagaggccaaggaagaaggaaccatgcttggggaggctcatggggggttataggaggaagcaagctaagctgctagatctagtgatgcctaaggagggtgaaaggggattgtagtttaggggccagatctaatgtgaatccaaaatgggcgagagtaaatgccgatagtagcatgaatacagcacattggctagttcagcttggcccttgacccaggaataattttgtggagtgatctaatgtggaaatggggttaaatgagcaacatcaaaccaatatttgtgttcaattgcagttggagagtaactagtccaagtgttggtggaaa

SEQ ID NO: 47645 - DNA, 785 bp, Oryza sativa
ctttctagggtttagtgttacaggggattttacatggttgcccttatgaaagggacatttacatgggtatgcagtgtcatttgcacatataggcctttaatgggctgataggctgggcctggtctatggcaaacgggcttaaaaggccaggggcggcctgttgggcctccttgatgccgaactcgtcatggcgaagtctttgtagttcgccgaagatgccttcacccgagatgcctttactttcagaataccgacgcggctttccagccttcgccatcttcgcttatggctttcgccatagggcttcgcctgaatggccttgacatctttggcttgaatccttgctggtactatagtttcggcaggtccggtcgaagggcttcatggcatgcctccaacactaaacaacctagaatcacaattaatttgggatagaggtagtatgtgttaaattgttctaggctctcgcgtcacccacgcctaggcgactcagggacaaaaccctagcccccactgccgcaccttccccatccccccacctcgctgccgccggagcgtgtcgtcggagaaccgggcgatgagccaggatggcggtggaggggccttatcgtagaggcgccctgtctcgagcgtgggagaggcagcgtgacgagttgtgaaccggagacctggaggtggcagcggcacatcctccccggcgagggaggtggcagatccggcacttccgcgaccaaatctgatgctcctacggctggatctagtgcctccgcgtcggatctagctgg

SEQ ID NO: 47646 - DNA, 449 bp, Oryza sativa
aggttttattcctaattaactattctttactcacgattaatgaactttgaaatcaaatccaaataaaataggcgattaagatcggcatgatgcaattaatttaaaatttttcgaaggcccatatttttagagttttgtttttattggtcaaattttcagggtgttacagagcttttatggtcttcacgctagtagtagagactcgagactccattacctccatgctagactcgcctttgtttaggagagtcggagattctacaaaaggttgctgttgatagaagcttcccaaacatagccattagcatatacagtacagtactacagtgactcaagctagcttaagtcgcgtctagcactaaaactatattatgatccaaaagctcgaaaggtttagttccaccatcctatagctaccctcgtaacaacgctctaaaattctccctaga

SEQ ID NO: 47647 - DNA, 1501 bp, Oryza sativa
atgcaatattttatcctgagttagttttttaatgagggaatatctggagtttgttttgacccagccacatcccactccctgaaaaaaaggatgttttcccgtacttaaaaaaaaaacctgccagccctctagaaaaaccccgtcaactcaaaaaaaaaaagaaaaagaagggctctctagctctcatgaaaaaaacccccaagtcccaatccatctttttccttcccgcgattttctggcattccccccaaaatcatcgacccccattatcccatctctcccactccccatgtttgccggtctaattgtgatttcctcatctgattggagagatttatttgcccctccgtgagtttgtagcacccaattttcttcatttgttttcttcctcgcatgatcgctaacaatcccctgccgcgcgcttgcctcgacgcaggttggcacccccgtcgcactccgagccatcaggtgcggcacctcctgtagcccggtgcctgacacccaggcccagcactcctacctcgtcggagtgtgccgctctgccgtgccccgatccttcctcctcaggtaacatcttgattaatgtgtgcctaccagctgctcgatggaattcccctgtaagaattttgtcatgtcctgtgattttcatcttttgtgattgtatcccatgagcatctcaactaatgattttgaaagaatgttcatcatccttttggtttcttctactctccttgctccaggatgttggatattggattaatttgtttatggtttaagtaatacacactaaaatttgctctctaacttgcacatgtatgactcaagttcctgacgatgcttgtgtttctaattctttagttgctcgctactagatatttttattgcccaaaaattacgagtatctctagtagatatatattctatcatcagttcttcggattagaatatacaggtaggaattattaacatagtttaatttatgattggtactgatctcaggattgttttaagtggttagaaaattcaggtctcctgaaagtacggtggaatttgaatgttaataattgtgcaatctcaggattgctttaagtggttagaaaattcaggtcttctgaaagtacgatggaatttgagtgttaataattgtgcaatctgatagcaaaccattggcatgtgtgcaaaaattcagtaaattaaacaagctaagacacatgttgtttattcttttggtgtattgaagtgtagacagagtaaacaaattatagagaaatatgtactacttaatatgttcaagttatcactaataatgatttatctgggagcaattattttttgtatttaaaagaagatttgctattagtctacatctaatctttcctcttcttattttgataaacttcctttacataatctttcaaaatatgcatccttaccatataatttcaagtgtagggctagccattatttgcatgtcagaatagcttgtttagtgtgagattaa

SEQ ID NO: 47648 - DNA, 465 bp, Oryza sativa
aattcctgcagcccaaaaaatatcaaaatatgttcaatgttaaatgtaataatttggtgctacaagtattactatatttttctattaaaattattcaacctttaagaacgttggcttaaaaaggttaaagcagttattataatatgaaatagagggaatataatattactaggtattctacatatgtgttttatattagtactaggaggggtacaatagcagactataaatcagctataaacatatatcgatgagataaaagagaagagagaagagggcagtaggatacagatttataaccagttacagcacggacttaagacatagtgtatatatgataggtgggaccatgtattaatagtgtagtatatgtttatatataactattgtgtgaattgtctatttaattaactatagattatttaaaattaatagttggctatactagtaaacttgctctctagc

SEQ ID NO: 47649 - DNA, 769 bp, Oryza sativa
aaccccttctgtcaggcagaatactaattacattggagtaaatttacagaggcagagacccctcgtgaaatacattacctattctgtacaaaaaaggggagatttatatttccaataaattgacatttagtaagcattaacatagttaaactttgcgatgttgctgatgcagtatggtatcctagttatcctgtcatttatgtttttcccattttatgtttgctcatggtgtgtggtcagaaagtaaggcactgcatgtaaattatgtgctaatttcctttaaaaataagacgttacagcatcatctatgggccttctgtaactgaaacatgtagctacgagtaaatcactctatctaactctgctcatttagtaatagtctttactatgaatgatgtgaatgtttttatatatacttctgtagtttgctaatgatgattgatgactatagcagttcacatggtaaacatgatagcagatcatgattttgttactatattttaatgtgattgcaaattggtagtacttgtctcaatgtgctgagaaacaaatattgctaatttttttcatagaaagaaacattttttttgggtgtttaaactaattacctttgatgtgctagctaaatgcggaagatattcaaacacgcagcttcctgtgcagaagcctgtctctgtcagtgcttactgctaagcatttcaacatttagtccaaattgaaccatgttgttttggagcaaattgtgagattgatatgtttgttttttagg

SEQ ID NO: 47650 - DNA, 489 bp, Oryza sativa
tcctgcagcccaggaagtctgagaggatggtggttcagatacagagtgaatgagccaaacatgtacaagatgatggctttttgcaggagcaacaaatgttgatctctgaaccattgtatattgctgatgtaaccatttggtctgggagtcctggtgtggcagctcacatttatttttatagctcaagtgaatcatgacatagtttcatctttttctttttttattgtcaaatttcactactatgactgtatttagttgtctctgtattgtcaagtgacctcaagctttgttgggtgatgcctccttgccttaaaccggatacaggccttgatgatactgcaatatttttgttttaatgattaatcaatgtgattttcgcgtaattgatgaggttactgcaatatttttttactgaagtgaatttcatcatgttgcacttttcacttatacaaaaatatcggtttgcaatatttttttgctattctaagc

SEQ ID NO: 47651 - DNA, 1501 bp, Oryza sativa
aactctgtacttgtatttgtatcaccaaagaattaattattagcggttcttttatctgtttgttaagggtgaatttgttgcacctgttgcctacatgattaacatgaatttgttactgatgtagcgtttcatggtacctgtatagttttcagcattgctttgctttgctgcattagtcattcaggggaagaagaataactgaacatattagatggacttaagagttattgttcatgaacccaaaacagttcagatgatagtcctgacactatatagaactgaactgaataactgaagagcacaagaaatgaatgcaaaactcgattcttatttcagagtccatgagggagttgcagatttgctcatttgaataaacatgtatactactagattgcagggttgacagagtcatcagtattttcccctcctgatggtgtcaactggcttggtaaattcattaattaggactaaatgcggaaatgggccataggctgtcaggactcaggaatgaggagagacagagagtgagacctgcaggcttacagagtttcagaccgccacgttcatcacatgttaggaccagcaggagcaaccctgaagaggtacagtatgcgggagatgacggcaacacggtggatggggaacaggacggaggcggtcgtcaagatggcgtcttcgtcaaggaaaagcgtaatcgtcgagtgaacatgaagtataaggggtccgagtgggccgtctaagctttgtgggttatcggcccaaattcatgtaacgagagagagagagagagagagagagagagagagagagaagtaactaagaactatatgtaagctggcaacagctagaaggaaggttggcttggaactcggcaaggtggcgatggcggcggcggctccgctcggttgagcgtgagataatctatcaatctagttcgagttccacatttctgtgttcttgttgcgagaggctgttctgttgataagggttctaacaaaatctggtattagagctttgcgaccttaatctcttgattcgaccgtagaatcaccgatcggggattgagactcacctcctggggtggtgtctcgcgaaaaggcaacttgcctcgattgggttggtcgagtttggagcggtcgcgggatctggacgccagaaaaccacgctgagaaatttggggaaggtcaaccatggtgcacgaaacaaagttggatctcttgttgaagaagatggaggagaacgagcggaagagagcggaagcagaggagcggactcgtgcagatctagcggagctcaagaaggtggttgaggcgaggttgccgctagtggagaagcgtgtggaggaagtcgcttcggtggtcggatccttgagtacgaaggtcgaaaacatggagggtactctgctgaaacagggaagaatggagaagaaaccagctgatgtgaaggaagagcaattcacgccccaatcgtcgttccagattcaaggtatgcgagatcccac

SEQ ID NO: 47652 - DNA, 1501 bp, Oryza sativa
tcgaactcgaatgctgtgcgggatctttccttgattggcgccagtcggcatttgatgaagtgccgagtgatttgctctccctgtaagccttgttctttaagatttaacatacgatccaacaactccaaggcttgtactgcttcatctccgattggaagagagttccaagtatcttggcacactggaggaagacaagagtacccgggaagagcaggctcgggattctgaacatagaaccagtttgcatgccatcctttgttcgaagtcttgaagggcatcgagaaatatttttggctcagagttccccttagttggaatcctgcccccccgactacacacggtttgttcttgtttggttggggtttgaggaagaagatccggcggaatagggcgaagtgaggtttgatccccaaaaaggcttcacaaacatggacgaagttggcgatatgcactatggaattcgggtttaggtgatgcaagctgattccatagaaattcaagatcccgcggaaaaattttgaggtcggaagagcaaagccaccgtagaagaaatgcgagaagactacgatctcatgtgtatcaggggtcgggaaaacctcaccgcacgctggccgccacccgatgatctccttggctgggagaacgccgtgcgccaccatctccttcaggttctcctccgtcacgtcggacggcacccattggctttcgaagctttctctctcttccgccatcgatttttctcaaatgtgctgatttgattcgagggatggcttgggagaggtgaggaattgaggcggtggatcacgggaaggattttgatgcacttttcggaggtggatttggccggagttgtgaaccctagttcgccggcgcagcttcgcactgtagcagggagtggggaaaatggcgagagttccggcggggaagacgaagcgtcgcttggatataggatttttcagttaagggtatcggaggtgctaatgggcttaggcctgaacagtacttcagcccaatacttttaacagcgtggcccattgtgttccttagggacttaggcatattttgctttggcaatattatgcgcacaacagtgttgcccaatgctgatcaaaccctttttatgcggtcatataattctttggaattattgcaatgcaaattaaaaaggtgcccgacagaaaggcgttatgctgtttttgcaagcttttttaggctacaaaagctgtttgggttaactaggaatgacttgtttttattataatcatttccttggcgtgttatatgcctgttttcatggtaaatagtcatggcctaggctattcgacttatttattaccataatctttataatacttgatgggtaatctttagaatttttattcggatgcctgtcaagtgtgttcattcgtgaaccttttagagtgtaaaccactcggatttcttttattgtggctaaaaagcagtcggttagcatgcctattttggcgccgcatatgctttt

SEQ ID NO: 47653 - DNA, 1501 bp, Oryza sativa
ataggcaagattaccttccatggacaaaacccgtcgtgacgaagcctatcggtgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtgtgattcgggaaaaaccaacatatgcccctataggcgcccagaccccccttatatatgggaaggagtccgagttacaaaagataacctatatcccttacggaatatgaaaatataggtaagatacagtcgtaaccgactaagtttcagggtgtttccatgatacacaagttaagaaacaaacccaagatacaaataagatattctatctacgttaggtatcctgtacccagttcgaataccatcgccgtgtagatatgggatacccataatctccacagtagcccccgagtcctttgcagtcgaccatcgtagccttctcaaagatgataatccgagtacttcaaactcttcaagccaaaacctgccgagtggactgtaaagggcgaaaagaagaagaatatggtgcatcgaatagatgcacctaattaggtgtagcccccaactatgtgattagttaacaaactaaacatatagttgaaagacaaaataacaacacaattgtgcattatatgacaaaagcatatgcggcgccaaaataggcatgctaaccgactgctttttagccacaataaaagaaatccgagtggtttacactctaaaaggttcacgaatgaacacacttgacaggcatccgaataaaaattctaaagattacccatcaagtattataaagattatggtaataaataagtcgaatagcctaggccatgactatttaccatgaaaacaggcatataacacgccaaggaaatgattataataaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaagggtttgatcagcattgggcaacactgttgtgcgcataatattgccaaagcaaaatatgcctaagtccctaaggaacacaatgggccacgctgttaaaagtattgggctgaagtactgttcaggcctaagcccattagcacctccgatacccttaactgaaaaatcctatatccaagcgacgcttcgtcttccccgccggaactctcgccattttccccactccctgctacagtgcgaagctgcgccggcgaactagggttcacaactccggccaaatccacctccgaaaagtgcatcaaaatccttcccgtgatccaccgcctcaattcctcacctctcccaagccatccctcgaatcaaatcagcacatttgagaaaaatcga

SEQ ID NO: 47654 - DNA, 389 bp, Oryza sativa
tcctttgactgttgggttgtcaacgctggatgagggttttctctgcttatttttggttgccccgttggaagattggcttggttcgttgatgaatttagagaataataaggatataataatcccactatttttagagtctaattgttgttgttaattatttgtgtgttttgatacgtgatatttgcgacattgatttgttataataaaaatggtaaagtgtctttccttttggagtagtgcatcatcgaaatttatctatttttttaaaaaaaaagaactgtctgtttatttcattattgtttttctaaactggaatatgtagctaccaagatttacaaaaccacacggttaccacttgcagtaacctttttagtttttaaaccacggta

SEQ ID NO: 47655 - DNA, 151 bp, Oryza sativa
cgcccactccgccctcattgccgtcctgagcgccggtggctgtgagcgccctattcgccgccgcccactccgccctcaccaccgtcctgagcgccgtggctgcgggagccctttcgccgcctcccacttcgccctcaccgccgtcccaagc

SEQ ID NO: 47656 - DNA, 258 bp, Oryza sativa
ttgtgtctaaaaatagcacaagctcccatgcatgtccattccatctccaaaagtaaccaccacaaaaacccatgagctcatctcactctaccacttgtctactccgcagcccaataaccaccattgttttctcatctcgacatgctaacagcctaatactgctattattcgtctcgcttcccatataaccacaggtataaccgccacgagagagctctctcccacttcttccttcctgcgcgcctctccaaaccacca

SEQ ID NO: 47657 - DNA, 1501 bp, Oryza sativa
ttcaacaagagtttgaccacgatggttttgcccactggcaggtgatagatagctcatccaaggagatgctctccagccaattgcatttttgtaagtaaaataaaagacaggtggcaccaaggaatagtggaagccatggagaggaccaaatcggaagcagtgagaagaggccggagagatgaaagggagatgtcagcattcagcaaaagagaccaatctccaaaagcaacccgtcttcttctcctccacagaagttgatgccctggagccccccaagcatctaccctcttgtgccttggatcttacatggacctagctcatggaccaaatgctgattagttgattttctcctttattccgcttaatttgctgtctatgcaatattgcaatatgcttgtggtttatatagtactccctctctctgtcccattttaagtgcagctataattttctatgcccaacttcaatcgtccgtcttatttgaaaattttttgaaaaaaaaattaaaaacataaatcacgtataaaaaactattcatgttttatcatcttataacaataaaaatacttattataaaaaaattcaaataagacagacgattaaaattaagcacggaaacttatagttgtacttaaaatgggacggagggagtacataagagatattacacttgtaaatttcctaataaccacatttaaaacttgtattattggacttgttgctaatgaaagtatggagcgtggattttcaaatacatcatcatatattgaggtactcgataacgctatgcagtgttgcacagtagcttacagcactgcaacaacttcgtaatcatgctagcacactgcaccagcacaacactgtatagcgcaaccgaacaagtcctatataggtgggtgaaaccatgtatgtttatcatatcgccaagctagttggctgctttggcaagtcactgataaaatctaacaagcgagcaattggcattagagaattggaattttctatagtacatgtgcatttagtacatgtattcctttaaaactttacagtttactgctcagcgcttaaaaactaagttaaaattctcataaatttgaaaattaaaccacatacacgtaaaatttagctaatttaacttgtgcctatgagcctatcactatatacatactttatcacttgtggagtttaacttgtacggttttctgaaaccttccatttaaccttgtccatagacagcgtccacccagcagattaagcaggttaacggccaagaagagtccccggcgtccccgcatctgaaaccaacgctcactcctccccctccactcgcccgcggaatcttccttcctccgattccctcctcctcttcttcttcccctcctccacctccgcgccctccacctgttcgacgaaatatcccacccaccctccccctctcgccgcgcaccgccgctacttatacccgccattttcacctcgcccccccgcgcttcccgccact

SEQ ID NO: 47658 - DNA, 1501 bp, Oryza sativa
aattaaacaacttgtaatataaaacggaaggagtgtcattttcgactctttaatcttaagatactctatatataaaataaaaataaggccatgtttgtttggggcccttcctaggcacctaaatagtgcacaattaattaataagtatcccatccgtctaaaaaaactaattctatctacgaaactagacacacatgtgtctaggtttatagctagaaattcgtttttttatgtagtagtagtaggtaaatttttttaaaaaaacataggaattggttattttgagaccaactgtccccgggtaaactatagaatcaatcaaattagaaaagagtagtactagtagtaatgataagggctttacacgtcagaatgacacaatagctagtagatcatgccagctggacaagctacaaagccgtacgcctcttctctctctctcttccacagcgttcacttccttgttttcttcttcgagagagagaggggcagagacgccgcgcgcgctgccctcgacgctcgagctcgctccccccaccaccacctctccctcctccttccgagggcgcgcggatggcgaggcgcgcggcggcggggctcctccgccgccacctggggcccctcgccgccggcgagacactgcaggcgcgaggtgagattggcttaatttgctcttcgcctgcccatgaccctctcgctctccccccctccctgctagggttcgaacgatccggtcggtcatggccgctcgctcgctgtgtgtgtggtgcggggaagtgaggactggggagtggtagtggttcgtgaactgctgtgaactactaactttgagttgcagcaacacatacgctgtaaatctgaaacagcagttggtggttggtgatctcggatgatttcactttagtctcgaggagaaaaatctcgggtgtgttttgttgttttaaatgggatttagtttgcgaccggattctagtttggtataaggaagtagttaagtgtacattgtgtactagaaactattataatgtgtgttttattagctcgaattttgtgtatatgggcttggagaggttgttctcgctggttaaatgtcttggtaaaaatgtgtatatatggcatcacatccattggaaataatgcaagtacgattgcctttgtatagttctatgttgaaacagtcgcatatccttgtttgcactatccatgctccaatctttctagctgaagtaggttcgcaactagttttcgacatggtgaaagcattaaggtttctgagatttcctaaataatcttgtacaatttaattatttttatagcatttttgttcctataatttattttatcagacagaaaatcactagtttccatgctttgttaaaactccaaagttgagttgcaataaatatattggatgatacctgcaacttcatgagatgcttttacctgaaatattatgatcaatgttgctttctaggcatgtatcctaaacaatatggagccg

SEQ ID NO: 47659 - DNA, 368 bp, Oryza sativa
aaagctgatctctttcccttcttttctggctatcattatttgtatggcaaatgctaacacttaacgccttgttgatctgaataacagtaatgaaatctctacctgtcattcataattattcaatccatgaaccgagaacagtcaaattcgtctatcttacaatccaaattccatcgcgaatggagtatttttttttcacaagataataggcatagggagaacaagtggcttatttaagctcagatcgagacctatcaaaagacgagaagaatcacattggtgccacgcagataaatcacaacatgaaaaatgtgaatcatgcaaattcggctaaattccacttatgttatctccttgctatgtacaga

SEQ ID NO: 47660 - DNA, 376 bp, Oryza sativa
gtgctcatttctcaattcattgatagatttgataccaaggtgatgaacttgcttgttaatataatggacaaatcagacactttagatggctccaatactgctatagctgctattgattctggctctgtagtgaatgatgatcctcctgctcctgctactcatgctgctggtccttacaatgttgttgctcctggtgctgtcggtgcttataatgttgatgctcctagtgttgttgctcatggtggtattgattgggatgaactaaacatccagccattgacagttgaaggtggatcctgtcatgttacatttgatgaggatgagatgtttgacatgctgggactaggtggttctgatattggagcagatgaggcaa

SEQ ID NO: 47661 - DNA, 193 bp, Oryza sativa
attcctgcagccctaaaggatgagatttgtgccttaccccggcgggcactcagatggagccataacccccaaaatccaaaccctagacaatccaatctgcaacaaaaacaaccaaatctgagacaaattgttgccaaactgaaaaagagaagggggaaacggatttatctcacacctcgttggctgtcgcagc

SEQ ID NO: 47662 - DNA, 724 bp, Oryza sativa
tgagtctttttatttatctttctccgactcactcattgattgtgtgtagggctgtcaacgagccgagctcgagcgagctcgtctgcctaggcttgagctcggctaccgagcttgaatcttaagtaaaacaatatatatttcaaagataatctttaaaaaaataattaatttctagttcatcatattaatagaagaggaaaaaagaataaaataaatatatgatgtcaatataagatatacaaataacatatttgaccttctaatttattaaataacaacaaaaatcatatattactaagctcgttggaagctcaagctcggctcgtctggagctcgagccgagctcgagcagctcgcgagcctcaagctttttgacagccctaattgtgtgtctgttggtagatatataatgaagatgtaaatcattttcattttttagaaaaaccacaccaagtctataatacttatgaatgggaaaaggcaaatattgtcgaaagagagctttgtgcaagacgtactcatttaggttgacgttactccaaatcccaatctctcttgtccctgtaacccaaattagctccaaaagtgaaaatctagtccaaaatcaatgcagtcgcgtcgggcgagcccgactctgtttaggctgtgtttagttgagggggaagtttggattttggttgaaattgaagatgatgtgactgaaaagttgtgtgtgtatgacagg

SEQ ID NO: 47663 - DNA, 406 bp, Oryza sativa
ttttttcccggttgatgttatcaaccgggactacaaatagatctttagtctcggttggtaacaccaaccggtactaaagattgaaaagtatcctgtaacttttaaaccgggactaaagatatttttagtcccggtttttaatacaaccgggactattgtaaaatctggttgaccgaccaaagatggtttctccaccagtgtcatatcatttgattcattgttaaatatactttcatgtacacatatagttttacatattttacaaatttttttaaataagataaacggtcaaatatatgctaaaaagtcaacggtgtcaaacattttgaaacggagggagtagcatggatcagctgccggagggcgatcgacgaacgatataaccctatatccgtctggctctagc

SEQ ID NO: 47664 - DNA, 213 bp, Oryza sativa
ctatagggcgaattcgagctcggtacccagatgcaacaaatgcttcaatgctactttacccatattttaatcatgcaagatcatgttcagatctacaaattcttaaccctaaaacccattagaataaggaaggggggacaaacaaagtaggcattaaaaaaaatcctcaaaatcacaagcattcctccatgttatccatcatctacaagtagg

SEQ ID NO: 47665 - DNA, 1501 bp, Oryza sativa
tcgagaggagaggagaaacaaagttttgggttccaaggaggaggcaacttgcactgcaaatcttcaatgcagacaaaaaaacacagtgccacagccacagatcctattcctagacagagggtcaggtgtattacaaacatccataaaaaacagtttcggacttttcaggccggatcgaaaatcataagccgtttataatttttaagttcacaaaactcatattgaattttaatactctttttttacaaagtttgttttttattgtttctttttcgtttatcaatgatttttatgaaatctgaatatacaactctcctcgtatttgcgagaaagtgtctgaatggttgagctcaactaataaaccataaaaatataaataaaacattaaaaattttatatgtgtataatttatgttttaaaagctaacgttgaaaaatatactattctgaaaaaaagccccaaaatcaactttccaaaaatttcattttggctacagctaataaaccaacaaacatgaaaatgatttatcatcaattttgtatatggagttagtaatatcacaccgagcgagtacatatataacttaaaaccaatatagtggataatggatataccagatacgaggagaaaattcagataagtgtagtgtggtgcaaaggtgcagtgagcattcaacacagatgtggcctaaaaaaccggtcagaactcaccaagttcccaccaacacaagcacatgaagaaaaagggcagccacagctgatgccaatcaacatcacatccagccaaaaaggagcacttttctaaataggagtatatactaccaagagcagcaataatctccaaaagatcatctctaggagtagttgaattcttctgaaccccaatattctaatgccaaatattcagaggccacttaatcaggcaaggagagtttagtcagggtgtgtcaatagatcaacggctttcccaagttggtgatggtgactgcaacaattggggcagattgatggagacagatggtgagaaggcaaaagctatccctgtttgagatcatccctgcaccaaaaatccaactcataaagaaattcatattttgcaagtgaaattgtgggaacaaaaggaaaaaaagcccaaagccaaaagccaaagccaaaggcaagacagattgtgacagattccatatattgttttgattgtttgctcctatctctaaggaactctccaacctgaaaggattccaacttgaaaccaaagcttgctgcttcttttctctcatttgtctgaaattcatccattttttcagtagacaaggcaagaaaaggcaagttgtgcaaagttttgttcttcagattagcttggaggcaggcaaaagaaaaaaataaggcgccaaactttgtgtgctcctggatcataggaagaaatatccaagagattggtaaaaaaaggcgccatttttgagagaaaggcgtttccttgcgatcaagctggtgatgtgatcgaa

SEQ ID NO: 47666 - DNA, 309 bp, Oryza sativa
ttgcgatgctctgaatattccgccttaagtcttgttaattattttagagcaaagagaattcgaaaaaaaattatccctgacattttcgattattaaatacattgttaattaggaaactacgaaaaactacgggttaaccaaagtaatttctatagataatttgttggtggattataaactacgggaaacaggaaactccgtgtgtgcaagagcacgtgtatttaacttgcacatctaaatttcttttcgaaaatcatgcacatccgaaagaggatatttattctcatattctgtatatctcgtgacaga

SEQ ID NO: 47667 - DNA, 1501 bp, Oryza sativa
ccattaaaattggtttattttgctgtttcagtagccttattgcttgtatttcttgtgtgttttgtttgtcgtttagattccgtcagttccggtgatccagtttattttgaagtggttgccaaggtttcatcagctcaagagcaaggcaagtcatacatacaacattgatcatgttgaacctattttacaaaatcccttgctttctattaaattgcattattttagaatgggatggatgcctatcgtactctacttgttgaatattttatgccattgataaattgggttataattgactagatgattgggttaggaatgcttagccatgcttagattaattagctcacaattggattcattataatttagtccttaattatattatgatgtaccaccatggttatggtttaattaaactaaaatatactttaatggtgggttgtgggtacatgcatgattttggaagtcgtgcccataacaattaaggaccggttctcaagaatccctggaagatatactcgtacttaccacatgccagcgtgggctccatgctaaatctagagtataacttaaactagctgacatatcatggcaagggtagaggcgatggtgcagttcggacctgtattttggtctttgttgcttccgaatttacctatgcatgagaggggactgcccgacttggcacaaggagagggtgaaacctgaggtggttatgttcggttagggaaggttatatgacggtttttgtcacggtttcccctttgcagtatcgtggcggtacttcggggcatggtaacatgtgtggaattatgtcttgtgggtaaaattgtacacctctgattagagttaaaactattcgaatagccgttcccgcggttgttgggcggtcaaccagctcaccatgattagtttcactataataatttgacctatagaactggtgtagttcaggtagtttggttgggcctgttgcaacgtggttttagcattggacaatgatgatttaatatttcttaattatatacttcccccgtcccataaaaaaccaacctagcactggatgtgacatatcctagtacaacgaatctggacgaggaggggggggtaatgttttacttattcaaaatatgatttataaatgctgcttttactgcaaatatccaatgagccattcctttgagaataccttgcatcatgccttcccgttggtatgacttgttgagtatggtggttggtactcagtcttgctttatcccccccccacagaagcagagattggttcagatggtgagttctattaggattgagcttgttcaggacgtcgaggatttcctgtggtttatggaggaagcttcttttggttgtgaagattaagtctagtttttttcttgtttttccgctgcgtttgtgagttttattttattatttttgtaagatgtggaactgtttatcaaattgtcatttgtatactctggctagtcttggatagagatttagg

SEQ ID NO: 47668 - DNA, 1501 bp, Oryza sativa
gctaatgacagattaattagacttaataaattcgtctcgcggtttactggcggatactgtaattagtttttttattagtgtccgaacaacccatgtgacatcctatataatacccgatgtgatacgccaaactttacacactgatctaaataccccctatacggttgtgactatgttttaagttatagtggctataaatatttcttcctccgatttcataactgtatattttagacaaagacacgatttacaaaaatttctttgactatgatatatataaagtaagtaaatgtttattttattaaaatgattttttaagactaatctatacatcttggtttagtgaatttaaaaatatttaagtcattgatagttaaagttttaattgtttgacctcggaagctgcatggaagacacgtgaggctatgaagaggacagacagctgcaccgaatataagaagtgtttgcggaagctgcatttaaggcaataattagtggttaggtgacgagaggtcccaacacaacacttcaactcttattagttctgaaacttgattctggacttcatctttcagaaagagaaaggcatgaaaattttgagagttttgaggcctcataggattctcacatagatatgcctttgctcttgaagttctttcttcctgaagttctgtttcgtcacagacatgagtaaaagggcgtaagagttatttccagctggcctctagtgtgaacatgcctattcggttttgagaaatttcacaggaatttttaaggaattgaactatttcctacgaaaatcttgtaaaattcatgtattccgaaggaggcttcaacattctagggatggccaagaagtaagcaatacaagttttgctaaccatcatgacatggattgattatccaatatacaccgacaggtatgcaaactaaaccaatcgtgaatcgtctttcctaacatagagttgcaagtttgtattcgtacttctcacttctttttccttctgaagtgagtttcttttttttttcttcttaagtgagttatatctgttggtgatgctcttatggtcaatcttaggattgtaacctatatgttggtgatgctcttatggtcaatcttccagtctagatgttttttttccctggggatttcagtgctaacttgaggtttcctcccatccttagaaggtatataccttcttaccacctatatatggtagttatattttcagctcaagctagctttgcataaatatttccttgcaacacatggtaggagtatttgtgactgcgaattaatacactatacttgttcttatcctataatctcgtcctattgtagaaccagactcaaagtgctagcaattgcaattaatggctgaggctgtgattcttctaaccgtgaagaagattggtgttgccctggggaatgaagcaataaaccaagccacatcatatttcaaaaaatctgtcacacagctgacagagcttcaaggtagca

SEQ ID NO: 47669 - DNA, 1501 bp, Oryza sativa
tagacctttgtaaatcggaaatacaagagctacctggcgggatagttaagctaaagaaacttcgacacttgtttgctgagaaattgaacggtaagttttggcgagatttccagtggagcactggtgtacgcatccacaggggactggagatgctaagcgagctacagacgctgcaagcactggaggtgcaagatgaacgatctgtgaggagcttaagggagctgaggcagatgagaagcattaggatattgggtgttaagggaaggtactttgaagacctctgcgagtccctatgtcagatggaatatctttccttgttaaacatcgcagcaagtgatgaggaagaggtcctccaattgaatggtctgaagtggttgcatccaaacgttaaaaagctaagattgattgggcgattggcacaaacaggactgctgtcgtgtgcacctgaagcagggagtcactcattgtgttcattatgtctattttggtcacagttagcagaggacccactgccatccctgtctcggtggtcgaatttgacggactttaggctgacgagagcatatctcgttgaacatgtggttttcctcccaggatggttccctaggctcaagacactctatttggtagacatgcctaatctgaagaggctgaagatacaccaaggctccataacaagcctggaggaactacatctaataaacctccgtggcatgacagaggtcccatctgacatcatcttcctcctgcccaccctcaagtatctgtacttcctggagatcacttgggacttcttcatggcgttgcgccgctctagaattggcagtatccgatggcgatacagtctagcttctgatgcgcgcctctgatgcatgaatggatgaggggatgataaatggatagatgcaggccgcgtgcatcgaaccgttaggagtgcctcacctcatcgaccgaccgtggttgcatctgctgcctgcatgcatgtgagcttattcaactcgtattgcctactttattatggcttaatttgctatcgttttaattacaactacgtacctctactactagttcagtggctcagtgcttgcaaaaatatttccattgtgattactagacattcctgtgattgaatctatttcgttcctgcccaagtttaactgtaatattcagtaatagtacaactcacactgtataagcatgcatttaatttctcacacatttatgcagtgtagctagctgttgctagctagtagaaataaaaggaaccaatttttttagagcaattttatattctttgaagaggtaccataagctactaaaaatttagtgtaaaatttagtacctcatagtatcaaggggtaccaaatatagtaccagatcgtatcgtcttctttccctgctttgttcttgttctacggtttgaacgttttaccggaaggagatagagggaaaagtgtaggtatggttgagggttgaataggagactagatcacatggtcga

SEQ ID NO: 47670 - DNA, 651 bp, Oryza sativa
ccttttcatttttacgcgtggaattgaagcttgatcgaatgaaggaagggatcgaaacagagcaaaagtccaacatgatcgacatatgctttttgatgaaatttccccaaaaagcaggttgtcgtgtggcataatatgcattatattcaagctaagtaaagcgcaagtgcatatattccttggcgtattccactctagctataactcaatcttttcctctcttttcgcgatgatcaaaattcagcgcgtctgatggtgttggcagaaacgaatacagccgcacgatcgatttacgggtacaattaattgtcccccttgcaagtggagcaaacgcctgaaatgaatcgactattggtggtgctaagcttctttcaaaaacactattggtggtagcggttgcactactagagaaatgatctttgctgggtcaacccaaaaccacaatagtcccggttacaaaaagaaccgaaactaaaaatgatttttagtcccgattgaaaaccccacagccattttatcatctttagtcccagttggcaatcgggactaaagatctcccggttcatcctttgtcagtggcctgttagggggccgagaatctttagtcccgttcgtaaagatgatctttaatcccggatggtaatcctaacc

SEQ ID NO: 47671 - DNA, 1501 bp, Oryza sativa
gtttgggaagtcagcgagtagcaaaataagttgcctggaacatctacagactctgagaagcatagaagccaatagctacatagtgaaaaaccttggatgcttgacaaggatgagaagtgtcggtatcatgaaggtgctggagtcccacaacactgatctatggacctcaatcagcaagatgacatctctgaattcattgtctgttctcgcagaagatcgtgatcgatacgcccttgatctcggcaacttaaaacctttatctcacctggagaagctgatgataagtggcaggctacacaaaggagcaattcctcccgtttttgccagcttcaccaaactgagaagcttgagcctctgcttctctggtcttcatgaagatccgctcgcttcttttgctgccatgttccagaatctaggccatcttaacctttaccggtgcttcgacggggcgaaactgacatttcgcgctggatggttccctaacctgaaacacctgtacctgagctccatgaatgagctcagggaggttgaggttgaggatggcgccatgagaagcttgtggagacttgagctttggagcttgaaaagcttaacatctgtgccacagggctttgtgcatcttaggtcactccagcagctgtgcattggatcattgatgcctgaagagttccacaggaggttagagggaatcgatcggtggattgttcggcacatcccctacatcggagacccgtgatcgcgctgctaccctcacaagcatgataaactgtgtatgaaatttcatgattggatcggattggaggctttcttaagaaaaaatgttgtcttaatctgttttaatgcaattttgaagggtcatctaatttatgccacacactgcaatagtggcagttcttgaatccaataacactggaggtttattttgcgaaacctgtgaaatgaaaattattctgacccattatgcggaatagagagtaatactaataactatagtagctctgaatctcttagaattacaacacggcagctcaaactccagtcatatgtgaacttttttttttctttttgagattacacagcagatgcacacacactccactatacacgcaacaccacactcacacccccgcgaatacgtcccctcacacatgctctaagagacgaaaaccagcgcacatccctgatttcactaaaatcctattgaaagcccatctacatatgtgtaatattcgtgggcatcaggatttgtaccctggttggtggagtcatgcatccacaaattcaccaccacatcactgatgcttcccccagtcatatgtgaacttcaaaggctgaattacaacaaaagaacacttgtgccctgtcattattcaggattttctttttattatttgcaaggatccattcattcagaactgaatggattagtatggcaaacacactgaatttgtagggttagcgccctcgcagaaaatgattattacataatgatcagattaat

SEQ ID NO: 47672 - DNA, 1501 bp, Oryza sativa
catagctctatttgcaaaagcaactgctgaaggagacagtccgatacttcttgagtagcactcaatagcctgggcaaactttttctgtttgaaatactcattaccctgaaaaaaaatcaaacagaacaaccaatgttttagcttcaaaggattgtccctctacaacagtctaaagtttgaacagagtagcaagagatgcaatacttaatcccaacctgttccttttctgatgcggcatcaggcattggctcatcatttaagtagcttgagtagttcgcataattgtcgtaccgatcacccagatttcctggggaagctcctgaagacccgtatgtccttgccctagcttcctgcagacagtatattctgatttattactgaaccaaaacccccagacacaagagaaaaaccacttcatttcaaactcaaacactgacaatagatatataggttcgaattggagacatcttttcatcttgcgcaatcgcatcgaattagttgatgcatcctaaaagtaacctcgaactatgccatcgagacaagttaattccaccaaaaagaaacaattatcagtgtgaacctgatgctccattaaaacgaacctacatttcagaccaattcactagcatacgttcatactttccatgcgagcatacattgggtaaaccaaaaaaaaaaagagagagaaaaatctaggtttacccaagctgtgacagtgaatgaagctacagggagagggaagttttactaaacctaataggggcaggagaggtcatgagagctcgtaccatatccccaagtcgcctcttgctacacctcgccggcgtcgcctcccgcggatgatccaaccggccgcaggagcagcggtgctaacgccgaggaggagctcctcggccgcgcgcgtccgaggcggcgtggcgggggagagggcccggccggagcgtgcctccggctcaggcagggaatcgagagagagggtgggaagcggcggcggtgacggcgttgtcccgcgcgccgacggcgagacggccggcgaagcgaggggaggggaagggcaaaagtaagggaagggggttctggaatgttccggagatatcggggacctaattgcaaaaactgcacgggcttttcatgggccgagatgtcccaagcccaccgatcgcacgggtccaagactagggggaataaactcctaaatatgggcctaatccattaatgaggaggccagcgatgggctccatttgcaatattctatcttgtctctttttatatgaaaataataatataataaatatctactaatatcttagtaggagtatttcttttttccgaatgaattgtactagtatgttgtgaattccgtcatgttttgcacggtttgtagagctgtactgatttactcagtgctttcaaaaaaaagtttgaaactcatgtgttccaaaacaattttcggcttccaatgttcaatccaaagtccaaacctcaaaaggtatttttcagc

SEQ ID NO: 47673 - DNA, 1174 bp, Oryza sativa
ctttcaaaatggtctcaaatacatcgatttggattaaaaaaaacattgtgagaaagatatttataatttactctattttatattacatccattttcgagcaattgtcatttttactgcacaatcaaatcttaagaatacgttttgtcattaacatacaaaaaaagtcgagagttgtccagtgaaaatgatataagtagatttctcatgaaaaataatttgatatcaatgtactttcattatatcttcacggataaatgaataagaaaagtaaccattaaaggtgcatgttatagatcatatcgatgttctaaattataacaaaacggaggtacagttgacagctagctagcctccaactgcaacgtgattttacatgtttaatactattcacccaagtcataaataattattgctttgatatagacgtagctttctacagaacatagaatatttgtaagacctaataatactagcaggattagtaatatattagtactagagtactcttcaagacaaactaaataactaatcatgctgtttgtttgtgcatggccaatcaaaatgttcataaagaaaactattattttagcttcattaaatagatatatcatatattcaagtcattaagtaatttggttcacccatggaaaatcacaaggatcacacctgcaaaattgcaaccactactttgtaagagaggcttgcaggagtccacatcatcattgaactcacaggaaaatggtggtgaggctctgaaacagtaaccctgaacattttcagtattgcattcaattattggacagtgaaaacatagaaaagaaaagagtagcaaggcagagagggagatcagcaacttgctccagcctttttcagccaacttgtggtgtggtgttggcacttggcagtcactatatcatctcactgttcactaacatattctgtgcccttcagagtaatagtgccattgctattatctcttcaccagctatatctcttcttcctccacctgctgccatatgcttgtgtagtcagtgttgcagaaatgacaaagatgagcagcatgaaagctgatggcagtgtccccaagagaaggtagtgttagctagcacctatatcctttgcttctgcttctgcaaattctcttgtgattgtgttgtcactgcagctgtctat

SEQ ID NO: 47674 - DNA, 1501 bp, Oryza sativa
ctgtgcatctggcccctcacgtgcaactgcaagctcaactagtcgctgcccaagtacaccatcaaccacctggccaagcgccacaaacagtggtggaaggggcttcggctctgcaggcgcaactccaagctttccttcagcgactcaaccaaccccactgcatttcaactacaaccccatcggcccacccggaggggaatacaagtcaaggtacgcctaattggttgccactgattcagccgggcctgggagtttcgccgtggaatcaaggaccgcagttcgacttcgtcaacgctgctcaagcgccaaccgttcggcagcaagctccgactccaggcttcggaacaaaccaagcaccaatccaagctgccatgacgtggtcacagccgatttttgacccatccatggcggctcaacaagtacctccagttggtgccgggcagccgaatgccatggcccaacctcacgcacaagctacgatttcgcccttcgccacaccgtacccgcagcaaggtgcggtaaacagggcgggaggcgaaaaggggctaccgctgagtgggggaatcaagactcgtccaatcccaccccagttcaagtttccacccgtaccgcgctattcgggcgaaaccgacccgaaggagttcctctccatctatgagtcagcgatcgaagcggctcatggtgacgaaaataccaaggcaacggtaatacatctcgctctagacggcatcgcccgttcttggtatttcaatttaccagccaatagcatttactcatgggagcaattgcgcgatgtttttgtccttaactttcgaggcacctatgaggagccgaagacgcagcaacacctcctcgtcattcgccaaaggccgggggagtcgataagggagtacatgcgtcgcttctcgcaagcccggtgccaagttcaagacataaccgaggcgtcggttataaacgccgcatcggccggtctgctcgagggcaaactcacaagaaaaatcgccaacaaggagccacagacgctcgagcacctacttcgcatcattgacgggttcgcaaggggcgaggaggattccaagcgacgacaagctatacaagctgagtacgacaaagcctccctcgtcgctgctcaagctaaagcacaagttcaagttgccaaaccacctcccctctctgttcgccagtctcagccggcgatcaaaggatagccgccaaggcaaggccaggcccccataacttggagaaagttcagaacagaccgtgcgggcaaagctgtgatggtggtcgaagaagtgcaagccctccgcaaggagttcgatgcccagcaagcgagcaaccatcagcagccagctcgcaagaaggtccgaaaagacctctactgcgcctttcacggacgctcttcgcacaccacggagcaatgctgaaacattaggcaatgtggcaacgcgcaagacccaaggccgcagcagggaacaactgtcgaagcaccctgcgaagcagt

SEQ ID NO: 47675 - DNA, 382 bp, Oryza sativa
ttagcttaatctagcgctagtggctcaagatgagcgcgaccccggccgttctgatgcttaattgtgcttgcgccacaactaagtggacgattatatttggacttggaggatttccaaactgttgctgagtcgttttttttttgttgccccgctaagaaaagataactcttcggtacagaagaaacatgctaagatagtacattttgaaatgcctctcgtccggggaaaggaaaaataaggaagacgtaaatttaacctgcagctgtatttgtacatcacaaaaagtaaaagaaaagaaaagaaaaagttataccccacaccaaatagctgaaaacgtggttgtctgcatggatctcatcatcaagtagtgttcgtgactaaa

SEQ ID NO: 47676 - DNA, 1501 bp, Oryza sativa
gctgcaaattattggtgcgccaggaaggaagaacacgagccaagcaattaaagtgtatctgcatgagcggccgggccgggagcccgggagtgagcgcacgacacttcatcaaggcatatatgcatgcgattgtggtaattgattaccaatgcatgaatctgaacgagtacactagctagcaagcagctagcagctgaatctgaatgagactagtagctagcaaagcatacatatatagcatagtacagtataacacagtaacctgatctgaactttctggtgattatcactacgcgtccatgcgtcaaatgcgtatggatatgctaatataatataggtgtccaggaatatgagatagagttcgctcacgtgtaaaaaaacatgtggacgagtggagaaatcaacagggcccgattcgttggaacagctggtgtgcatctcctgaaagttgcagctgcccgcccgttgccaaaccaaaaacatcgcaacttggcaaagtggcagtcctcgatccgatcggccctccagtacgtacgtatgcgcgcgattcgtcacagatagacgaaataactagaccgtgtcgaccgaaaccgaacgaccgaactaagcagcagtgggggagcacagggcgagatcgtcgtacacatggggtgtctcgtcagcgaccggcaacagtactgggggaaaacagcggccggatatatgaacaggagtcaggagatgcacgggggaggtggtttactgctagcttgaggcgcatcacgatttcgatcgcgcgcgccaatgcgtgcatgcacaggtgttgcgccgcatcgacgcgggcacgtgtggttgctatctagctttggatggtggggtgggacggccaggagaggtaaggcgggcggcttgatcggaagctggaatagctggggcctgggggagggggacgggacaccaccatcttatcctaaagagatccagaacaaaagcgcgttcaacaaaaggtgcatttgatctgatgggcgatcgcaaattggcgatcatctctccctgtagatatgatgcgtacagccatacacgctacactcgggccgaggcatgtgttttcataattaaacgggccagtctgtgggctttcttctgaatgaaaccgaacagaaagtgggccgtatgtgccacgggccagttgggtccgttggagagcttaatgggcctcctctaaaagaacaagagaaaacggatcaaattgacagatcctgatcgtcctcatgtagtgagcaatgttttttccgagggaataagttcacttagtgaccctcaaaagtgatcgaaatctaatccgtggccctaaaccacaaaatcggatatctcgacccccaaactcttaaaaccggtgtaatttgactcccttagtggttttggagagcggttttgctgacgtggcgcctacgttgcggtattgaccggttctcctttacacgtggcgttgacatggcatttaggtggcatttagaattaa

SEQ ID NO: 47677 - DNA, 1501 bp, Oryza sativa
tttgttgtattagaaaatatctcatctaatattacgttgattttttttttacggacggagtactgccattttctattaaaaaattacctcatttcattttcactttcttttatccggatattcatatgatgatcacttaaatattagtttaattaacctcttcaataatcaaacagatttatcagtggtgcactggtgccgtaacattatttttttataaaaaaatactcaagatatgttgtactagatacattggcgaatcatctttggtatcgtctatcgatattatagtatgctaattatatttagaatataatgttataatatatgaataagcattttaagcataacttttgccgaaagtcgtcggtgtcacctgacaccggtggtagcttttactagttcatccaaagagtgggagtccaaggggaatttagtgtcatcatttattaatgtaagcatgatgcttagctgaattaaatgccattagatgcgtatttgcctcacggaaagtgaggtagagagcagataatgatagctatgtccatcctttgtattcatgtaagattacatttggtcgtgaggtttggctgcgtttttctgagttctgaaaatttttgtacctttttggcaattaagaatattttttatttatgtgattatactaatataataaaaaaagtacgtaatatatatgtaaattctgttgtttctcatttctcttctttttctgctacagcaaggctggtccagaaggaccaatctcaagctcatagcctcactattccctcaatgacaagcaagacccacacgttagaaccatcttcttctttgccttctttttccatgccgctggaatgagtaaggctgtgttcgttggagggggttgggaacccatctcccatgcacgaaaaaccaaacggtccattagcacgtgattaattaagtattagctatttcttaaaaaaatggattaatttgaattttctaagcaacttttgtatagaaactttttataaaaaacgtatcgtttagcagtttgaaaagcgtgcgagcgaaaaacgagtgagaggggttgggaacttgagttccgaacacagcctaaagcgagccacgcacaaggagttccatcaccgcgtgtccgtgttgttgtgaaaggaagataaccctggagagaaagatgaggataaagatcaggttacggttaagtcattattagtatagatggccatatggcccgaggcccacggcccgcccaaggcacgtcattttggcccggtcacagccgagccatgcttgggctgcaccctcggcacggtgggttggcccggcatggcacgatcgaagaaaaatagtacagggatgaaaaatagacttaaataaccatataaggcaacacccaaaaaggagagaaatacaaaatagatttatttctagccatatgaacatagcccacatagttgagggatgaaaaatagacttattctgtggagaagcacga

SEQ ID NO: 47678 - DNA, 174 bp, Oryza sativa
tccgccgccgccacctccgcctccgtcttcgtgtcccgcgccgccgcctgcaccagcctccatccgtccgcgcgccgaggggcggctccttgtagtggccacggccgccgccgctcggcgtcgctcgccgccgtcgaccggcgagaaagagagaggaagagtgagagaggagta

SEQ ID NO: 47679 - DNA, 779 bp, Oryza sativa
ttggcatcttcaggctttgcacaataaagacaatatttttagcatgtccccctactgatcagattatcatggcacactttagctcattgaaagaatatgctgaccattaggccattaatcttgcccgcgaattaacctgataactaacttaacaacctctgcgcgcccccactactgtaatggccacgccaccatcgccacagatcaatctggcatcgacacaggtcaggaagcatctgacattagtgcaccatcaccgtgtctgtgtcttcaacacggcaacacctgacaactgacgagaccaaaggtaatattacctccgtcccaaaataagtacagccgtagatatccatgtccaacatttaaccgtccgtcttatttgaaaaatttgtgaaaaatttaaaaatatttagtcacacaaaaagtactattcatgttttatcatctactagcaataaaaatactaatcataaaaaaatttcaaataagacgaacagtcaaacgttgaatatgaatagtgtaaaactacacttattttaggatggagggattactaagcagtatcatcatcttctctaaagccgttcctgttccatgtataagtatgaatccacttttagttcagagcaacagtacgaggtctcctccgttataaatacgcggcgacgccgcggcgactctgcagaattcagcaacctgacctctcccgttctcctgcagctagcctccggccagtctccagcgcgtcgccctggaccgaaatattatgccacgttctt

SEQ ID NO: 47680 - DNA, 405 bp, Oryza sativa
gctcaaatctgagacttttcacagatgttgcagcaatgttgctgtggtattgaagatgagccttgatcacttgcagtatcatcagacgcaactgaaggcactagcacatgctagtggagtcgtccagtcgaacgattactctcagtctacagttcccagttactactcctgattctctctacaactttcagcactcgaattgtactctgtggatatatatggtggatgctgttcctgctggcgtctaactggtggatctgaggaacgatgttctgtcgtccgatcaagattgtaatgcacgttccagtttgtctcgtgtcgcatggctatatgaaagtgacatcgccgaccgaaagggaggaggagcccctccgagtcgtactgtccccatcgctttttccgcca

SEQ ID NO: 47681 - DNA, 431 bp, Oryza sativa
aatttgaatcgggtatataaactttagatgtatagaaacactatatatgaaaaatatttgaattcaaattcaaattcaaatttgaattggatataattcaaattcaaatttgaatcggatatataaactttaggtgtataaactttagatatatagaagtactatatataaaaaatatttgaattcaaattcaaatttgaatcggatatataaacttttggtctctaaactttagatgtgtaaatttgaggtgtataaactttaggtgcataaatttactaaaataggaaagtaatacggtgccaaaaatagaaaccaggtggagggaggagggggggaatttgatcgctctgggcgacgcgctcgctcaataacatttccgcaagctttggcccccgctcatttccacctcgcattctctatactacagt

SEQ ID NO: 47682 - DNA, 1238 bp, Oryza sativa
atttacatagtataggctcatctacattttcattattttgtcgctactaagaaaaaaaattaaaactggtagagacagccacgggaaaagggcacgacaatatgcaaatataaaaaaatacaatgcaaataatataatggaaaattagaggcgatggagatgacttaccgcatatttggtgatgaactactgatgcggtacctatgtacctacaactaatactatagacaattctaccatttttcatcttctagcaaattatcattttaccctttctacctaagtacctatattaatacttaaatactttttgtatgataccttttattatggagcgttggatttttactatttctggaatgcaaataccgtaaaacttctcctctatacaggagcaacgctctctttacactagcagtctttgtttttttcaattctcttgtttccttgccctcgggctggccgcctgggcggttgcattgcgttgtgtaacaaaaacattgtttttcttcaaatatattgacgtgcaattcttttacatgttcgcgaaaaaagtgaaaaccagagttatagatttttttttaaaaaaagtggaatctagtttgatttaatttttttcaatttggctgtttattgagcggtttgtcaacccaagtaggctcgaaatctcaaaaatttgtgaaaaccaagcggtttgttactcaagctggtttgaaacctcaatatttcgtgaaaaccgaatggtttttgtcagttttatggaaccttgagggcaacaagcatgtatttgtacatatacaaatgttttgcagatttagcacatccaccaaaaatattattgtcgtatacaaatatatgtatagaacgatatgacagcaataaattatacaagatataaagtcatttaatgtttcttaaggaagttatgtcatttaatgttggaacatatatctaaaactacaacaataatatgtaaatggaaaaaacaataaaatgtgtaaagatttgggatgtttaatctatctaaaactacaacaataatatgtaaatggaacaaaaacaataaattgtgcaggagatggcataaatgcaagaaaccatcagtacatctccaagattaagttggttgtgcatatatataaacatgagcagagggccatggcaacgagcacagtgaacttgaagagtggaaaatcataaatacatataggaggagaacttaattatcttcttaataa

SEQ ID NO: 47683 - DNA, 1501 bp, Oryza sativa
tccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggttggaggacttgggtggtatccggaaaaggctagtgtcgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacgatggggcagccattggtaggaccgcaaggcgggtgtctacagtggtgtcgccatcggtaggactgccatgtgagaatctaaaacataattataacttaatgcatgtgtgagtcttctcttcccgggtgcgccagaactcctctcactgctagaaaccgtgtacgcctagagtgcatgaggatgaaaagttcatagagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagaatctaaattcttaacttgtgtgggaggggatattgcatgatgaattttatactgttggagccacttcctgagaggcgggaacgtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgtgcaaaagaactatggccatcctttgaactccccctttcatatgcattgttgctgtggtggcttgttgagtacggttggtactcacccttgcaaatataaaattaatcagaagcgggcgatgaagctacggaggatccctatgcctactaccaggagggagacgaagacgatggtgcccagtaggtcttagtacggtcgttgcctgtggcaatggcatgccgctgcctaaattccactgccttatctaaactctgcttttggttgtattccagaccgctcggtctgatgatttaagacaatgcctgcgggcttatgttgtaataattcgtactagactctcgtatatgagcatttggtattccagctatgaattcgtgtgtaccagactacttgatccagggaaatggtacggtttacacgattgattcctgttataaaaacgggggtccacagt

SEQ ID NO: 47684 - DNA, 1501 bp, Oryza sativa
tttcccttgttcaattcctgcttcctgtcatggttggagtcgatcgagacgttggctcactcagtcatcttcttcttgtactccagcagaagacgttgatccggctcatttcagcctcacacccagcaacacttcgccttccatgcttaagcaaaacctctcaacttgttgcccatttcttcttcgtcgttgcccgttgacccaagaagctgtctaaaggtaatcccattgttctagttctttcagatttaatatgttctagttctagttcttaccatccacatgatgccctcgccaagtcaccatgatatcatcatccaagatgaattggaactttgcacaccaaccaaataggggtagagggatcactgcactatatgaaatttacagcggttagtatcgaatatgattttatgaaataattgccttcttccgttcattttagtatgttagactgtgtattgtttgctgttaattagttagtcttattctcaccagtcctatatacaattatgtaattgtaaaagataaaccattctttagttgtagtcccatattaagagtagatacactacactacacagaaaaaaaacatacttctatgaatacctcacatgataagaatgtaatacttttagtgttggttatgtacctcatactgtgcatgatttgtccctagaactttagtttaagtatgataagctaattattgtattaatataaatggcaattcagtagttatacccatggatgtctattttatcaatacaaaaggtttagtgaacattatatatttttcagatcatgctaacagatatcgtgcattccttgccaacctacaatgctgtcactttctgaaacgttaaaagtggatctcccttgctgatttttcctatggcaaccatattagattctttggttggatcatgtgccaataagttgaaagagattattactgaagaggtgatacttattctagggatacaagaagagctcgcagagttgcagcggaagactgaactcatacattgttgtattagtgatgctgaggaaaggaggatggaagagtcagcagttgacaattggcttggtcagctaagagaagttctatatgatgttgatgatattattgacttggctagatttaagggaagcattctactaactgatcatccttcatcgtcatcaaggaagtcaattgcttgcactggcctgtcaatttccacttgcttttctaatgttcaggcacgtcatgaggttgctgtgaagattagaagtctcaacaggaagatagaaaacatttcgaaggacagagtatttttgacactcaagagtacggttcctactggaagcagttcagtattgagagtgagaaaaagttcccacctacttgagcccaacattgttggcaaggagatcatacatgcctgcagaaaaatggtagatttagtgcttgaacataaggggagaaaactttataagcttgcaattgttgggactg

SEQ ID NO: 47685 - DNA, 1501 bp, Oryza sativa
cggtaaatgtttgcatcttcaggatatacactacaataaagaaagcattgcttcaaatgatgtggtaactcatcgtaactcagatataaagcacctctcaaatcatttggaaggttgttcatgaaccaagcatttttgctcaatatttttttccattcgttctctgtttgttctttactcgctaacactctagcaataaccttgattgcaagaggaaggcaaccacatttgcgaacaatctcaatcccaacatcctgcagagtttgcaattctatgctttcactgatattcatgctcttccaaagtaactcccaccctacgtcggttgacatcaaatcaactcgataagtatggtccactccgatttctaaggcaacaatattatttctagttgttatgagaattgctcccatttctgcagcatgcaacggaattcttaataaatttgtccatgcgtcagattgccacatgtcatccaactcaaggaaaaaacttgtctccttaattgctatttcaagcttgctctggagctctccaattgattcatcttgatcatgatgaacttccataattcgaagaagttctctcaaaagagaagcttcagagtacactttggaaacacaaacccaggcttttttgttgaaacttccttttatttttctatcattgtatattttctgagctaatgttgtcttaccaactcccccagtcccaacaattgcaagcttataaagttttctccccttatgttcaagcactaaatctaccatttttctgcaggcatgtatgatctccttgccaacaatgttgggctcaagtaggtgggaactttttctcactctcaatactgaactgcttccagtaggaaccgtactcttgagtgtcaaaaatactctgtccttcgaaatgttttctatcttcctgttgagacttctaatcttcacagcaacctcatgacgtgcctgaacattagaaaagcaagtggaaattgacaggccagtgcaagcaattgacttccttgatgacgatgaaggatgatcagttagtagaatgcttcccttaaatctagccaagtcaataatatcatcaacatcatatagaacttctcttagctgaccaagccaattgtcaactgctgactcttccatcctcctttcctcagcatcactaatacaacaatgtatgagttcagtcttccgctgcaactctgcgagctcttcttgtatccctagaataagtatcacctcttcagtaataatctctttcaacttattggcacatgatccaaccaaagaatctaatatggttgccataggaaaaatcagcaagggagatccacttttaacgtttcagaaagtgacagcattgtaggttggcaaggaatgcacgatatctgttagcatgatctgaaaaatatataatgttcactaaaccttttgtattgataaaatagacatccatgggtataactactgaattgccatttatattaatacaataa

SEQ ID NO: 47686 - DNA, 272 bp, Oryza sativa
cataggattctcacatagatatgcctttgctcttgaagttctttcttcctgaagttctgtttcgtcacagacatgagtaaaagggcgtaagagttatttccagctggcctctagtgtgaacatgcctattcggttttgagaaatttcacaggaatttttaaggaattgaactatttcctacgaaaatcttgtaaaattcatgtattccgaaggaggcttcaacattctagggatggccaagaagtaagcaatacaagttctgctaaccatca

SEQ ID NO: 47687 - DNA, 1501 bp, Oryza sativa
aaattttcgcatataggattttgccgaattagtttttaacgtatcacgagaagcggagcgttacatgaacaaagctgttgtagttgccagcgtctacccggatcccgtcatcatggttagaaccgcagactgatccccacactcaacggatcaatccttttggctagcacaagattgatctggactgggagttcatactccagacgcccacaaagccctattatatttttccttcacactcatctcatctacaatatttgcattgaaataccttgatttggttgcttcaatggcagtacggttgagtaatccggccagttctcttttaatttagatcgattccggaccaacatcgccaggaattggaagcttggatggcagtttaagtggagaggagatgagaaaggcaattatcagggaaaagtgaacgaacgcatcgatcggtgcttgtttgcttcgatcccatggtgcagtgcccataattgccattgcgtaacttttggatgcattttgtacgcaagaatgattgcagcttggaatgcatgcatctttcgtttttagtttgtttcaaactttcaggtgatgaacaatttgtgtttgtgatgcgatgcaaatgcaatggagatcacggttgttaattagtggttttcagtttgtgaaaagttgcggtgattactgttggtgtgggctctagacttaactccctcgaggacaaaattaccctccctaaatgaagtttacactatcagtaccttctaatctgggcctctcatcttctttaaaaattgtgcagttttttcattgaggagcatatagaagcattaaacttactctcaagatatactatgtggtttgaggagctagatatgtctttgtggatgcaggtacaaaacgaataaagtggattgcaacagaagttgaagaacttgtgcaggaaatttcccggcttccactcagcttttgttgagtagagacaacacaatcaaaatcgagagattttccattatactcctacggagatatattcatttgtaaagaataaatgagtgcccattccccccaaaaaaaatgttatactattcggcaagagatcgaacaatgaacagcttaattacagcagctggttgtccattcgaaaggccggacacaccctttcagaatgaattcagaacgctgctaattaataatacaactgtcatgtaattgatcataatatatgttcatggtatttgtaaagagtacatttctcgtaacatacatcactctgtagtctgtaccagtaattggagacgggcatgcttgcatagttgcataagcactcatgcatgtcttcctccgatatgatcccttattcaacatccatatgaagtagctagctagctagctagagtgatcatgtcgatcaacacgtacatggttgctcgacatgatcaagctaggtgcgagatgagatcgagctcgatcgctagcaagctatatatggttagagtaagatcaggta

SEQ ID NO: 47688 - DNA, 1501 bp, Oryza sativa; identical to SEQ ID NO: 25298

SEQ ID NO: 47689 - DNA, 1501 bp, Oryza sativa; identical to SEQ ID NO: 25257

SEQ ID NO: 47690 - DNA, 158 bp, Oryza sativa
taggcgagctagctagctagcacgtcttcttcctccgccacggcccaacgaggcagccggcaaagctaggcaggcgtacgaactcgtggccaggaaagctgccggcgtcgcgccgtgcaggggccagcctgccgtccatcatcaatgcctatgtcagg

SEQ ID NO: 47691 - DNA, 1501 bp, Oryza sativa
ttgttgagtacatgacatgtgtcataaatcatgcatgtaattgtttaaccatggtggctgtgatgtttttgaagattatccagtttctcttcaatgtgattatccaatttctgcttaaaagcaaggaaattctctccattgctactttgcgctgcaccgtattgtttgttatctgctactgcctccgttttttaatagatgacgtcgttgactttttctcacatgtttgaccatttgtcttattcaaaatatttacgtaataataatttattttgttacgagttgttttatcactcatagtactttaagtgtgacggagctcgtggctcctcaccgggagaccgcgcaggcccccctttgccggttcggccgggggcttagggtgagatctcaagctctcgctgtgtgtggaaagattactcgcccgcaagacacacgagacacagcgatgtatacaggttcgggccgctccgaagcgtaataccctactcctgtgtttttgtggatttgtgtatgaatgagctacaaagtgtgtccacttctcctccgctctaggctctaaatctggcaagaatccacccacctctctatgggcaaggtcctccttttatacttcaaggggataccacatgcacccttccctttccaaactggactttttcttctttacgtaaatggacggagatttgcacggttgccctccaaacgtccttctgatgggacggcacatacctacctccacttctgccgggggcaggcgcgtcgcgggaacgtggctgtgagctgacgacctgagcagtgtcagaccggtcacaaatcggtcattcttgtccaccgcgtgtcagcttagcaacgtgcatgtttgcccttcttcacacaacatcttgcctgtaatggttaggatgaagcctggtataaatctgaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgaccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttccgaagggaagcggtcaggtgtgacgccacccctaaagcctggtgacaggtgggaccggtctccgtagttg

SEQ ID NO: 47692 - DNA, 1501 bp, Oryza sativa
aatgcagacttcaaagaaaggccgttgtttttgcgattgattttatttaaactcttttctgaaacaactaagggagtgcttctcaaacgacacggatgagacagtgcgtctcgtccggtcggagtatatgcaatgtatcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactacgctagaaatcacctcacatccgcccatgaccgtgggcacggttgttcgaacagttttaataacctctgcagagggggtacactttacccacacgacattactaacccggatcatccagctcgtggggatcagccacgtcgggagacctccaagctttcatgacaaggcatttccaaagccgacacatgtttaccatatgctgacgagaggggtcccagaccaacaacaggttaggtcccagaccatactgtgccaggaagcccaggggtcctccccgacaccaccccggcgaatccacttgtctctcagcatcaaggctcccctgattagctaattactcagccaggggtgtcccattccacccatgtggtcgtacttgtcttatgttcggatgaaattccaaggaaacggtccttaagtgcaagagcgggaaactgtacacccggtacgttccccggtcctcagttttggaaattcatttagttcgcaagcaccgacccaagtgtcgggttttccaagtcttttgtaaaacccaagttttacccaagatgtttctcagattttaagtttgaaggcgaccgttgatacccgtgcagagagcacgattaccgaggcacaactaggtgggtacaagggaacatggtataacaattacaatggaagggtcaaatgcaacaaattaggtaggtccgccaatctgccttgcaaacgggacaagcagattaagtgcgatcctatcaatgcataatatttttcaagcaacataattaagtttaaatataggctcaagttgttcaaaggtggcttgcctcgctcgagatcttgagcttgatcctcgaaatcctcgcactgcgggtcttcgggctccgaaactacacgcgaaacgggacaactcagcaaacggcgaaaataaagccctattatcgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcgcggcccgagaaaaaaggggcggctcggccgagcttaatgggccggccagcccaagaaggcggcccaaggcgcg

SEQ ID NO: 47693 - DNA, 285 bp, Oryza sativa
atattcacttcattccccgtaagccggccaatgggatttagggaaaccttggccccggaaaccaaggaaccaaattaccaaaatccaaggaaccaaggtatgggccccaaaaaacaagaacccagaaccaccattggcaaggttttaaaaccttcaaggaaagattttgttcctttcttttcccctttgttctttttgctttccccgctgaactttaattttttttttgttaccccttattttcccaaaaccccttctttccaattatttttttcttcaaccgca

SEQ ID NO: 47694 - DNA, 1501 bp, Oryza sativa
tactcagcaagccaggggaaataagtgtttaatgcaggcttcaaggaaaggctgttgttttcgcaatttattttatttgaactctttttctaaaacaactaggtgagtgcttctcaaacgacacggatgagacagtgcgtctcgtccggtcggagtatgtgcaatgtatcagtctttagaattgaaacaaggttggcacccggccaacagcttttcaaacggccacccgggccaacaacttttcaaacggccatccgggcctagctgatcccgtcagctgctgatttttcaaacatcgaaccaattttcacaacagcaatttcacaagcagtagtcaaacaaaactacgctaggaatcacctcacatccacccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacaagaggggtcctagaccaacaacaggttaggtcccagaccttactgtgccaggaagcccaggggtcctccccgataccaccccggtgaatccacatgtctctcggcatcaaggctcccctgataagctagttactcagccaggggtgtcccattccacccatgtggtcgtacttgtcttatgttcggatgaaattctaaggaaacggtccttaagtgcaagagcggggaaaactgtacacccggtacgttccccggtccgcggttttggaaattcatttagttcgcaagcaccgacccaggtgtcgggttttccaagtcttttgtaaaactccagttttacccaagtggttactcagattttaagtttgaaggcgaccgtcgatactcgcacagagtgcacgaatatcgaggcgcaactgggtggttacaaggggacatggtatagcaattaacaatggaaggatcaaatgcaacaagtcaggtaggtccgccaatctgccttgcagatgggacaaaagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggctctgaaactatacgcgaaacggaacaactcaacaaacgacgaaaataaagccctattaatgacctctaagcgcgccattagatagatctcgagatttggggaattttggaagttgaacggagtcaaacggatttacggttgggaagatattgaatttctacgatcattgaatttttgatctaaaggaaaaggatttaattaaattctttttggaaaagaaaaagaaaagaagggagggagggaatatagacttttctcggacggctaaggcgcggcccaagagaaa

SEQ ID NO: 47695 - DNA, 1501 bp, Oryza sativa
acctccttgctccgctgctcctcgccgtcggtaatgatacgccctttcgttgttaagcaagatgcgaatagctgctgctgctgctgctagtgtttcttgattgatttgtttcactttgtgcaggcggatgcggcgtcgccgtcgggggagggtggccgcgagtacgagccctccttcgccgacgacttcctcctcgccttcttccgtgccaagatggtggaggtgacaagctccatcaccccaaactcttcttcagttcttcttcgtcttcccctttttgagcttaacaatggttgccccttcctagtgcttgctttttagtagcatgggtgattactagcagaaatatcaagggagttgcgataggattatcctcccgaaaaggaagatgcttactactactagcaaataatctgacaatgtcatattgatggttgatgaatgttcagagtcgaacaaaaatgattgataagtggtgttgatcagttcgtggataaattatctattcctaactcccataatcggcatcgctgaattgcttattactatgattttgtatagcgtttatctgcaactgcaattgtatgcctaattgcctattagtgaacgtgtgccatactgctctgtgcgtgtgtacgtcctatgcttatggcgtgttctgttccctgtgtatagctgacccagttagagtttatcacatatatatgtgtttacatttgtaacgtatcatgatcggtaggagtatgcattggatcaattctccttctagctctctaccgttatacaataccgagaatggatccatatttttcacttttgctctccttatttgtacatttggtaattctctcattctctgtaaagctgtaggaggttggatgggattctgaaaagcctggctacaatggactgattgaagttgccaaccgcctcatgatcaaggggaagagtgcgttggagacagagcaatcagctgtatatataaatttctcatgcacaatctcattgcttggaaaaaaccgtatcctttagaagataaaatcaaactctcttctctgtaaatttcaggtccgagtactccgatcactgtttccccctctcttgcttgttctcttcaaagctcttttagcaccaattgctaatggtcaattggcttccatgatggttggtgagttcactcaagtgacattttttgccacctctgttggtacttattagacatacaataggaatcgatggttggtgagttcattgcagtagttgcttttgatgtagtgtgattggccttactgatttttttaatacatttgagatgtgaagctagagcaacagcactttcatgccaatggctgatggggccatgtttgttaaattccataacattatccaatggaaaatcattatcaagcggggtaccaatatattcctactgttttttttgtttatccttcactcagtgagattttacagttcacggacattgcgtgatggaaactgtcag

SEQ ID NO: 47696 - DNA, 1501 bp, Oryza sativa
caaacatagtgatttgtaccgatacagaaacaaatgttgacaagcaaaccatacatagcacttctgaaataggctcataactaggtctagatcagaagctagcccacgattccctctctattatggatcctgtgccgggtatacatcacaatggcggaaataaacgaaatccatatggaacgcatctgatgttaaaacacaaaagaagtgcataataaacatacaaacatagtgatttgtaccgatacagaaacaaatgttgacaagcaaaccatacatagcacttctgaaataggctcataactaggtctagatcagaagctaaccatacatagaactaaggaaataagttcataataattaggtccacatttctgcataaacagggtgccgatggtacattaacgacgataaacatcatcgcccttccgactcgacagctagagctgcagtcaaacatacaatcgagtcgctttattcgcctgaccgcacgtaggtattcaggcgtgaggcagcaatacctacatgcaaagcatcaggaacggtgggaccataaccagaccgatgccgtttacatctgggatgaagcgtggagtggctgcgtctccacatgtacgtatccctccctgtgtaaatgtcagtgaccaaattagcttttggataatggtagagtacgaggtccaaaggtacaggagaagtgaattttcagcagtaaggaagaactagagcataccagttactcaagtagcatcatattcccaaaggagcagcacaaagggcatgaagagcaccaggcgtactgcaattgtacccaaacaagtctagcatccgtggattttggcaatcagtttcataactcacttccttttcaccatctttgtctgttgggataatcttctcggtcaaggaaaaaccaaaaaggcggcaactagttctgtcaacctcccttccaccattaccaggcttagtagcattcccaggtgttgaagcctttccaattttaaactggtcccagctagtttcactgagcaacttgtgctgtcgcaaggctggttggctgtcatttccacttttgtcattgttcttgcttgccaattcaagctgtggtacccctgtttggtataacataagactggaaggtggagaaggtggcacagttgacagggagagacaatatccttcatttgcagatgatagtccattcatggtagctggggtgcacacataattctttaattcatatctgcttttcgctgaacatgcatcaggcaacattccttgaaacggaggaactgtctgagaaatttcttgaccttgcaagacctctgggaatccaatagattcaccgaagcttacagattggtgggtatagccagagtactgcactggaagtctgcttgttgaactgcccaacatgcagcttcgtgtatcagtaaggaatctccaagcatcaaaagacttactttttgtaatgtcgattgactgaggagaacaagtagca

SEQ ID NO: 47697 - DNA, 1501 bp, Oryza sativa
cgtatttgaccaagcacgtattacctgcatagttcaattttcctcatctaaacgtacgacctctcccatccagccaacaaattactcccaaaactgatgaaatttgaaaggggcatttgagaacagcaataatccccaacaaaatcgaacttgtggggttaccactactgaatccgcgcgcgtacatcaggcgtgagttcaagcaatcaacccccaaaaatctgagattcagagacaaggaagggggtctcacatgtttctcggcgcaccgctccgcctccggccgatgcagatccgcgtagtggcggggttggcgtaatcggtgaagaaccccgcctcgcagagccgcgcggtcgcggacggccgcaaccagccgctcgcagccggcgccgcagacatcgcaggcttccgtcaaataccttttcctcggctgcttatccttgatacacttttgagtttgactcccctcttctggtctactagcactctactactccagtaatttaattttgtggttgtttggatctctaacactacgggtttaaaattgccgaacgaaatttccgaagttggtcctatcggaccgccccagccgataccatattatttcggccgcattttttttattttttcgtgaatttggttttttttttaaatttgatcaaattgtattaaaaaattcatacaattttaatatttcggccaccgcagatacaaatagcccaaccgaaagattaaacccttatgtcccccaatgtacttttacccaaagaaggtttactggaccgtaaggctatgttattttcttaaactataaaaaatgcacatgcgttgtaacgggtgaagactattttaatcttattattgatataatttagttaatgtgaaattcaccgtgttaaatttgtttggatatatactttgttagaaaatcacgagctgtaattaggagtccaattatctcaagttaatatacgagtttttttaaaaaaagatttctcatacgatgattcaaaatgaaacatcagtaataaaagttgaaccaaaataaaatttactcaaactgattttgagcaacttaaaagtttaggctagaagtaaaatatgatgaaaaaaaacatttaaatcaacttgaagtttaggttttaaaatttaaattttaactgcgacttatacatgcacgatatgttagtaaagaaaaacaacttaagtaactactttttgacttctgacttgatcactcagagctaatctactagtaacatttttttatcagcacttgcatgttaagcattatggatttcggcagcaccttctccttgtaaatgcatgcgaaatgcgatttcacaatgaagacaaaacccaacaacttgaaggaggcaagaatataggattcttcataatttcgtagtatcctaaagttgtcatgtttgactacggaaccaaaagctaattaatcactcgggccaaacactgagcagctgagcaatggacgccagcc

SEQ ID NO: 47698 - DNA, 1501 bp, Oryza sativa
aatgtcaagtcccataatctattaagcaagagatagattatacataaggttaaaaagttatgtactaagatccctgagcattgatcattggactgagcattcttcattggaccagttaccttcataatgtaatctgtctgcatgctcctttctaagccttccacagatattgcctacaaaaatacaaaaatacctaattgaattgtaatggtagagcttatgccatttagattacaaatggctaaacaccaaactattttttccaacaccaaactgaatgaggaaaatgagacaagttttcactgttgtttagatacactatccaaataccaatgtgttgcaatgaaatttaaaaagtatgttataagttttaaatttgaaatgtcttatataattcctaatcaaatatcagttcataacatattaagctacacacacaaatatgtatttgtcctcaaaaggtcccttcaactcgagaggtggtgggagtggcagagtcaccaccatcactattggcttcttttacacaactagctaggtggcccgcgcaattgcgcggctagcacccaaacaaaatcatatctttaacggtcatagtgctttcaggcgatatagcaaaacagccataaagactgttcattgtcattttatgaatgaattctaaggcttttatgtttcagttcgccaggttgtctcttgcctgctcatggattcagcaggcagttcaaaaggttgacctatttgggaatctccggatctatgcttattttcaactccccgaagcatttcgtcgcttgctacgcccttcctcgtaacccttttgcttttccagcaatatgtacatatctaagtaattgtcgttctgtcataccatcatgaaaacgaaatttccgtttttcttctagacgactgtatcagcacctagttcattactcttgatggagggggaggatctaccttcttagatttctttttctatttatttttccatctaggattagaaccgtatacttggtagattatttttccatctaggattagaaccgtatacttggtagatagtaggaacggcacattatggcaaaaaaaaaagtttgattcagagagagaggaagcggcagaaattagaacagaaatatcatttgattcgtcgatcttcaaaaaaaaagataagaagcaaagtttaccctttgagtttgagtgaaaaaacgaaaatgcggcctgactattctagaggattgtgcgatattattgcggaatactgagcagaggctggaacaacccatagaagtgtaggggctgcttttacttccgcacttagctactctaggttggggagtagggcccgggggagaagttctagatacttttccatactttgtatctggagtacttcatctaatttcctccgcagtcactaatctaaagaaaaacaaaaaaagaattccattgaattgtatttttattgatcaattagaactgccttctagaacgtataatt

SEQ ID NO: 47699 - DNA, 1501 bp, Oryza sativa
aaacgccaaagaagaaacaataaccttgtttgttcgatctccccatcagaaggattttgttttgtattttgacatgtggaaattcgagacgatagtgcaattccgaaagaaaaaggacaacctatcaaactcaacgggccgtttccaaatttgctagtgaatgcaatatgtcgggaaacaagtcaacccaaatattgtattctgtatgtatggttggtatcaaactaaccagtatcgcatttgtctgtttgggccaacatgattacaatagcacactgctacactgaagaaatggtagattagtaggtaagacaagtacaaattgtttgttggaatatccagatgtgtgcttggaccaaaccaaaattacattttgccctacataatcaaatactaccagtgaatgcaatttcagaatgaaatttcatcccccgccagcaagcacatatttcgcccgaaattttcgggttttttttccattttttttgaaactggtcaaaaaaaaattcaaattcattcgaaattcgtcaaattttcaaaaaaaaagggggccaaaaaagtaccgaaatttcagagattttggttcttttggccacccccggcaaaaatcacaatgttgagattgctaaccctgactactacagcacccagcttgatgcatggctgaaaagccactttatcttgttattatgcaaactatgtggtttagactgtagagattgccaaaattaacaagtgaccaacaccatatcctttaacctttatcgatttgtgcagaaagagaactataattaatagtaacaaagagggaggggagggttcgcgaaccagtagaaaacggctctctttgccctgagcacgttgctcccgttcttcataaggattgggttgctctgcccggtgagtgcgcgcccctcgtgcgtgtgtagcctatctcctttcttctagtcggcgtgcacgcgatcacgccgcacttttccaactgcaactagtatagcaaatgcagtgagaattataaataaaatcgcatgcttttccaagtgcaagtaggcaaatgcagcgaggattataaaattgcatggaatggaaggtgagcgaaaggaatactgaatacataaacaagcaaaaacacgatccatcagagcgtccggcctgtgtgctcgcttctcgaccagtgctgattgaccaaccaaaacctccgatcaccttgtcccgtactgaaaatgctccgtttttgacttgtgcagagttcactatcgttgccacgaccatggtgacgatggcatcacactccgccattgcaatggacagataaatattcccccctcaagctctttgtcttctcctgctcctcccgatcccaatccgccattggtgggcgccaagctcagctcgttgctcttcttcttcttcttcttcttcttcttcttcctcactcgctgcccactcattgggaaaaatccgagctcggattgaggtttgttggtaagacggacagcca

SEQ ID NO: 47700 - DNA, 1501 bp, Oryza sativa
aatgcaacctacaacccactatgtttaataggattaaactctaattttcacatccctacttcttctaggtatgcaacctaataagagtctttactcataagtgcttacgaaattttttttgtgatttttgtgttgaaaatttccattatttctttgcatatatgaaaatgttgttgaatttcagtcaagaccgagaccgagaccaagaccgaatttatcggtcctaatattttgcgctgaaattcggtcttcacttttcaaagaccgaaaccgaaattttcggttagaccgaatgcccacccctatatcttatattgtggttcagggaggataaacggattcggtgtcaagttaagggacctccaatgaacttaatcttttttgaattcttaagtactcaactcacacgtttggtgtgcttggtttcatgggctggcccaacagaaaaatcgctctgcccaatccgctggacgcacgcggagtcgccagtctgctagaggatgtgctccattttggcagcccattgttcaccgcgagaaaggatgatggaccacaggctactaggctagtcaggtcacgcttcgcacgagtgcttctccctcacgtgctcctcaacgtttacacagaggtgacagagcagaacagaaaaatgaaacaacagagcaccggtgttgcgttcttccattcactgagaatttgtttcgtgtaagcctcctgggtccagcccaactcccatcttcccttttgttgttttccctgggtaacaaaaagcgcgaccaaagaggacaaggaaaaacaaaaagaagcacaggagtagcaagtagcagggagggagacgcgacgcaagcggcgttacgggtcgagagggaaagcctccccgccgttggtttccttttcctctcctcttcctccccaacccgcgccgtgccgcacggcccgcgccacgccaactcgatcggtggtgactccgcctgcctccccgcgcgcgcgcgcgccgctgccctccaccttccacctggcagcagcggctggcatggcatggacgcgctcctctcctctcccttcccccgcaacgcaacgcgacgcccgggcgcgcacgggaaaccgacgctttcaccgcgaggggggaggggaaaagcctcgccctccgccctcgccgcctgactcgcgtgcgccgcgggttggaccgacgcgcaaccgcctcttccgcccccgtccccccagtgcacgcatcgcacacccaccctcgggcggcctcgctgccactctcgcgtgaggggttcgctccatcaggaccagagctcctcctcctcgtcctctatatagcgcggcgccctccgctcctcctagcttcagcaccagtgcacccgcacgcgcgcacacccacacaccgaccaccaggcagcgcctcctcgctttggctctcgcgtgaggagggtttaggtggaagcagagcgcgggggttgccgggggatccgatccggctgcggtgcgggcgaga

SEQ ID NO: 47701 - DNA, 645 bp, Oryza sativa
cccccaacagcaaattaagccgacatcagaaaccgtattgtcttgctttttctataaaaaaaaggatataaattgttttagaacaatttagagttttgttatttgctcacggcattcttaattcaattcggcactttgtgcgacaaggaacatatacccacccataaaaaatatttaatatatattgaagtgaaaaatatgtgcaatgagtagtacttaaaaaataatcatatttatcgagagaaagaggagttaagataaacggaaccaagcgtgggaagctaattaattcattgtattgatttctcattggcaatcaatataaattcaccagtatatacaaatattcatttaattaagatataagtaacaatacgacactataaaatgcttctctagagcaccacataattaatgaactattatgacgatatatcaggttccttttaaggccctttttctgctgaatggaatataaacgatatatgcaaaaaaaaattgaatggttgaataattggtgatacttatttaagagtatacacgaatttattaactattataaaatttaaaatggatttaaaacaatattttaagaatttcatatgtagctcgagaagcatgacactaaatagaatgcgacgtcca

SEQ ID NO: 47702 - DNA, 541 bp, Oryza sativa
cagttcaactttggggtgccacttcaccttttgacaccgacaaagccttaaaggagccctgcttggacatatgcacgaacgcaggacgatggaaagtgctcggaacgggtagtagcacagatagtttgcaatgtcctcaagtttgatgagatgttcttgaaagtttggatagtataactgaagataggaatgacatgtggaccacacttgccaagggcccacacgtcagcgacttctactgctgcagaggagttgagccattgtgccccttcttcagttgctattactagctagacataataactgctgtcgtctgatgatcaatactaccacttctgtctcaaatgtaacacaattagtcaagaaaaagattgaggaccaaccaaagagatggcatgaggcgctttcagagatattgggggctcataagatatctaaatatggtgctactaaagttatcccctttgagtaagtttataggcaagaaaccgttttactggtagaggtagttcttggctctcttatagatacataaagaaag

SEQ ID NO: 47703 - DNA, 960 bp, Oryza sativa
aaattgggaatacctccctgatatcccccatgatttataggagctccaaaaacagaacctcccattctaccagtaaaattctctccttgagtaaacacagttggctcaggtcgagtggtgtcaacacctgggccactactgccccccatttgacaaaacagactcttctgattcattggtgcagagggtatcacaacgttgggttcgatttcaaaacgtacctcaggtgcagtggagggaaaaaccactccagtactcggcccagcagcgtcagtaccctgtcccgttgatcccttaactgctgtagtagcatctgctccttctccaccctgatctgccattttcttttgcttacagagttcacgcagcagctctttgatttccttgacctcccccttgagcgatttcagatttgttacctcctttttcagggtcaccatgtcagtcctgaactcgttcatctcttccaaatccaccatcgattcgctggagcgcgtcttcgtcatcttactctacaggattggtttggaacaagttcctccccactagatcctatcagagatgggtttaccaccgccaattcttagttgcgagctccggagatttcataggggcacacaccttggtggctcccaaacccttgctcgagcaaccaagaacaccaccacgcctccggattgattctgcccgggttcaggaattttacgatggatctcaccgccgccttccaccaaccctcaccggacaagatcaagagccaagaatcgtgcttgctctgatacctctgtcaagaccctgagtgcgaaatggaagaaacaagggaaaacagagcagcgattttagggttctaagctactttagctaatcctaagacaaagtaaattgtagtttgcgttctgttcttctccagggccaaaggcctccattagtagcttacaattcaagcattacatccagctg

SEQ ID NO: 47704 - DNA, 1501 bp, Oryza sativa
ttaatgcaggcttcaaggagaggctggtgtttttgcaattgattttatttgaactcttttctgaaacaactaagtgagtgcttctcaaacgacacggatgagacagtgcgtctcgtccggtcggagtatgtgcaatgtatcagtctttagatttgaatcaaggttggcacccggccaacagcttttcaaacggccacccgggccaacaactttcaaacggccacccgggcctacctgattccatcagttacagatttttcaatcatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttgaatgaaattccaaggaaacggtccttaagtgcaagagcgggaaaccgtacacccggtacgttccccggtccgcggttttggaaattcatttagttcgcaagcaccgacccaggtgtcgggttttccaagtctttcgtaaaacccaagttttatccaagaagttttttattagattttaagtttgaaggcgtccgtcgatactcgcacagggtgcacgaatatcgagacgcaactagatggttaccaggggacacgatataacaattatcaaaggaaggatcaaatgcaaccaattaggtaggtccgccaatctgccttgcaggcgggacaacagattaagtgcgatcctatcaatgcataatatttttcaagcaacataattaatttcaaatataggctcaagatgttcaaaggtggcttgccttgctcgagatctggagcttgatcctcgaaatcctcgcactgcgggtcttcgggctccgaaactacacgcgaaacgggaaaactcaacaaacggcgaaaataaagccctattaatgacctctaagcgtgccattagatagatctcgagatttgaggaattttggaagttgaacggagtcaaacggatttacggttgggaagatattgaatttctaagattattggatttttgggtctaaaggaaaaaagatttaattaaatcctttttgaataagaaaagaaaagaaaagaaaagagggagggaaactagacttttcctcgggcggctagggcgcggcccgagagaaatggagcggtccggccgagctaaa

SEQ ID NO: 47705 - DNA, 569 bp, Oryza sativa
gggggggttgtggtgggccaggagagtgacgtgtcggagtggcaccgcgtggggaccaccggggagtcgttgggagggtgggacccacgaagacgtggctggctgtgacagtagcacccgccaattttttaagtgtgggcatgttcggattaggacggtgatttggcttaaagaaatgttggacttgtatggttttgtaccctactaataagttgttagtgtcaaactctagtcaagttttggcgctactaatattttgataggtggaattgtaaatgtgtgtctttgaatttatgctaattgagagataaattttaaattatggtaaaaaatattctagtattatgccaaattaagtataagtattaccaaacatttgtcttcaaaccaaatcatcacatttactatttatactaaaaaaattggtatgataacactttggtatcaaaccaaaacgccccgttaagtatcagtgtatcacagtggctgcagctcacgtaaggggaaaaaaaagtataatcgctgatttaactctatgcctcttgactctcggtctctcgggtataagc

SEQ ID NO: 47706 - DNA, 399 bp, Oryza sativa
tcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 47707 - DNA, 265 bp, Oryza sativa
atcccgccgtgcccgcgcgccataaagagggggaaatcactccccgtgattccctccctctttccccccacttttccctctctctctctctcggattcgtttggaaatcctcccgcaaacttcgccggcgtcattgatggagccgagatcgccgcgccggtttccttcccctccggccaccctctctcgcccccggctctatttaagcactccccgtgcctccctcctccgtttccgacccttgccgctttctctccccgtcaga

SEQ ID NO: 47708 - DNA, 1501 bp, Oryza sativa
ggatattgtttataatttatacatgacgaaatacatgtgaagttgtgtactgactataatctactggcaggttcactctattactaagtactttgcagagggctctccttttgtcaaacaaggtatactatagcagcaactttattttaaaaagtctctgtaagcattatctatctttagtttgagcatgataggctggcggcagcatcagatagtattcgattgtttgtgttatatgacctatctgtcatagactcagacgcaactaagacatttatttctctggtagagtcaactaatagtagatactctttatttgttttgaatatttacaataaagagcttgcttggtcttattattaaaggaccatgaactatgtgctgtgtaagaggattatcattagagatgtggaacttctgaagcagctgaactaaggataatctaatttgctctttgtggtactgccttgtcataggctcaatgatataatctgttttcgttcctaatgcagacattaagaacttaggaaaatatccttgtttacattagtgccgtcctcatagttctggtgccaataattttacttgtcatatctgcgcacaatcattggatagtagtggaggttgacaatgatggctctactgcaaaattggtcaaatgtcttgaagtaaaagtttatcttgttagtagtttctaaaaagtacatacatctgacatgggtgatgcttagagcaatttcgcctcatgtttagaatgatatgaacatctgatgaagatgttcattttacgcgtttcttaacccaagaaacctgtttaacattttacagtttagttactccccaaggcattttaatttgtaggccacaatgactcacaaccatagtttgtcaggttttcccttataaacttattattgttaagcaatccatgcatatttggtgtcatttctccttttgttggcatatgacgaaaacatttgataggagcttagtgactttttcttttagaaaatggattaaaacagagcctctacatccaaacaggatgaggatgtatgcagccaattcccagtgacttgcagtaggaacttaagcttttcagattatcctattaagtttttaaggttttgtaatcagactgttctatataaaaatccatacaatgctttcatcattgcgatagcaatttctgtgcatcttattcgattgttttgtaccagaaataaaaggagtggtccaagccggtttgcaagtcatagtggaactatacatctgttctaccggtggaggcagtatttggatgcgtcatttcacctgagcagatgtggttgtgtgtgttactgtgcatgtgtgtgttgttttcctttttttttcctcttgccctttgttttgctgtttttacctgatgaagtataatgaaatggtagggcagcaacaggtagccctttgttttgctgttttcacctgatgaaatgtgatgagatggtagggcagcaacagg

SEQ ID NO: 47709 - DNA, 489 bp, Oryza sativa
aggaaaagtctagtttccctccctcttttcttttcttggcttttcttattcaaaaaggatttaattaaatcttttttcctttagacccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttttcccgtttcgcgtgtagtttcggagcccgaagacccgcagtgcgaggatttcgaggatcaagctccagatctcgagcaaggcaagccacctttgaacatcttgagcctatatttgaaattaattatgttgcttgaaaaatattatgcattgataggatcgcacttaatctgttgtcccgcctgcaaggcagattggcggacctacctaattggttgcatttgatccttcctttgataattgttatatcg

SEQ ID NO: 47710 - DNA, 367 bp, Oryza sativa
acgtcctgcaccgggagaagagggcagtaaggtttttggaaagcgctccacgcgactgttccttgttcgtccggaacggctcgccttcctcttcgctcgcgtgctgcgcgcattcgtcgacgctcgcaaccgcgagtagttcctgccgagcaaacggtctttccaccacctcggtacgtgttcgacatgttgcgcatatttgatctgttcatattttactgcttagtttacatgtgtagatctaatgatgcgtttatgctagtatacatctgtaatgtcatgatttatttattgaatatattaaatcattatatgtctatattctcaacaatccaaaaaccttattataggcgctgtgattttacta

SEQ ID NO: 47711 - DNA, 744 bp, Oryza sativa
gtaaatatccatttaaaggagcatataaatttcaaatggccataactgggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatcctctcttcatggaagttgaagccggcgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctaggaaaataaaaccccaactagtgggtactctattcatggttccactggtatgaatttaggtagatgcttcgctggttaattaggcaacattaggtggttttataactttagactttgggaattctcatatcatttggacactatggaatggttggcttatggtggaattggacatacccctctcttcctctttcaaagcccctaaaatctgttttccggtggggtttgggtgcatgccagttgtgggaagtagcaccccggccactataaggattaagctcgggcctctgttgcaaagcactaccgtacttcc

SEQ ID NO: 47712 - DNA, 1501 bp, Oryza sativa
gtcgtgaggaactcgacagtaagggatggcttctcgaagtactaggagggcatcggaaaaagggtattagctagttaatcatataactagaatgtgtgtatactatgtatattagaagtataggaatagattcttttctactttctttccacttagcttagacaatttagtatgagaataagtagttctatgcttgtgtgtcattctaccttatggattatattaacccctgcttagactatgattattacaagtaatatataagttattagtatggttctctctactataatcttcccacgggattaaataaatacgatacccttggaatactctcgggtgaaatgctacaatggtatatccgtgcgcttgcggataaattctgtaaccataatatactaggagtatttctgcgccattgctgggaattatacttttagtaatgtcattaagaaataccaataccggccccctggaggctggcagctatgctctagggtagccaatccagagccgcaactggtcagaccgagccgatgtcggtctgaccgaggcgtggccgatctgaccggccgcagtactgcggtctgaccggcctattcagaattgctcattgattgccctgtaatggctaaaaaactagccgttacatagtagtccggtctgactggccacacaatggcagtctgaccggcagtacactgagttaggggatttcgcccccaacgactagttttagttggtgggagtgtaaatactcccccaccagcagcaagggaactctcttggtacttgcttcacttacatacaccccttgcacactctctcacactctctagttcttgtgttcatccattaggtgtgattgagggttaattagccaagagtcgagtgcatttgcttcattgtagagctagtgtggcacttgatcatctccgagccgggtcatctcttattactattggaggttgccgtctcctagacggcttgtggaggtgttgcccggtgacctctccgaggagattgtgcaggaggcccggcgccggttgtgagtggtttggagttcaccaccttcgaagtgaaggaagaactacccctagtgattgaggtttgggtagtcctctccgtggatcggctcccaccttgcccaccccttgacgaagggggtgtgcggtggcttcgtggttgagaggtggagttgggctcgcctcaacagggattaggaaaccggcgagtttccgaacctcggtgaaaaactccttgtctcttgtctcatttatttgttgcatttacatttgtgcaatttacattcatagagacatatttgagtccatatcaccctaggattgcaaaaacttaacttaggtgtgtgatttactttcctagagatatacttgagccactatcaccccaggattgcaaaacataacatagttgcttagttagacttgtccctcactgagcctagcaacttatgttagttttgattaggtgtcattta

SEQ ID NO: 47713 - DNA, 1501 bp, Oryza sativa
gtaagcagtatgcctgttacataacaacttgcacttatatggtccagacagaaaatggacattatgcaattcaaagggtatcaactctagattcttgattgtttttctcaagagctccggaaaataatggcaactattggaattcccagccttaagttttacattaagaaatgttgggacgcatttcatcaactcggattaattccatctgcatcataatttaaaacaaaatgacaaaaagagtgaagcctgatttttagcagtcagaacaagtaatttcctaacagctagccagttttgaacaatttaagggagataaaatatccagatgcctaaaaaaaagtaaactccaggatcatagattggacatagatgtacgcaacacaatgaattggcaaatcgagaggaaaccaaaccggtagcatacctctgaaagtttgggggaaacccaaaagcttgataattcactaaccaggtatgaatgaaccatcactgttaagtaattttgtacaataataatacaccagagacatcagatccataaataaaactaagatgccacactttcctgcttaaaagtcaaaaccatggttttaggacttatgggaatgatgcgtcaggcagaaaaaaaacgtggcacttgagcaaaatcagtaaaaaaaaaaaaacaacaacaccatgctatattttcttgtatatctattaaaaaacaagtacgaattataaaatattatatttccattggtagttactctttggtaatgcaagttccataacaatggaatatgtcttcttttttttcctcactaaaccaactaaattgcaaatgtgagatataaagttctgcgtataacttatttgaatgttatacatttcaaattagccatgcaatatgttttgcttcatatcctcacttaaatgcactatggtttaaagatagatgaagtgatgaactcaagcaaaaaccagtacaaaatcagtatattggtgatgctggttgaactagaaagctagcattgaagtgcaatgcaatacacaaggtgaggctacttccttctgacctgagttcctagcctcctgtcaagttttagaatcatatttttcttcagttagccatactaaaattttacttcatatcttcacttaaatatagcattgaagatgagatagataaactcaagccaccaccacgtacgaaatcagtatatgcttgttgcactagaagctagcatagtagcattgagatgtaacgcagtataaaaggcaagtctatttctgctgatttgagcccctatcacatttaactccatgataaacattagattgcaacctctaactgttacataacaataacaattccatgaacaaaaagaatagaaaaaaagagtggaaaataaaacaacaccatccccaagtcacaaaatgctctgaccttgaagagagccaaagcaagtatgctattgccataccaactctcatcaggacttttcaagaagtggtc

SEQ ID NO: 47714 - DNA, 1501 bp, Oryza sativa
tgtttttctgcacagagcactgtctagtcgcaagattaactagatgcatgaactgagtaacataccacagcagcagtaatgaggctttcaccaaaagttacaagaacaaaaatggactgagatttttaaaacaggggcattactgagatgacccaactccaaggcaagcaatttgttgttcccagcattagcaagagctaaagcactagaacagcagcaactgatacagagagtacatgaagaatataagcaactcagagtaagcagtatgcctgttacataacaacttgcacttatatggtccagacagaaaatggacattatgcaattcaaagggtatcaactctagattcttgattgtttttctcaagagctccggaaaataatggcaactattggaattcccagccttaagttttacattaagaaatgttgggacgcatttcatcaactcggattaattccatctgcatcataatttaaaacaaaatgacaaaaagagtgaagcctgatttttagcagtcagaacaagtaatttcctaacagctagccagttttgaacaatttaagggagataaaatatccagatgcctaaaaaaaagtaaactccaggatcatagattggacatagatgtacgcaacacaatgaattggcaaatcgagaggaaaccaaaccggtagcatacctctgaaagtttgggggaaacccaaaagcttgataattcactaaccaggtatgaatgaaccatcactgttaagtaattttgtacaataataatacaccagagacatcagatccataaataaaactaagatgccacactttcctgcttaaaagtcaaaaccatggttttaggacttatgggaatgatgcgtcaggcagaaaaaaaacgtggcacttgagcaaaatcagtaaaaaaaaaaaaacaacaacaccatgctatattttcttgtatatctattaaaaaacaagtacgaattataaaatattatatttccattggtagttactctttggtaatgcaagttccataacaatggaatatgtcttcttttttttcctcactaaaccaactaaattgcaaatgtgagatataaagttctgcgtataacttatttgaatgttatacatttcaaattagccatgcaatatgttttgcttcatatcctcacttaaatgcactatggtttaaagatagatgaagtgatgaactcaagcaaaaaccagtacaaaatcagtatattggtgatgctggttgaactagaaagctagcattgaagtgcaatgcaatacacaaggtgaggctacttccttctgacctgagttcctagcctcctgtcaagttttagaatcatatttttcttcagttagccatactaaaattttacttcatatcttcacttaaatatagcattgaagatgagatagataaactcaagccaccaccacgtacgaaatcagtatatgcttgttgcactagaagctagcatagtagcattg

SEQ ID NO: 47715 - DNA, 1501 bp, Oryza sativa
taaacatcatgcaaacatgctatatctttatagtttttataatttaagagcttttcaaatacaaacatgttaaattatcacccaacataattcacataatgtttcaatgtatatctttattatgttttatgatatcctatatactcatatagttcatcctcacttagttagtgcttaaatgattaatctatggtacaaattatctttctccttttttcctctaattaaatcatatcacatcaattgtttttagtctttagatgattaatctacggtccaaactatctccctacttttcttcttccataaagtcataccaccttacttttttacgtttgaatcaccattctacacactatttagatttaaattatcatgaaccacattaatctacttaatatgatattatctagctatcttacacattattttttttattattatcatactaaattctcacagcaatgcgcggggtttcacctagtatcttaaattaatgtgagcgctcgtgaaatctaaaacttgaacttagaagaagatgtttttaccataagaaacgtaaccagttgacaccagcacacttctcatgctcaggtagtctggtccagcaccacccatgcatgcaaccatgagttaatagaatgttctaaatcagctatatctacccctgaatatttgctaagctcaagttaaggataccacgagtaaacataatcatggacagtagtaccttctctgcataaaatcggcatcaacttatactcttaagaatgcaatcttttgctccgctatatcttgaaaatgcatgctcacaatcttattgtcgcctacattcttgcacgtcattaattggactaattaattagcatgtgataaattaaagaagcacgttctttctaaaacccccgaatatagtcgtgtctccagcaccgatggaccatgagagtttcccaaaaataacacctcgtttggtaaacgaggccactatataagagagaaggatttgcattgctaaaaagaagttcagtttctaataaagggagatctattgcctctcttttgccctccagggggaggaggatcagggagaaagggagggccaaacaatacaaaaagaattactgcaggtttaatttggccgatctctcatgccaatttctcgtcttgtaattaatatctccagcagttcatgtatttgctttgtttaatcgttcgtgctgtgatggttccttcctctttaattttatccattttttttgtatgggaaaatttcttcatctttggagtcttttttttttttttgcaaatttgcagtgtgacatgcatgggctgtttggttttgcaggaaccctagggattataattagcgagttaacggcaaattaagatgccggtgtcacgtggcggcaaggccgcttcgtcgaaggccgaccccttcgactcggactcggactcggacctggtcccgaagaagaagccgggggcgtacacggcgcccagc

SEQ ID NO: 47716 - DNA, 470 bp, Oryza sativa
aggccactccacccagtccccctccccccggcccttagcgtccgccttctccgtcgaaccggtggccactcgcgcttcccaacgtaccgtggcggtccggccggtgagttgctccccccccccccgcctcctctcctcctcgcgttaatcatttgcgccacttgttcatgtgatccctcgcgcgcggctgttcttgccatgctgagcgtagcgaacatggaatttgggtttggtttttttttctttcgattatcgcggaattcgtttcggtttgggatcttcgtttctggtggttgttagcttttatctaacacatggccgtgcgcggtgcttcttgcagtcacccatttgagttgggagcacggtggcaatggggattgcggaggtggccctccacagtatgccgggggcattcgccgcccactccccggcatccaatttgcccctcgcggccgacgccgcgaggggca

SEQ ID NO: 47717 - DNA, 1501 bp, Oryza sativa
  unsure (1)..(1501): unsure at all n locations
caaaatattttgagttgaaagttttcgaatctgcgtggaaagtttttgaatcttgagtcacaagttttcgaattcgagtcgaaagtttttgaatctcgagtcgaaagttttcgacttcgagttgagaggtgtcgaatccgagtcaaaagttttcgaatatgagtcaaaagttttcgaatctgagtcgaaagtttttgaatcagagtcgaaagttttcatattttttcaaatcttaacttaaaaaattttcaaatctgtacttgaaagttttcaaatcttgagatgaaagttttcaaatctgggttgaaagttttcaaaatttatcttacacatttaaatttcgagttaaaaattttcaaattgagttttgaaagtttttaaaatttgcttcaaaagttttcaatcggttagtaaaaaaatcttccggacaaaagaaaatcatatcttaattaccgtcattatctactaatcacttagttaattaagctaaactatcggaaactctcgccgncaacgcgcacgcgcgcgttcgcttttccgatnaaacatacacatatatacatggatgccattttccaagtttgagtcaagccttgtattgtacaagcaagcttatgatagagtgctcgcctgctcggacaaagctctttggaaatttaaactcttaaattctctgtatcctgctttgaaaatgagtgatctatgcctgtgtttttagttcccttcaaacttccaaaaatttcatcacatcaaatatttggacacatgcatggagcattaaatatggacggaaaaaaaaccaattgcacagtttgcatgtaaattgtgatacgaattttttgagcctaattatgccatgatttgacaatgtggtgctacagtaaacatttgctaataacagattaattaggcttaatagattcgtctcgcagtttacatgcggaatctgtaatttattttgttattagtctatgtttaatattttaaatatatatccgtatactttaaaatttttacacctaatcaactaaacacggcctatgttcttcttaatttgcctcacaaatttaggtgggataattaagttcggtatgaaccttttctcctcctccttgtaacacttcattcacatcaatcaatgtacagtatataaaacacatcattgtaatttctaatcatactaatatatatacatgcatatattattgacgcccgaggtaaacctacagcaaagcagatctccacggaggagttggtcaaccgaatgtcttctcgctgctgtagcacaagtagaggaagccatcgccctcatctttgtatgactcatacacactgcccatcagctgagctgcagccacaacaaaattgtatgtctgaagcttcaacagaggttcaagcgggacaaaaaaaaaacactacttcatatgcaaaactcaccagtctggggcaaagtgttgttgacaaacacaaacaacgctgttcctggaggcaaatgtagcct

SEQ ID NO: 47718 - DNA, 569 bp, Oryza sativa
tttattatttgtgagtttcaatcttcccggaactttcaaaggggtgaaggtgtactgataagtttctaactatgcttattgcactatcttccatgcagtgttacagccctgtaacacaatatgtgcctgtttagaattattttttatggtcttgactaaggagctccggttgggagtcactagtttcattgtctttggagccttgggaagaattcctgctgctccctttatgggaaatgatttacacaaagcatatataagttgcagatgtttatattctgttgggtgtagattctatgctatcttctgacagggtgtagatccttcaatagattctgttgggtatagatccttcagtatctaagttactgcatgttgttttattggtagttgtggttggtggcataatttatgtcatcatatccttttccttgttactataatatcgtttcctccttttctcatcaatttatctattgaaggatcttgaacttaccattgtattgattgtatcaattatatgagatagttggaatcgtcttttaaacttaatattattactttgcaga

SEQ ID NO: 47719 - DNA, 482 bp, Oryza sativa
gggaaaaaggactttttagagcttttctttttataaaatcattttaactttgtttatttcttaataattattatttgtgctctgaaaattccactaaaatttgagggctcctttagaccaaggagaatttaacaaaaattctccgggccacatttgagtttttcttgtacgtattttagtgtttgccaatttcttttcgaattttaattaattctattattccttttagcgaatgatttttaattcgggatgaatttatcaggacgtgacataaactaagtgcacaagggtgtgagagctcttgaaagggttcaagataatgcaatggagtgccaaaaccttacccttgctgctggggagtgggtatatatacccccaaccaccaaaactagccgttggaaacgaaatccccaactttgtgctctgccggtcagaccgtcgttgtgaggccggtcaaaccggactactttgtaacggctaga

SEQ ID NO: 47720 - DNA, 498 bp, Oryza sativa
tgattaaggtccatcaccaaagaatgcatatctaccacatctcattatcgggaaataaccttgttgaaaacttatgtaaaagagaggttaatcccataaacatcggtttatcatctatcaccaacgtaacaattacacaaattgtttaatccaagatctttcaatcttttctctcttttgtgataaataataatccgatataaacaatacaaagaaatgagatgaaagataatttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagacaaagttagaatatgtgaagtttaatacatacctcccatcatttttactttcatatccaaataagactagtcaaagaaagactcataaaaacgttagtctcgtataattaga

SEQ ID NO: 47721 - DNA, 1501 bp, Oryza sativa
gcacactgtattttgtacattgatcagaaatacagtattgtgttcagatctgtacggtactacactactacacagcgtcagcgtgtgtggaataagtccagcaaaatatggaataagtccactttgactccttgaaaagtgaccagaatctaatccatgactctaaaccgcaaaaccggatatctcaacccccgaactattgaaatcgatgcaatttgtctcccttagcggttttggagggcgttttcgctgacattgtgctaacatggcggtgttgacctagtctgtgggattgatgtgacacttaggtggcatttgaattagaaacatatatgtgggacctgtttgacattcacacacaaaaaaatttgtgaggtgagccccacgtgtcatcctctctctctttcttcttcctcccctcttcctcccttctctctttctttctctttctctccccttcggcaggcgacggggagcacaggctggagcggcggcgggcgagggccggagtggtggtagccggcgggagctaaagcggcagcgacgacgagctagagccgacgccaacgagatcgagtagggggacggtggttgatggctttggcgggccaagagatgggtgtcggcgcggcctgagggtgctggggggagacctgagcggacaacgtgggaccgcctccttctcctccttcgctgccgccgccgccgctttagctcccgctggtcggtaccactccgggagagagagagagagagagagagagaaagagagagaagggatgaagaagaaagagagaggatgatatgcggggccaaacgggtcccacatatatgtttttaattcaaatgccacttaagcgtcacgtcaaccccacagattaggtcaacaccgccacattagcgaaaccgctaagggagtcaaatcataccgatttcaatagttcgggggtcgagatatccggctttgtggtttaggttcttgaatcattttttcagagagccaaagtggacttaatccgcaaaatatactcgactcggcagctgggaaggcccaaaaaaaaaagctaacataggcctgcaaagaactacttgggcattacctgctccacgtggcccatataatatggcccattaatttcgagattgggtcgtgttagttcacacggggcccgaagggttgatgggccgtttcttcaccaaagcagcaggcgctccctcttcctctccgaccccggccgagacgcacggcggggaagaggctcacagtccaagagcgtgacgcatgttcggtaccacgcgcacaaactgccgtgctcggcttctccatcgatcaccggcataggtgagccatgcaaagctcgccgggcgcccccaagctccggccaccccctataaaacccgccgctcctcaccgtcaccggcaagcacagcaaagcagcagcagcaaaggtaaggtaatatttgcagcatcgtctgaagaagcacaggagcaggggagata

SEQ ID NO: 47722 - DNA, 1499 bp, Oryza sativa
gcgggtgatccgtacagtcggatgctgcacgcttgcctatgacaggtgggggccatctgtcagcgagagctgcactatcttcttcctcgggcaagggaggccaccgacagccggggcacacgtggagcacggcgacgcgtccacgtcggcgcgcacccacgtcctccatcacaaggatgatgttctttgcttcgcgagaggatcgcgcgtacgtgatcggaaagggacgccgtaacctactacgcgaggtgaacgagaccgatcgatgggggccccaccctcgccgccgacgcggcaaccaccagccggccaccggtcgccggccgccggcgaccggtcgcgcgagagcgtacgtacgcacaacggtacggctcgatcgctcgcgcgtgtactcgatccgcgcacgagcgtgtacgatacaggcacatgacagaggtagacgaagacgaagacgaaacggagcttgaagaatattggcgtcgcttaattttcgtggacgcgtgagtcagacctactgccgtactgccaattatttcgttttcgattgatttctcgtcgtcaattgcaatttgcaaacactgcatcctttctcgatctcgctctttcgatgaaaaggagagtacgtagtaaaaactaaaaagttactgatgcaacacgcttcacatcgatcaaactgtaatttttggtccaccattgcaatcaatcaagcgagaggtgtactttactgattcttttttctttttctttttttgtttgggatatgatgcttgagacgaccaacaagctgatcattggatcatacagttgtagctccgccagaaaacagtactagtacatttgattaaattcagttcgcttgctgatctggaagactgaactctcaagtctgaaggatgttgctgttcctttcactgttcatcgctttggtgtgtatctctggtggttatggtataaagtacacaaaagaaccaggagaaaaaccgcaccaaaaagatcgttttcgtttgagatttcgataggtgaaatcgtgaaagcatcaaaggcacctaccaatttaactccacacggtatgcgctgccagatcatctagattactttggccagtactggttaagatttcaggggttaataattaagttgcaacatcaactcctatatagctacatgaagttgaacgatcagctgacaaaagagtgacaaatgaactgttagacgatgatattattgatatatacagatactcctaggtgcctgcccactcaattatgtatgctcatagtcactatgagttgcatcgctagcatgtaggatatcataggaaaaagattttagatcgttacactgttcatgaccaatgtaatggcatccgaataaagttcatatctttgccgactggcccgttctttatcacaaaaaagacactggattagcgtttattttgtaatggttacatgcacatatttatgatctaaagtggaccatggcgaacaagaatatgt

SEQ ID NO: 47723 - DNA, 1501 bp, Oryza sativa
gtgatcgaagatgtttacatggggcgtgtttggttgcccggctcgtacttggctcgcatctcggatgcaacttgtaggatgtttggttgactgtacatgtcccacaactaagcccagcggatgcaaaaactccctcgcaggcaggctaaggaggaacggccgaaacgagcttcgctgcttgtcctggctccacgcatgcagccgcgctgcacacacgcgtgcaagcgccgcacccgcgcatgcagggagaggcgatggggtcaccaacaccaacctgcctccctcctcatttcttccgtcttctctcttcgctatcgccggccacagccacaagttgcgaccatctccatctccaccagccagatctagctgcaagtcctgctcctccgtattttcttcaacaatgggccacgaagagctctccgcaagtggatccgaagggcatgagctcactactgccagatctaccagtctggtagcgttgaatatggcgggtgctcatcaccactttcctcaccccagagagaaggatgagctcggctccaacttcttcatgtcattgtcgtcgtcgtcgttaccagcgccaccaccttcctcgtcggcttgagctcgtcgctgcacgaatgcccccaccgcagtcggcagctaccttgaatctctctcctcctcacctttctttctttttttttttgagaacacttcctcacctttctttggccggattcagaattaacctaggaacttaggcccgccagatccaagtagccacaagctcctgaccgccagacccgctgcacccacggcggcgaacatgcctggctgggtggcacgagcggctagctaccggcggcgacaagctcctctgcgagctctcttatcattttcttttttttcttattctttcttttttcaaccgaatgttattaatcactaataaatatacttgatttactgctgtgtgaccatatatgcttttgacagtgtcttaaattattgtatatgctcatctgacagtgtcttaaattattatcgccaggaactccaatatcaattttttatacattctgcttatattaaatctgctacaatataccgtaaataaatagcttttacatgataagaattttcactctcaaagaaagtaagtactcgaacctactttccatacaatcaaccaaacaaaatctctttcaaaccgtatcttcgatgcaagcaaccaaacaaaatctcactataatccagctaaaccaatacaaccaaccaaacagctgcatgtgtatctacttggccaggctaaactcggtctggacgagagagatgggccaggctaagaagatgcgatcaaccaaaacacacccaggagatgggccaggctaagaagatgccatcaatcaaacacacccatggtttcacatcggagaaggcaaggtatattcgactaggggcagaggaggtgcagcaaaagtgctttcttttgtgccttcttttgcttcggggagat

SEQ ID NO: 47724 - DNA, 1501 bp, Oryza sativa
gcccgcggggatccaatttcccgcttctcgacggaaagcccaaccgaacacgcggcgctcccgtacacggggcaagggcaacgaagcaaaagcccacacctgcgcagtgtgtaccgtcgaacgcggcccatgcggcaacgggccgagctttttcgccgggccaacggggccgagctaacacggcgtacgtacaacagtgaagcaaacgagctcgccgtgctgcccagcccagtaataaacgacggatgaaaaaggctttcttgatagatgattctggaggcagctccgcagcagtaggcttggcaaggggagcaaggcagcaacggcttatgcgtcatggactcatggatgggttggcaaggtcgatcggtttcgatggcgcgcagcagatcgatcaaaggtagagcccgactgggatatggattggattccggttggatgagtttggataatgtaatttgatttggtaattatgttttctttaacgactcgcaatagacagtgtgaagtttatattgatagagtaggaaaaaaaatacaagattataaccctaggatgtcataactagggaaaaaagaaaaaaatgaccatcacccacgcaccgacagcaccaatacacatatctgggagaaggatagcaccgaatcggccatcgctaagcgtgactggccgccactaggccaacaaaggagttacaaccaggatcgcctaatgaccaccataacaaacgatgcaaaattacactctatccacgtcttcgggattgaggaagagggggtgagagagaagaatagaaccgctctcccctttaggtcctctgacatggccaacttgcataagtgttgacggtcattatagaccattttcgaccatcaacataactaaaatggaggagaactagctatgctggcaatgcatatctattttagaataatatattttcacttgtacttggagtatggagtattatttgtttgcatagattagcacataaatgaagaaaaaatgaagaaaaactcactcctaagcaagctcaaggaaagaggggacccacatgtcaggtgtaaccgtcctgaaacccacatgtcaggcccacctgtcaacatctctgccaaaattggaggcctgctgggtcagcccaggttcagccgaaccctggcagtggccgttcagctcgggcttacacgtggacgtataggattgcttgctaatggcggttgcggagcatttccgacatttcacatgctctacaaccgtcatacctacctatttaaggagttcttcatttcacttcactcgcacactcaagcaagaagctttgatctctctctcaagtttagtttagtgctctagtgctaagtggagtagaatataacagttctcggagtccttgagtcttcggaaggtttcgagtatggctctagtagtttttcttttttcttttgtaagactttcggaattaatagaatattattctttatatactttctatcgacgagt

SEQ ID NO: 47725 - DNA, 252 bp, Oryza sativa
tcgattcattcctgtctccaattgaaggtcacaattgcagctggcagctagctcaaatttccattttttgtttggttgtctctcggcagcaaagcagatatagagcagaggaaagctaagctaaattagttagttagattactagtctctggcagctgggtgatcttaatttgatcaaagaagaagaagaagaagcaagtttttttagctcctgagtatattataggattaactactactaggatagtactc

SEQ ID NO: 47726 - DNA, 1501 bp, Oryza sativa
taatgcgtctcttggaaggcgcgtggcgctggtgcgatcccggtattactccctccgtctaacagcataaggattctgagttttgattacaacgtttgaccactcatcttatttaattttttttaaatattaaaaaatgaaaagttatgtttaaagtactgtaaataataaagtaaatcacaaataaaataaataataattttaaaaaaaaattaataaaacgagtggtcaaatattgcaagcaaaaatttaaaatctcttatattatagaacggagggagtattaaacctatcatcactactactctactcctcactagagcacaagcttagaacaaatgcttcagacagttacgagaatagccgtccgtcggatcagagatcaacggcggagattgccgttcgggtgtgaggtcacgatgactagccggtgatgtcgcgacgctgtgcgtgtgcgtggggaggtgtatagtttggtctcgaaaaggagaggcgaggaggacgccacgctccgcgcgagcatttgctgcgggagaggagataggctggcggtcgtcgcgtgtggcgcgcgcgcgcgtacgcagacgtttgcgtcgtttccttgcggatggaggcatcgtctgttgacgtactggttgatactacgacgctgtcaaaattcgtaaagtgagcggtgagcgctccaggttggaatcgtaaaaatatcttttgtgttccaaccgggattgacatatggaggcgtgaaggcatcaaggcaccatttcaaataaaagagtttgttctaattctcatgccaattggacagcgtgcataagagggaaattatgtgaggaacgtctagagatcttcctgctagctttataaggtggtgggctagacggtttagattcaaaacatcgtcctttctatttatttgatattatatcattctctaatattcgtgtttaagagggaagttatatgaaaacatttgagttttcactcttaggagggcaaggtttgaatgggtcagaaatgttcttttggtttaatttaccgtcttcttaattgtttttaggtaggagtacaacaacacgacaaacatatacggtttattcacaagtcttacaaatcgactgatttgatcggatactaagcagaacaacgtaaaaaatgaacgtggtttttcctttataaaaacaacttcaagtaaaatccctgcaaccacttaacgcatacggtgttcatggaatacgtcatgtaagactatggaccacatcagctcaccactcaaaacgagagtaacatgtacaccgagacgcgcacaatctgcagtgtgacagaggttaaccaccacaaacccctcaaccacattacagcagctcgcaggattccctgtccccgaccccatctcctccacgatacacacaatctccggcgaagaaaaatttctagaacactagctacaaaaacgttctaaaaacacaagcagcccacgcggactcctgtgtggactccaccc

SEQ ID NO: 47727 - DNA, 1501 bp, Oryza sativa
caattctactaatcatcatgtttcttgctccaaggtatctctatgctgactctgaaaaaaaaagggccatgcatgcatgatagtttcagtttctgaatgtgtttttccagatttttcacatactttggtctttgcttagctctgcctgcatggttcgttgactagcataaattggttcaggtgtctccaattacattgcacgagtcctcgtgtgtatatggatcagggtttggttcgaaatttcagtaatttcgcctcccccctcccactggcaagctcacatctcgcccgaaattttcccttttttgctttttttttgtaaatttggttaaattttattgaaactcatttaaaattagtcaaattttcaaataaaattagccaaaaacttccgaaattttgataattttggtccccaccggcaagaaaactaattccaaaatttcaaaccctgatatggatctggccgtctaattgtgcgctataagatttgaaactaaactttttgaaatttagtttcaggaagacactctcgatggtacaataatgtatcaggtcttttgcaccccaaattggaaaggataatgaggtactccttctgtcccaaaataactcaacctaggatgagatgtgatatgtgacccattcttatccagattcgttgttctaggatgggtcatatccccctaggttgagttattttgggacagacggagtatgatgcaaatatactcttctttcgatcatcaatagcagcataaagcacctgaagaaagtaggggggggcttcaaatgaaaacgttttagtattcagtattcattccgagggaacttacttcctttttctttactatacacggtacaaatacaaatgcttacaaacatacctcataagatggtgggctagctagcctggattcaaagtctcaccttttttatttatttgatattagatctttccctagtgttcgcatcttttttttaataaagtcacataggcagctcgctatcgacaaacacgtcgtatacaaccaaaagaataattacttgaaaatacgagttggaacctgtgtatacagattcagcttcgcacatcaatctaatttcacaatgaagatgcttatagagccataattaaaaatcttgaatcctaaaactaagaagagaagaaaaagaaaaagttggaagaaaaaaaaatagaaatgcctttttttctgtgggccccatgtgactttgatcatgtcagcagggcaggccggctggatcagttataaatagttccaagtccctcataacttcctctccatcagaaaagcatcactccataacatccttaaccatttgcacccaagaaacgccattgatgatagggtaagctgctgagctaagagtaagagctctcacattagctagctgtaccacacactacactagcagctggagcagcacacacatcacactacaatgtgccactgctcgtccaaggtcgtagccgtagcac

SEQ ID NO: 47728 - DNA, 681 bp, Oryza sativa
tagaagaaaagctgaatctgctagtagtaccaaatatatacatccacggtgatatgtcctagcatgaatgagaatgtggtatacaaagttctcagaactggctgcgttcgggaggaggcacgcaaaacaaagcatattttattgtataattaattaagtattaactattttttaaaaaaatagattaatatgtttttttaaaacaacttttatatagaatttttttataagtttaacagtttgaaaacagtgcgcgcgaaaaatgagatttgtgagttaggaaaacttggggaagaacacagcctgattttactttattacaacattggagcagcggaacctccaaaatattgctcagaactgaatttatttgtagtgtcacgtttgaaagcggaaccttctcagaactgaaagcggaaccccacaattagtgatgtgtatcagaacaaaaggggaagctcaagtagagcctcagctgaggaatctatgctaccaaatatatgcatccacggcgatatgtcgtagcatgattgaaaaagtggagatagcaattagtatatgtgcaatcacagatgttagtatcgctcattacaagcaacatagcgcgttggtacacaagttctcagaactgaatttacttattacatggagaagctgaacctccaaaatcttgctctcaga

SEQ ID NO: 47729 - DNA, 160 bp, Oryza sativa
ctttttccacgtagcataatcgggtgccttaaatctcaactccaccctttcgttcttttttcttctttttgacatttttcgttcttttttttttctggaacaaggaagttcgatctcgaatcacgctccaaacaaagattactgctacaaaggcaagcga

SEQ ID NO: 47730 - DNA, 1328 bp, Oryza sativa
tgactcggaaatcgaagcggttgaagatgcctctgctcgtgttgcggatgtcgtcgaggtcgtcggcgatggtcgccgcggcattggggcggcagaggaagcgcgagcccagggagagggggttgacgacgatgccggcgacggagagggggaggaggtccgcgcgcaggaggcggttggcgtcgacggcggcgcgccatgcgctgcagacgacgcgcgacgcggcgaggctgatcggcgggaggcggcggaggacttccagcaacaggtcgtccggcaggtcctccatcaacgtcgccgtacgtgttccgccggcctcttcctttccttgcttcagcttcttctacttattaatccttcgtcactatcgatcggaaactcttgctcgttgggccgggttggagtccggaccggattcggacacgaacttgcgggcccataaaaaatgcggcccatttgccggtaaggaaaagtgaattttttattaaaatatttacataaataaaaaatttacaaaactagtcgcctatcgctcccaaagagcgattttgccgacgtggcatacagccattgaacctcctataacggccagccaccaaaagagccaaaaatgtgcaggcggtctccttaccgccctttaggaggatgattttttccaatgcgaggggccacttgcttaaaggatggtagggggtggtatttttgcaggcagtcgcatagtaaaaaaatcgtcctcgagagcggaagggggccgcctgcagaatttcggcgtcctcagtggccaaccgttatggaagggcccacagccatctgccaagccaataaaatcgccttttaggagggtgacttttatagagggctatgggtgactagttttgtaaatttttcaaatagaaaattattttttaaatattttataataaataaaattaaaaaaatcaaggaaaagtagggataaaaaaatctttagttgcgagaggcagcgagcccatctacgtcatccacaacgttgtatgaccccgcggctcgccaccgccgtgtcgcgtcgcgtcgcgctctcatatcctcctcctctcgccgcgccgcgccagggatggcagcggggcccaccccatccacggcggcgtcgttccggccgccgctgccgccgccgccgccgtgcttcgactacagggaggccatgctggggcacacgcgggcggccgcggtgaccgccgcggacccggcgctcgccgcgctggtcgagtcaggcgcactggtgcgcgttccccggcggcggttcgggcccgtcccggcgtggcggccgccggagttcgtggagccagagg

SEQ ID NO: 47731 - DNA, 786 bp, Oryza sativa
ctccgtcaatgtactattactatctctgttttatactcatcgttcagaacattcggtgtctgcaatattcatgttttaatatttttaatatatttataaaaacattaactaaagatataaccatatgaatgtgtttttattgacaaatatattagcgtcgtttttacatattaataaatctgaatattaatttctttaatactccattcgttttaggttataagaccttttgactttggtcaaagtcaaactgctttaagtttgatcaagtttgcagaaaaaacgataacattttcaacccaaaacaaacttattatgaaaatatattcgattattgatttgatgaagataatttagtattataaatattactatatttgtctataaacttagtcaattttaaaacaatttgactttgaccaaagtcaaattacattataacctgaaaaggagggaatagacagtattagtagaccgtgctccctccatcgtataatataagagattttggaggatgtgacccttatattatattgggttaatggactcgtgccattacaaatttctggtttgaaaaaataccactactatttgtgaaaactactgtgtgccattgaaattttttaaaattcgagacatgccatcaccgttacttttccaaaccaactgcgtcacgtcgaatcatgacgcttcgaaaagtcactgaagcatcacagtcgtcacgtcgaaacattcgaaacatgacgcttcagtgattcatgagcgtaggagtagcaatttatgagt

SEQ ID NO: 47732 - DNA, 1501 bp, Oryza sativa
cttgaagtccgtactgcagctggctacagatctataacccgctactcttctctctcttcctttatatgtttaaaatatatttatatctggcttatagcctgctattgtacctgctattaaaatggagctgtagatcgagatcgatcgatcatcagtacgaggattcagcatgaggaagtacgtttagcctgctgaacatttgcctatatatattcagatcatgtaccaaatggttttaattaataatggaggcagatcttgtaccgatatatctatatctgtatgcatcgtcaagttgagcgcatcggaacatgcattactggctctgtatgatttggcagaatctgaatccttgtccatatattgctagctagctagcttgacataaatcgatcacatgtatcctcctacttgtaaatattttcttttccttgctcgtgaagcgaatctagcagcatgtagtcccaaaaaagatctacacataattatcagaagcttaagataatcctgctaagaaatcaagcttccaggttgtgtgtactagtgtaatgtttggtttaccagatccaaacaaacagcttgaggttagcacttaggagtggctgtagcagtgaagttcttcaggtaaagaaatgcatgggcaaagtgatcagcggtccttatattgggccgtacagtaagcccaatacgacccgtgcgaactgttgacttggccgctagcaatggtagcggcccttttgttgatgggccaaacggaggcccaacgttttgcttctaggcctgctcagccggagctctcagggggttcggagaaaaagatgccgaacccaataaacggcaaagtatcctacgcacacataggcttctcgtgtacactctctacataccaactagtaaatgtcttagaaaattttacaaaaaatatgacatgtactcttaataatactacacatattacaaagtcttacattcaaattcattgtattttagccgtaacaaaaaagagaaaaatctaacaattgtaagagtaaaaaccagtaagaattgtcttttttttttgttacggctaaaatataataaatttgaacatgagatttcatagataggtgtaatactattgaaagtatgtgtttaattttttatataattttctgtgcacgggaagcttgtatccgtagtatatgttcccccaataaacacggattcaaaaatgccggcagcccggcactggtgctctagcttgttcttgggcatcgttcaattggcagcagcacatatagctgcatacggctatatatgtattatttcatagatgattgatgatttctgatcgatgtcaatgctagttaatttgtttttgcaatttggacgagcttggaggtccctcccggccctctgcttataaaaacaatctttttgtgtttgcactgtatatgtatagatggttgctttttgggggtgtgatttgaaactctagaaagtatatctcctcgtttttaga

SEQ ID NO: 47733 - DNA, 369 bp, Oryza sativa
aaaacatcacatcgtatctttcgacacatgcatggagcattaaatgtagattaaaagaaaaactaattgtaaagttatggggaaatcacgagacgaatcttttgagcctaattagtccatgattagccataagtgctacagtaacccacatgtgctaatggcggattaattaggctcaaaagattcgtctcgcggtttccaggcgagttttgaaattagttttttcattcgtgtccgaaaaccccttccgatattcggttaaacgtctgatgtgacacctaaaaatttttatttcgtgaactaaacagaccctatgtagtttctactcataaattgctactcctacgctcatgaatcactgaagcgtca

SEQ ID NO: 47734 - DNA, 1501 bp, Oryza sativa
gtatatgttcccccaataaacacggattcaaaaatgccggcagcccggcactggtgctctagcttgttcttgggcatcgttcaattggcagcagcacatatagctgcatacggctatatatgtattatttcatagatgattgatgatttctgatcgatgtcaatgctagttaatttgtttttgcaatttggacgagcttggaggtccctcccggccctctgcttataaaaacaatctttttgtgtttgcactgtatatgtatagatggttgctttttgggggtgtgatttgaaactctagaaagtatatctcctcgtttttagagcttttttacggtacattctactgctagtatatactaccagtatatttgatctgacggtgtaaatttatctgatttccctcttaattatactgcaatataaattggatagggtatatttgtctttttatctttttgcgtgggagggtatttttgtaaattaatgcgaactcacttagtcagatccgtttcaccacatcgactcaaactgaatccgctcggctcgcatgggcgaccgccgccgctggcttctatgggcgccgcccccgccgccgacagccacagtcgccgccgccaccgggagccaaaatcggcgccgccgccatcgaaatcgattcgatttccctcctcctttcctcctctcgtgtcttttccgtccacccaaaaccctatctcttccaaaaaatccccaaatcggcgccggctgctgggtctacgggagggcgccggctgctgggtctaccgaagggcgaagcctgctggggaccttgtctgccgcagtggcaggggcagccggccagcggtaggcggcagcggcaggggcagcaggccggcggtaggtggcagcggatggctgtcgcggggcagaccctcttgttcggcgcgggagcgatgtgcaccaggagcagcgacgctggaaacgcgagatgtatcgagaagaagcagatgacgacatccacagaaaaaactaacgaaggaaaattaatccggatgaaattaattctctaatttaaaggaccaaaaagccattttcagacttttacctaataccaaaactacccttgtatatactggtagtatatactagcagtagaatttaccgtaaaagtcctcttattttatactaggtatcaactcaactgtaaaattggaaaataataatgatatgatatattaattcacaaacattaagttcaaatataattacaaacatactttaatttgctaactaacattgcattataacatacttttaactttcataagaaaagctgcgagacgaacatcagccagatggccaccggctgcatgcatgcgctactgcacacgctctgttgagcgatcgccggctagcgggagagatggatcagaccctgttaacaaatggactaaataagtagtttagtcatgcgtttggcaggtacatcgatctcgatccagacgacaaaccaaatactc

SEQ ID NO: 47735 - DNA, 434 bp, Oryza sativa
gggcactgcgggggtggtgtgatggtggttaaggggccctgctgcggcggtccagcgccaaaggggcgttgaggtggcacggccgcgaagggcgccgcaggggacgcagcagcctgcgcggggctgaagcggcgccgaacgacggggacggcggggcagcggcggcgccgggcatgaaggcggagacgggcctcccgggtaccccctgcggcggcctatcgttccccatcggcggctgcatcgtcgggcactccgctgctgtcacgcattgcttggcgcagcttcccccactccgccgcctccgcgtaacccgttgccgccgccgctccatggcccccgccttccgcccgtagataggctcagcaatacccctgtctgattcccgttccgcacttacgtttctccgccggaatccacagtagcacccgtcgcca

SEQ ID NO: 47736 - DNA, 1358 bp, Oryza sativa
aattcctgcagcccatggaaatgatgggttcaagagcacatcgcactccggaagaaataattttcgttgcttagcttagtgatggcgttatattctatttcatttcgaatgaactacgtcccatgattttcctcccgaatactattaatatggctgcaaagtattaccctggtactgctttgatgttttcttttaaggttcatgtgcaaaaaagtacttagggagttagggtagagcaaggctcacaaaacagcaatatgttgattggatagagtagctccatagaaataaatcttgcagtgtgatttttttatcttgtagatagccaagaacctcagagcatcatttgcttgaattatttgtttgaggtggctgttgtatggagtgctgcctagtgtgcactaaacaaaatgctcagatcctcagagaaaaatatgatagtggactagtggtattctaaccatttccaactgatgcaagaactacaccttctttttcgttatatattactttcaaatttgatccctgtcaattgttatgtttcagttagtgcaatgattgcactttactcaaagctggatcttagatggtatgatactgattatcttttcccatgtgttgctccttacttttgcagatggagatgtagaaactcaaacaaattggaaaggatacttcaatgttgcatcttatgctccatatttcaatgttgatactgatgttgtagttgacaggctcatcagctcggtttatccaatggatgggtttttcaggaagattgatgctaatcctgacatgtaagtatctcctattaggctattaccaatctgtggtcacccttcacgtttaaaaaattcgaccttaagtacctgctggtattgatgtcataatttctaatgaatggattcatgatgataggatacaattacagcgaaggatcatagaattgtttgtctacattatataatgtgttgttaatgtgcaagtgatgttttaagttgcatataacatgccataaatatgttttgaagcagtttcagcgtgacatagacatttggataggtgaagtactgtatattttacaaaactatgttgtaacagtgctaaggcatatgctgcaataatcgagattatttatctaggactagaagcatgattttaaggaggagaaggacatgcaggttttttcaagggacttttgacccattgttgtattggtgcatttctgtagtaactcatctatgcttttgcattgtaataattttgatacctggagccaacttattcatatgcgataaatcattctgctgtttgcaggtatgggcccttatggatcacaacaacactgatattcatgc

SEQ ID NO: 47737 - DNA, 1501 bp, Oryza sativa
tgttgctcaggtctgcctctcttttttaccttctacgactagataccatagcatcataaccttcccaacagtacacagaccacgcctttatgaattttatttagtagtcttttattgtagcagttcattatcaaattgggttaaaatattctaatacattatattttgcttttgacaggtgagcttgatgttttgtctgctccaatcattctgttctggcgagcatccttttgaggaccaagcggagtagttttacttgacatacatattgacactagattgatagacctttgtgttttgtgttcatgagttttttttactcctttagttcacagaacttcactgtatgtttcaattcggaattgctgagtttgtcatctaaaattgcatagtgaaccttcgaccattttgatctacaataaccatttgactatattttgacaaatagcgtgttcctgctcttggttgagtgattgacaccttttttttagtttgaacaatcagcgtctctgtagcatcatttttcaattttcatgttatcgtaacctgctatagtcattgaggtatagtttatatcagtgtatgggtacataacatgcggttcccaacgactacctcgtttttgtgcatcacaatatcacatcactcttcatgtacaaaaactgaatgccatcagtgtggcataaacggagttcttctgaccattgtaaagtttgtctccagcctgcccgcgaaaatcacgagtctggactgaattatgctcaattctaaacattcctgtagatccttgagtgattaactcttttgctaggattggagaagaacgataaaagcttttacacatatcatggaagaaacctttgtagtgaatgaattgcataatcgtcgtagtagatcccatcaaacgtaacgtgtgtgagaacgtaaaactacagctcaaatagagctacgtttgttaggagactagcagcaacgcctccttggtcacagttgttagcagaaggctgcaaaactggtcactggtgctaatcaaaaccgcatggctagcctggatgggccgagacaagccaatgctgtcttagatgggcctagccgggcctaactcctcaaatacatactggtcttaatgtaagcccaagacagttcggtccactaaaaaatactatctcgctgagtagactgaggcacgcgtagaaaggtaatacgcaagctccttttcaaggcgtaatttcggcgagctctgcaagtcttgaagacgtaaagaatgtctcatcatcatcggtcccttgtccgttgtgctcgatgggctcctccgccgccgccggccgccgcatttgccgtaacctcgccgcgccgtcctggtgtacaaatttttcctgcacacgcagggccgcagtgtagagtccaatccaatccaatccaatctccgctgacatctccccactccaagcccacacgggccacggccacacatcgacgctctccgtccgtagcatgacac

SEQ ID NO: 47738 - DNA, 344 bp, Oryza sativa
atgtgggcaatgctagaaagtcttataatatgaaacggaggaagtattaagttcgcttgatgttagcccaagcaatacaatcacgcaaaaattagttagaagctaatttatttcttcacaacctaaaacataccctccaactccagtggtattctgcatttctcagcccccatttattttctcttttatttcaatataaactctatatttttgcgactaattcaaacataaataaatatttctaacacttcgaattgaacaatatttaaattcacaatttggaggcgggaaggagtcgggcggcggggaaggacggtgaccgcggcggctggacggcggtgagg

SEQ ID NO: 47739 - DNA, 1501 bp, Oryza sativa
cgcggcggcgcagcgcgcagcgagggtagtattagtacaccttcctcaccaagggagatgggaggtggtcggcgtacggcaggagaggccggagtccggcgtgatgccgtgatgacgccgcaacgcggcatccgcgagcgggggccaccgccgcggcagcgggggtggggaggaggtgacgaagctgacctgtgcgcttcggctccatattcccggaggagtagaacggccgcgcggtttgccggccgagatccttcccccgccgccgccggcccgccgcgccgccgcgccggtatcctctgcccgcggattggatcgtgcgtgggcgtgtggcccaaaaaagaatggcccacatgtcagccgcgatccagttctagcccaacaactatgggccgcgccttataccgttccggcccaacatggatgggcctaacgtggaatccaacggtccagaagcgtcggcaccttcagctcgacggtaatggggaaagacctgagaaaaccctcgcaaaaacctttgcggcgtccatggccgtctcctctaccctacggcgagctcgatctcacccctcctgggcggccgccgcgcgcggcctcctcgccacctggggcgccggatccggcggccgcgttcgtcatccgcggcatggcgccgcgtccgcgtcgttgttctcatcgttgtccagttctcagacgagcgccgccgacgcacagctcctccgggtcataaacatggagatctcctacgcccagaaagattgcaagaatcgcaactgggtatttactactcatctcatccctcactgatgatttccgtttttgtggacaaaagactcagagagaaaacaacatctgcgattaagttcgcctctttagagtttagacgccgcttgaatcgtgttcctggctatgaggctcatcgttccgcttatacttatgcttatccatgcgacctttagcaaccaaaaattgatttgggggtaaaacttttatatatgtccttaatgattcgaaagtaaatgttgtaaaataaactgcaatgaaaaaaccgtaaaatcaacttgaaaattaagttttaaaatttaaattttggcttataagcataagcaaaacgataggggctataaactttgtttgttgcaatttatgggcacgtctgtttagactttgaaaggaaaagtgtaccattatagtacatggcaaactatatcagacaagaagcttactaggggctgtttagattgtagtcaaaataaacctaatgtcaaaattttggcaatttggcaatatttccaagttttggcaggatttcttatttatttactagagtttggtaagaaactaaatggatgcacatatttagcaactttgctaaaaaatggtatagtttgaaatggcatcaatctgaacaagccctagatttctgagatgctgaaagatgccatcctttttaatatggaattgtaatgtgtgtttatgttctgccagtcaaaggaattag

SEQ ID NO: 47740 - DNA, 1501 bp, Oryza sativa
ccaaatttattgtattatgagggatcatattgtaattgagaccggaccggtcattgaaccggcgaggccctcggtttgatgggtcattggtttgaccggttgataatttattcatttcaaacacaagcatagcttggtggttggcgctcgtgcttccaatcaacccatcgtgggttcaaatcctacccaacacacattttacctatattttatcctctttccccagcatgcatgtgcaaccgttttacctatataaaaaccggatggtccgctctggttctggatttgaaaaccgggcggtccgctctagttggtttttttccggtctaaccgccggtctcctctttcccccgcgtgcgcctgccctctgagctactatagcattggtttttttccggtctaaccgccggtctcctctttcccccgcgtgcacctgccctctgagctactatagcattggtttttttccggtctaaccgccggtctcctctttcccccgcatgcgcctgccctctgagctactatagcacctgcctagcggtttagtgcagtgccgatttgaaaaccggatagtccgctctggttggtttttttccggtctgaccgccggtctcctctttcccccgcatgcgcctgccctctaagttactacagcacctgcctagcggtttagtgccgattttctgaccggttttaagctgttttcccagaaaaccgagtggtccagctggtttttacgtgttcacatgcacaggcaatcttttagctggaccagaccggcggaggatctggtaccaccggtccggctcctaggttttttttttagacggatggagtaggttataggtagtacacactgatcacatggtgcccttgattcatcgatcgtcacagccaaggtgaagcctgaagctgctttcgtcgtcaccggttgccgtctgattgtggacggaacgcaataaaaaccgtggtccaaacagggcatatacgtggattttgatacccagatttttaacaatctctccccatttcgtgacgcgtcctgggatcacgaagcagataccaaatgtttgttacatctttttccctgaaagaaccaaatgctgtttgtctaatccaatcgtaaagcgcagtgcttcgctcttctgatcacacaatttgcttggctccttctaaaacctcccactgattttttttcttctctccttggaatgattgcaaagataattacgtgagcaggaccatgaagccaagaaaaatctgacgctgccactgtcgttttcttgcgtcctcaacttgctaaggcatcgtgtctgtcacgtatggcgataagcatcgcagcgtaggccgtgtactctttgttctcttccgctaaaaatagacgcatccgtgccatttcatccctatttaatcgtcacatcactagctcatcagtcatcacctgctctctgcaaacactgtgactttgggtgagtgagtgagtgagtgaagaggaggaaga

SEQ ID NO: 47741 - DNA, 1501 bp, Oryza sativa
gtgtgtggcgaaaaaggataggaaagttaccttctcgaacgcagcctaacaacgttatcgttttagacatcgacgcggtcttactgatgtcggtaaatttccatatcaccgctaggtctttctgcgatcgcaaccgattcactacttacccaagaacaaatagaatcagacaccgaaaaaaggacacaattattcagagtaaattgttgacagcaacttgggaggcagccaggcagggaggtagtaggaggggggggggggaccccaactttgggaggctgtaggttgcaattgctctgaccatttcaacccccggggaaatgtttgcaagcttgcaattgcaaggtgacgatgccattacggaatcgaaggccaaacaacagatgccacaagacaagacggccactgcttgctgctgtgtgtttgatggatgcactcatcgcattagcacagtgctagtgccatgtgagatgagggggtgatggtggcaaaaggcctcctcatctgtggaaagatggttggaaacgagtgtggagtgggggtgattgaaagcgccgtgtgccgggcggtcagagtgatgtactggtgtttgtgtttgacctgcctttcttgcttcagctcggctgctcattgaccctttttttaaaaaaaatgaaaatgctaagaaattttgatgtatatttttttaaaaaaaatgaaaactggatcattgtatccgcatcaaaactcactcggacccttctccttttaactatagagtgatcctcgttgacgttgagaacctatgaatgaattaattggcgtttgagattgggattgggtaattgggtcatgacccatagcagtgaccaaattggtatgggtgatggatacgagaggtggacggaggcgagggaacgggagaggttaggagacgagagcggcggttacataagccactggagatggggaggaggaatgggagggctcactagtgtagcgcgatgaacaaggggtttggcaacgagcatgccgatttgagcgaggagagggaggggataaggtggaggcatgaggctgcatatatatcaaaccgatatgagccatttgaaaagtagacttggtggtcttaatttttaaatatgatatagataatcccttattttaagccccctgttttttttttcatccgatgaccggggctgcaccatagcatcggtgaagccatgacagtgggtcctaagataagggttggccgacatttgatatttgtatgaatgcataccgttctgttgttgttggtcagcttatcagcgcaaccaaaatttaatttaaaggtttttctttgtcataattttttaatattaactttaatggaatcatatcctatgcataaaagttttcacgtgtacacatcatacacaccaactaacaaatttcatcgaaaattctagaaaaaatatatatgtactctcaataatattacatctacgtgtaattcatcatatatatatatatgtat

SEQ ID NO: 47742 - DNA, 1501 bp, Oryza sativa
tcttgcaatctttctgggcgtaggagatctccatgtttatgacccggaggagctgtgcgtcggcggcgctcgtctgagaactggacaacgatgagaacaacgacgcggacgcggcgccatgccgcggatgacgaacgcggccgccggatccggcgccccaggtggcgaggaggccgcgcgcggcggccgcccaggaggggtgagatcgagctcgccgtagggtagaggagacggccatggacgccgcaaaggtttttgcgagggttttctcaggtctttccccattaccgtcgagctgaaggtgccgacgcttctggaccgttggattccacgttaggcccatccatgttgggccggaacggtataaggcgcggcccatagttgttgggctagaactggatcgcggctgacatgtgggccattcttttttgggccacacgcccacgcacgatccaatccgcgggcagaggataccggcgcggcggcgcggcgggccggcggcggcgggggaaggatctcggccggcaaaccgcgcggccgttctactcctccgggaatatggagccgaagcgcacaggtcagcttcgtcacctcctccccacccccgctgccgcggcggtggcccccgctcgcggatgccgcgttgcggcgtcatcacggcatcacgccggactccggcctctcctgccgtacgccgaccacctcccatctcccttggtgaggaaggtgtactaatactaccctcgctgcgcgctgcgccgccgcggccggcgccaaatttctcttgcacggcctgcttgatggctgcttctcacggttcttctttttcttgattttccaggaaaaagactcaggcagtcagactgaacaatgagcttatgagaatgctagaaatcgacgaactcaagacagtttttgggatccatcacaaagtgttcatccctatcctggatacatttgattcgaagcatctaaacacggtgaactgttatgcaacgccacgagcagctgaactggggaactgaatttggctgctggctttagatctccccgtcccagaaatcctccagcgacttgtaaaagctcgtcggatgggtcaagaattcgtacttgaaaagcctaacctgcatgttgcaaacagaacgtacagctcaggaaaaatctttagagtatcaggctttcagcaagtaatttgtcaaaatatggagccatgcctgttgaatctcgtagaactttgccatcagttcttcagggatgcaccagtcaaatatgtcaatgttctcccttgtccacacctcattgtcgctctttgggagcacgctctgtcccatctgaataccccagcgaagagcaacctgagcaggacttttctgcagcttcttggcaatggaaatcacagtaggatggctcagaacgtttggtccatcgttccctggtgatccgggtgaacctaatggtgcatatgcctgcaagaatagcatgaaaacaaatcagagtgaag

SEQ ID NO: 47743 - DNA, 1501 bp, Oryza sativa
gccaaggtatgcagcggttgaaatgagcccggtgatcaccagtagtatactctaaaataagagcttccagaatccatttaataatacataattgaccactctagatgagacttagagaaacctgcaactgacgaagctaatgcaatttgaaatagagaaatcgcatcttggcaattgatctgccaaagagaaggcaataggcaagcatcacagctcaagtaatttattttaagggtgagtcaagtcaatttatatttcagaaagactttcgaaacaagtttaactagaaatattagctgctgaagtcatacaacaaaatcaagatgctgactaactacttactggcagcatttaaaaatcattgtacacttgagagaaaacatcttatgtcactgaaattttacttgtcccaaatatgctactcatatcgcaaactcatgcccatttatgccatcagagatgcagcggccaagttatctattatctagtaaacacttatgccatcaggtgacaattctaacactgccaatgcttcttccccaatgaactcgccttcacttgttcaatggcagtggcgggcaggttgtgctgctggtgcggggtccgtgagctgctggacactgcccggtgatgtcctgtccccggcaggtgaggggcctggctagctggtaccgcagaagatggtgagaggctgagacctcagatcagagtggcgaactggagtgctgacctgatgccatcgcctggcggggactcgttgaggtgaaacattttgtatatgttttaaaatactttattgaattggcatgctttagttagccacacaaaagttacatttacacctaggaaaaacgtatcgcaggttactaaggaactgagcgagtgagcagaagaaagcagacgtcaaactacatccaaaatctgtgataaagccttcttttaaacaaatgtccaaattactgataattttgccggtaaagattctggattccggttcttgtaaaaatacacgccagtaccagcaaaatggtagctgtagacttaaactccttttattcattcattgattaacatttccccactttatttgcagcaatggcagtttccagtttttcacccacacgaagaaagcaaacttcagtccagccaagtcgatcattagatttcgccatcccaaagctcttcgattgatttgtagacgccttccgggtgagtccagaattctccacggatcagcttcatctgcaaatcaaaatcgccattcatgagaaccatcaccaattcaccatcttgcccaaaaaaaaaagacccaacaagaacagagtttcagagcgtctgctgctgaagctgactccggccttgcctgctcgatttcagagagcttgatgaacaggtcctccgggatggaccagtcatagacgtcaatgttctccttgatcctctcctcgtgggtgctcttcgggagcacgctgtgccccatctgaatcccccaccgtagagc

SEQ ID NO: 47744 - DNA, 481 bp, Oryza sativa
  unsure (1)..(481): unsure at all n locations
acccaatgtattctttaacagtaaaaccttaaatcaatttatctgttggctcaagcccggcccgtgagcccccgaacccattcatcatcccactagcgttagcgtaggcggaatagcatcctagggcgcacgcgtcacgccccgtccctcctcccccatctctcctcttttgaggaactcaatcacgcacaaaaattaccagattacccccaaccccatcatcttcgatctctctctccaccgcggcggctctctctctcttttctcccccacccccaaccaccactttcttcatcaccaaagcgccggtccctcgccgtgggcgncaccttcggcgnccgcggcggtgccggtcgtcgaggcgggaggacttcttcccgcgcgccgcgcttgatccgtnccgttcccagtacgcccgaggtgaggcccgtccccttcgattgggtcctttcttcgctctcactttttccttccccccagt

SEQ ID NO: 47745 - DNA, 1501 bp, Oryza sativa
tcaagcgacatcgctgacgtgtctctgtggagctactagcattgaagcagacgcgcgtcatgctcttgtacataaaagagtgacttcctaattaacagcagctgagcatgtatggccttgtatatagggtttttttttttttgatcgctgtacatttttcctacctctggaatctttgattcctatgtacggtttcctcatttcggcatgttttgagtgattgagagtgaaattataaaaaaatgtcatgcataatcaaagactagggaggaccaaaatattgcaaatgaacattgtttgtgtgtcgctacgtttcattaatagtgtagaaagccaaagttatgttttaccccgaaacggctaaaattcaccaccggtttttaactcaaatcccttaatttcaactcaaatcagggggccgttccagggttccatatttcaggctgaaaggcattgtttcggctagaataatatttttttcagttaagcaaaatttgatcatattcaactttgtttttctagtttttgttttttttttttgaaatttcaattctacccgatcccctcgaaatgttttttatttatatccctagatggttccaacgacataaaaggtaagaacataatttttattttttttatttgaaatttaaaactagaattattttgacgggatgccagcatgaacagtaaccggatgtatcgataagcagcatgaacggtcaagatcgtcttggatctgtctaggatttcccttatcattttcggcacggttaccgaaactccatagtaatatagttatcacgataaccacgagacatatcgtggttttaaaaactataaaacgattttgtaaaccctggatccatctgttgcagggtcctaagtgtgcgtgcacttcaccacacacgcacccaaaatactcttccgcttgggttgattagttcctaacaatatcaaaccaaaacgtcatttcgtgagaaatcgatggacttcgatcacagctaatacccgtgtacagtggcgaatctagaatataaattgagggggtgctagagcaaattagagatatgtcaactcgagaaatatttttgatgaaacccaaatatgcataagatcaacagaaaacacattgtttgctccattttaatttccagttacattaatatgcatctacaaaatgtatgaacaaattagtattttgtactgagagagtgtaagagtgcattatatatttgcaactttaatcaccaaactcttcagctaacatcctggcattctttacgtgcggccaattttactataaattactgattatactcactaatgactaactaaatacatgggacggagctggggcttgcgcaccaacaagcaccaacaatggattcgccgctgcccgtgtataagggtgtgtttcaggagaggagatagagaagatcggaaagatacgcaaaacgaggtgagccattagtatatgattaattgactattaagtatt

SEQ ID NO: 47746 - DNA, 349 bp, Oryza sativa
aatcgactagctatgttacttatgtccctacctgaactttatgtttaccatgtttaattcccctagctcagttattggaatattacagtattagccctttttagttcaagattaagttgcgtcttcaagcctcggcccctggtttcatggtggtaattatccaattaaaatgcgactgaatggtggtttgtgggtgcatggtttaatggtcgcgccatgccagttaagcccggtttcgcggaacaccctggaagttttcctcgtcttttccacaagccagggtgggcaccggctgggcttgtagtgtagctttcctctagctgacgcatccaggcaagggtgggcgtta

SEQ ID NO: 47747 - DNA, 1501 bp, Oryza sativa
agtgagccctcccattcctcctccccatctccagtggcttatgtaaccgccgctctcgtctcctaacctctcccgttccctcgcctccgtccacctctcgtatccatcacccataccaatttggtcactgctatgggtcatgacccaattacccaatcccaatctcaaacgccaattaattcattcataggttctcaacgtcaacgaggatcactctatagttaaaaggagaagggtccgagtgagttttgatgcggatacaatgatccagttttcattttttttaaaaaaatatacatcaaaatttcttagcattttcattttttttaaaaaaagggtcaatgagcagccgagctgaagcaagaaaggcaggtcaaacacaaacaccagtacatcactctgaccgcccggcacacggcgctttcaatcacccccactccacactcgtttccaaccatctttccacagatgaggaggccttttgccaccatcaccccctcatctcacatggcactagcactgtgctaatgcgatgagtgcatccatcaaacacacagcagcaagcagtggccgtcttgtcttgtggcatctgttgtttggccttcgattccgtaatggcatcgtcaccttgcaattgcaagcttgcaaacatttccccgggggttgaaatggtcagagcaattgcaacctacagcctcccaaagttggggtcccccccccccctcctactacctccctgcctggctgcctcccaagttgctgtcaacaatttactctgaataattgtgtccttttttcggtgtctgattctatttgttcttgggtaagtagtgaatcggttgcgatcgcagaaagacctagcggtgatatggaaatttaccgacatcagtaagaccgcgtcgatgtctaaaacgataacgttgttaggctgcgttcgagaaggtaactttcctatcctttttcgccacacacaagatgagaatagttattagcatatgattaattggtattaactattataaatttaaaaatatatatttttgatttttttaaaaaaaactccttgataaagcttttttacataaaacggtatggtttagtagttcagaaagcgagaacggtgagttggtaaaaataaatcgggagactgagccgaaattcagtatggaattcacatacataaacactcaataggagtagaaattgggccggtcagcgccggcagcgcaaataggggagccatatggagtacaagacaaggcgtgaatgctggggaagacgagcaacttgatttggtttctgaccaaattaagagaatatctggaggttgggggctttcacacctaatattaaaaaaaacatgttcttttcttcacctttttaaacaaaaaaatcccctttccctatataaataagtaaaaccctatcctgttcctatatgatcatcttgtcagtcagcaggatgccattgactggattgtagtataacaagatggatgat

SEQ ID NO: 47748 - DNA, 1501 bp, Oryza sativa
gcgccgccgcggtgcggaggtgatgtcggcgacgttcgcgtggccgggcatgcgcgtccacgccgccgacctccgcaagaagctgctccgcgggaggcggcgcggcggcggcggcgggcaccggagggggctcttcgtgttcccgctggtgtcgcggatgacgggggccaggtacccatacctgtggatgagcgcggcgcacgaacaagggtggcacgtcgcgctcgacgcgtgcgcgctgggcaccaaggacctcgacacgctgggcctctccctcctccgcccggacttcatcgtctgcaacttcttcaaggtgttcggcgagaacccctccggcttcgcgggcctcttcgtcaagaagtccagcctcgccgcgctggagcgctccgtcatcgcccgcagcatcggcatcgtcagcatcgtccccgcacgccgctggtcgctccacgacggctactccaccgagctcgacccggtcgccgcggcggcggacgacctcgacaccaccagctccttctccggcccactcagtggcaccctcatcgcgctcacactcaagaacgtaccggagatggacgccgcaggcgaggagaacggccactcgccggagatccgcgaggccgatccgccgccaccaccaccgccaataatggaggtggagtgcagggggctggaccacgcggacgcgctggggctgatcgccataggcaaccggctgaggtgcatcagcaactggctggtggtggcgatgcagaagctgcggcacccgcagtcggagcaggggaaggcgctggtgcgggtgtacgggccgcgggtgaagttcgagcgggggccatcgctggcgttcaacgtgttcgactggaagggggagaaggtggcgccgccgctggtgcagaagctcgccgaccgccacaacatctccctcacctgcggcttcctccgccacatctgcttctccgacaagtacgacgccgacagggccgccgtcctcgagcacatcgacggcggcggcaagaggaaggacgccgccggcgagatggggatctacgtggtgaacgcgtcgctggggttcttgaccaacttcgacgacgcctacaggttgtgggcgttcgtggccaagttcttggacgccgatttcgtggagaaggagcggtggaggtacaccgcgctcaaccagaagacggtggaggtgtagccgacatgtccatccaccttcagcttccaccattggtacacttcactgtcactgtcactgttcgccattcttttgggatcagctcgatcggctgtgcagagctgctccgtccattctttgtgtgagagaggctcgctccagtgtgttcatgattatactgtaaaatgtagtctttgcttccttagaaaaaaatatgtgcctattacttgttcgctatactgaaatcatttggttgccatctccaggatatgaattctgcatcattgtttcaaagcagaaaaagttacagctattttcttttatctg

SEQ ID NO: 47749 - DNA, 210 bp, Oryza sativa
caaacaactcgcaacttattctatatcagcttattataatccagcttagagtaatctgatttaataatctggattacaataatcttaagctgaaacaaacaagaccttaataacgttcatgaactgcacactgtacactagtgtctacctggcttgtatttataagctgatacgtaatgctatctggtattggtgctcactgatcagata

SEQ ID NO: 47750 - DNA, 241 bp, Oryza sativa
caccacccccaacaccaccaccaccaccaccaccaccaagaaccggtcgccccggtgcgccattaccccccaaaacgatcaagaaaccacaaaaaaaaccagaccaaaaaagaagaacaaatctcccccctaatctacacctcacgacatgagagagagcttgcttgctagtgagaagattactttgagctggagttgcttaagccgcaccccagctcgcatatggagctagacgaggaga

SEQ ID NO: 47751 - DNA, 328 bp, Oryza sativa
ccgtttgtgttctgcatgttcaatttgactctattgacacactcacttctcatctggaatttttcatattcagataagttcgggtattttgattttaactgcatagcatcggtgatttattttgctgttcaggtcatataaggagtatgatttaacacaggatctttctgatttcattatgagcaaggttagcttatctcttttctctttaccccatattttttggctgttgctcaaatgtgcttccaaattaagctagaaatgcaatctacaggcttctcctccatactttacgggatctccaccagttcgagcaagcaatccactt

SEQ ID NO: 47752 - DNA, 1501 bp, Oryza sativa
actaaactatataaacctctttttcgccagcattatttttcaattgctgagtagggccaagacttactcataacacacattcacccccacacactcacaccttggatctgtttgtcacatctccagctcaagctagagttcagccaaataatttcagtttcataaaaaataggagcagaactgggtggagttttctcacaaaatgaactagagagatggagatgggtttatgcagctctaaaacttcactatagactcaactcctgaaactaaatttaggtgtcgaagctctatcaaacaagccccttatccctacaaatatctccaaaatatcgaagcatttgtctcattgttaattggcactctctccgtcccaaaaaaaacctaatatagtattgaatgtgatgtttttagtacaacgaatctggacatactagaaagcgttcaatccaatactaggttgagttttttttggacgaagaaagtatgtcgtacatcactgaaaataattagtcgaaaatgataacacttttagcaaatctaaggcttaaatccggatggattggtttaagcacaataaacttaaccagttaagctacactcccttcatcttttctttcatgtacaatgcacaaaacttaaaacccaccaaaataaaaagttacaaatctcacgtcgaagaaaaatattttgtcaatgggtcgctttactaattattactactcatgcttactttttactctaaccatgcggtctatgcagcataaatgcataatccaagcaacaacgccacctttccgtaccaaaatgccaaaatctatctacccatccgtgcaacagcggtgcagtttcaatgtttcacatctggttcaactttttctttaaacttttaatttttctatcacatcaaaactttcctacacacacaaactttcaacttttccgtcacgtcgttccaatttaaatcaaatttttaattttttttggcgtgaactaaacacaccctcactcgctcgccatcttgtcagcgtacggaccctgacgttaacaaacgatcgcgaccgctcatcctccaccccctcggctaaccccacagccgtcggatctccagatcggagagcccaaacaaaccgcttcgtcgactcgtcgccgtcgtcgtcgtcttcctcctcgcctccgtcatccacgcgctcacgctgcagctgggtcccgcgccgctctctctctcgcgcgcgctcgtcagcgtcagcgtcgcaccaacaactctactaacaccaccaccgccgtggcgccagccagaattcctccccctttttctcctcctcctcctccgcgagtgtgagcctagaaactgcggcggttttgggcgcgatttggtttccaaccacctcgattggagtgcgccggcggtgatccggttggtccatggccggtggtggaggtaggtgagggggagggcggcggcggcggaggaggaggggtttggggggtcgtgggatgt

SEQ ID NO: 47753 - DNA, 295 bp, Oryza sativa
attctaggcttcagcgcaagtatggcaaggaagtcgctggccattaaatgaaggttgaaatgggcgtccaccgggaaagcaggtgagcagggcaggaggcgtgtgctctgcttgtcagaggtcacttccggctgtaactagccctgattgtaaaaagcatgtttcccttcttaggcagctagaggcccatgtggtgacccctgaccagataaaaaggaggcccaggcctagaaaaaaaggagagagaggaaagaaggggagtggggactctggcgaagggtttctacagcctgaa

SEQ ID NO: 47754 - DNA, 409 bp, Oryza sativa
tcctgcagccctggatagcttatttcagttatttacctggcactttaggtagtcgcatcgaaatccatgcagatacaagatcttttacatgttcttcgttagacagctggattttgcaaactatacaagatcttgcactgtatatgtaagattaagacaagagttagttaacgagagatatattaagaaaaatattctgtagtaaaattgtttggataatgtgttatacggaaaaaaacatacaagtacatgtatatgattcggaatactccgtatgatattttttcaacaaaaatatattcaggatatgttatgttgaacttgcatgggaacaacccgcattagcttgtgattgaatttgtcaattcatctccgagaacaaattaggaaaagaattaactattaataa

SEQ ID NO: 47755 - DNA, 828 bp, Oryza sativa
gagtgaaggacgaaaggaaacaatgacttggttgttgatcaggagttgctactatgctgcatatctcaaagatacaggtgcaaggtatatgtactctctcttagattaaataatttttggcacggtgggcttacccttacccctgattcccacgagacactgcttctccttgccttgagcggttgaaagacagaacagcaattaaagcaccaatcacccgatctttattcaactcttgttccggaagttttcaaatgattttgaaaaacaaaaccaagttcctcaagtgattcactcagtctctctaagtgtatcaaaatgaattcctcaccaaatgttgccttgttgattcctactctaaggttttgatatgtggcgctcggtagggatcaatcatggtatacttgcattcacatttattactaagtcaaaaacttagactaaagcagataactaaacatactcaagatcaagatcgtgcataaagtgtgtgatatatggtgtaaatggtgcatgaagaaaataaagaaaatgcttctcctttttgatttactttcttaatgcttctcctttttgatttactttctttctcccaaaaatccttcttttattggaagtgggcatggctacaaaaatttcttttaacatcatgctcatgcttgatggagtataactttatttatttttttttcatttcataaccatgcctttccctcccctttctttttttttcaaaaggagctttttttctgagaagaaagcacatggaagcatggaaaatttatttttgtggtgttaacgaccgaatttggtaatatcaccatcaga

SEQ ID NO: 47756 - DNA, 1501 bp, Oryza sativa
gttgtttttgcaattgattttatttgaactcctttctgaaaacaactaagtgagtgcttctcaaacgacacggatgagacagtgcgtctcgtccgatcggagtatgtgcaatgtatcagtctttagaattgaatcaaggttggcacccggccaacagcttttcaaacggccacccgggccaacagcttttcaaacggccacccgggccaacaactttcaaacagccacccgtgcctagctgatcccgtcagctgcagattttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacatcgggagacctccaagctttcatgacaaggcatttccaaagccgacacaggtttaccatataccgacgagaggggtcccagatcaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtatttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgcaaaacccaagttttacccaagtttttttttcagattttaagtttgaaggcgtccgtcgatactcgcacagggtgcacgaatatcgagacgcaactagatggttacaaggggacatgatataacaattaacaaagaaaggatcaaatgcaacaaattaggtaggtccgccaatctgccttgcagacgggacaaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggataactcaacaaacggcaaaaataaagccctattaacgacctctaagcgtgccattagatagatctcgatatttgaggaattttggaagttgaacggagtcaaacggatttacggttgggaagatattgaatttctaagattattggatttttggtctaaatgaaaaaggatttatttaaatcctttttgaaaaagaaaaagaaaagaaaagaaggagagagggaaatcagacttccatcgggcggctagggcgcggcccgagagaaaggggcggctcggccgagctaaa

SEQ ID NO: 47757 - DNA, 1501 bp, Oryza sativa
ttggatgttgtgtagaaaccatgtctcatgcaagacatggtttccttctctttcctcatttattcacttgccatatcatttttcatcccaagtgacaacttatttaatactatggacaccatcttagtcattaggttgtaaatgacctaactactcttctctatttccaatgtatccaaataggatatgttaattttaactcaactttgccttggtttatatactcttcttaatcctttgtgcccactcaagatatgccctttatataatgagcaaccacatttagtccggaaggcttagaagaccacgtttgtcagagaaccagataagcatgtgcattatttaatcatggtggttccaaatttggcacaattatatagaaaatatactccatcattccctaaatgtttgacaccgttaacttttttaaacatgtttgaccgttcgttttattcaaaaacttttgtgatatgtgtaaaactatatgtatacataaaagtatatttaacaataaatcaaatgatagaaaaagaattaacaattacttaaattttttgaataagacgaacggtcaaacatttttaaaaaagtcaacggcgtcaaacattttgggatggaggtagtacatagagttattatttgaccgacactatgctccactgcacagggaccgaaagagacaaatattgcaacaaagtttgaaatcctcatgtcaacaatgcagtttgagtctaatgcttttcttcttgaaaacctcatgtcaacaatgcagtttcaagggatggaagagatcctctggattgagatccaacactaaaattgaattgttaattatatatgatattggagtatcctaaagatatggtcaaattagggtggttgataacattttagatctagcttttaaagcagtaccaatcattcaccttagctagtttctatagcattaaatatgttgtcgtgtaagaaaaaaaactgatgcgataaaagagttaataaagagagcaaaacaaagctgaaaaaaatcatttctcataaaaaaaacccaactctttttaggtaccaacaatggaaacaattgaatagttggatgaaaagagagagacgagaggctattggataataatttgtttccaaaaaaacaacccactaggtatataatttatatatatatatatatatgagtatagaaattactttaatagtttctaaattaaaatgtcaacatctagagttaacgagaagagataaaaaaaaatgaagagaaagaaatcccatgtcacctttctaaaatatggtagggtctactggtggagtaatactttagttggacctctatatattattgcccataaaatacactattatgcacacgcacaagacgtggtgtgactggtgtccccagtagcacggattcaaaaaaaaaaaaaagaaggcgtacggactccaagagagcagcgtgacatgggaagcaatgaccaccgaaacgtagcactcgccg

SEQ ID NO: 47758 - DNA, 1501 bp, Oryza sativa
tgccttcttgttcacagcaactgataggcgctttccacattgggtgcagctgcagctgcagcagctctttgtgcctgttccaatagatcatgcggtaaccagtacacgggttgaacagacagtccttctcctcatgctcaccagattcaacccatggcaaggcttggagcaaaccatctttgtgtctagaaacagtgtcttgattagatgcctcttggagccatttacttaagggaacaaagctgaaaagagattttctagagcccttacccacaagcatgatttttggctcgtcgacctcattagacatttagactggacagatactcgattactgagttgcacgcatgacccactaaatgtttctaccaaattactcttcttttgaatgagtttaccatgaccgtaattaatttatatggacaactatatcaaaggtaaaattagggtcctaatttgcatgttgtcccggggcaccaaaattgtgtagacgccctgcctataaatggagtatatgtcttcgtatgtaagagatgattttataaaaaggacttcgtctgtcccaaaacattataattcaggatggatttgaaccatactagaacaacatgttaccacttaaatttagcactatagcaagaataggaaaacatgaacaaatttgaaaaggacccagacttaccatgcgagtccagtctaacactgtcgtagggctagtcagatcaacagcatatagacgatcaaaccgtcatagcccaactccggccctgtttagttccaaagtttttttttccaaacttccaactttccatcacatcaaacatttcatacacacacaacttttctgtcacatcgtaccaatttcaaccaaactttcaaacttcagtgtgaactaaacacagcctccgagtaggaatccgttggtgaacacaccaaacttaataaataagtatttggtatcccaagatgtattacagcttatgtattaatattatttttaaatttttcttatattgtttatataggttgtaagcacctaaaactagtttgaaattgagatatcaaagatcaagcaaacgattgtgaaacattgaaatatttttgaacttgataatgttgtcatccatggctttataaacttgcatcttaaaaatacaacttatagagaaaaaaatattattagttaataaagtgaactatttaaaataatttatagctataatgaggaaaaaatagtttagcaggtcaagtgacaacaaaatagactcttcttttttcaatgtcaaatgatgtttcaaaataggtacagtaattagcattttccataacatactgttgttagaatacaataatgtccaaggtcctacccgcgaaaatcccaacactggactggaagcgccttggtggtgctttgccttagcgatcgcgatttcgcgaggtcttcgcttcgtctccgccccacacccccaaacccacagccacgacgcggccgcaatggcgg

SEQ ID NO: 47759 - DNA, 1501 bp, Oryza sativa
tggaacaaagcgagggcgcgcgcgaaggaggacgcgagggcgtcggcgaggcggtcgccggagagcggcggcttgggcaggaggacgcccttctggatgtagtcgatgctgaggaggcggaggtcccacggcgtgaggtggatgtcgcacggcggcgcgtgaccggacgacgacaacgacgacgacggccggacgaggcgtcgggacaggacccggacacggtcaacggcgagtgctacgtttcggtggtcattgcttcccatgtcacgctgctctcttggagtccgtacgccttcttttttttttttttgaatccgtgctactggggacaccagtcacaccacgtcttgtgcgtgtgcataatagtgtattttatgggcaataatatatagaggtccaactaaagtattactccaccagtagaccctaccatattttagaaaggtgacatgggatttctttctcttcatttttttttatctcttctcgttaactctagatgttgacattttaatttagaaactattaaagtaatttctatactcatatatatatatatatataaattatatacctagtgggttgtttttttggaaacaaattattatccaatagcctctcgtctctctcttttcatccaactattcaattgtttccattgttggtacctaaaaagagttgggttttttttatgagaaatgatttttttcagctttgttttgctctctttattaactcttttatcgcatcagttttttttcttacacgacaacatatttaatgctatagaaactagctaaggtgaatgattggtactgctttaaaagctagatctaaaatgttatcaaccaccctaatttgaccatatctttaggatactccaatatcatatataattaacaattcaattttagtgttggatctcaatccagaggatctcttccatcccttgaaactgcattgttgacatgaggttttcaagaagaaaagcattagactcaaactgcattgttgacatgaggatttcaaactttgttgcaatatttgtctctttcggtccctgtgcagtggagcatagtgtcggtcaaataataactctatgtactacctccatcccaaaatgtttgacgccgttgacttttttaaaaatgtttgaccgttcgtcttattcaaaaaatttaagtaattgttaattctttttctatcatttgatttattgttaaatatacttttatgtatacatatagttttacacatatcacaaaagtttttgaataaaacgaacggtcaaacatgtttaaaaaagttaacggtgtcaaacatttagggaatgatggagtatattttctatataattgtgccaaatttggaaccaccatgattaaataatgcacatgcttatctggttctctgacaaacgtggtcttctaagccttccggactaaatgtggttgctcattatataaagggcatatcttgagtgggcacaaaggattaagaa

SEQ ID NO: 47760 - DNA, 222 bp, Oryza sativa
ttactctcttaccatatcaatttttttcttacatgacaacatatttaatttaatgctatgaaaactagttgaggtggatggttggtactgctctaaaagctagttctgatatgctatcaaacaccctaattcaaacccagggtttgatttttttttgatagagtagtatatctttagaatactccattattagatataattaatattggatctcaatccaga

SEQ ID NO: 47761 - DNA, 398 bp, Oryza sativa
  unsure (1)..(398): unsure at all n locations
gtaagcgtcacngtggcatgccacatcatctcacgaagcgggttagagtccgtttagacctacatgacactcatgacaagttcggggactcaaaaatacattttgagagtttagggatctaaatgatacatccgtacaagtttaaggaccacccatgcacttcactctaacaatattcaatttcatacaattttaattctgcacttctaaaatactccatatagtaggttctgtttattggatcgttagctcctcgaatactagaatctcagagtaagagcccaaccataaaatacactatatacatcttcaaggtgtggtttgtccagtagatcgaggcgtacggattccaagagagcagcgtgacatgggaagcaatgaccaccggaacgtagcac

SEQ ID NO: 47762 - DNA, 1501 bp, Oryza sativa
ttccccccatttttccctccctctctccctcggattcgttcggaaactttccccctaaacctcgccggcgcatcaatggcggccggatcttccgcgcccgtttccccctcatccggccaccctctctcactcccaaccctatataaacactccccgtgcctccctccaccgtttccgccactcgccgctccctctctccgccggaatcgagctcgcgccgtcgctctctctctccgccgtcaccgccgagctccggtctgccgccgtcgtcgccccggaccttctcccgcttcggcgccgcctccttcggtttcgccgcaacctcgccgacctcgtccacccctccgtttcgcccgccgaccgccggaacgccgccgtccccgtctacccgagccgcgccgccgccttcctccgctccggtcgccgttcccgtcgtcgccgtcgacccggggtgagctgtggaccgccgatttgtttcccccttccctcccctctctcgggcgccgctccaccgcgccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggtgtgagccaggtgcacccggtccaccgtggaccgtgaggctgccgcgtgggccccactcccgtggacccggtctgcgcgcccctcccctcggctgacgcaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcaacttcggaagatccgctcttcgtggaggttgaagccgacgtttgggaaagcgagcaaggcaagtcacatcatctttgaacatattgaatcccagtttataaaattatgttgatttaaattattgcattatcgctttatttaaattcccgcgttatcactgttttatttagcatgcctatttacctttgttatgaccttattattgttattgttattatttccttgttcaccctagattaaacaaaaccccaactagtggacactctactcatggtaccactagtatgatgttaggtagatgcttcgctatttaattaggtaacattaggcggttttacaactctagactttgggatattcatatcacctggacactttggaattgttggagtattgtggaattgaattcacatcgccccctctattcaaaatccccaaaatggttttaggctgggctcggggtgcatggttttgatagtagcac

SEQ ID NO: 47763 - DNA, 643 bp, Oryza sativa
ccaagtagaactagggagaccaatatagatacaatccaagtagtcattgttgtttccatatagaactctattcgtccttctttatccggaactacttctatatacgtggtatgattccatataagacttggtatatggtgggccccgctgaacttagtcgattaccattagttatgcagtatccataacctgacaaaaaccaactctttttaggaaccaacaatggaaacaatgaaatagttggatgaaaggagagagacgagaggttattagataggcaaattttgctacaggacaccgtgacttcgcagttttagctgtaggacatcgcacgaagtgacttttggaggaaaacactcccaaaagttggatttttgctagtggacaccgcacgcattaaagtaataatttttggttgaagagtagagagaaatcatgtgaaatgtcaaaaatgcccttgggcccacatgtcagctctcctatctctcttctctctgtatcccccccttcacttctctctccatccctttcttcacttctctctctaatctcttctctctctatcccctccacttctctctccatccctttcttcacttctctctctaatctcttctctctctatcccacatgttagcgacga

SEQ ID NO: 47764 - DNA, 268 bp, Oryza sativa
cagttgatgaaaatttgcaagccaagattaaacttgaatatatagagctccatccattttaaaatatatgtgtttattttgtttccctttttaatgtaagcattcttgccaaaattgcaggctgtactcaaaatagtgagatctggtgatcagataaaactttctaaatcaccactcaaagtctgaacctatattggtaacagttcatatgcaggatggaaatacataaacacatgaggagctttctcttttgttttcccgtttcatt

SEQ ID NO: 47765 - DNA, 162 bp, Oryza sativa
  unsure (1)..(162): unsure at all n locations
attagcttttatttatgtaattagttttgtaagtagtctatatttaatactctaaattagtgtctaaagaagggactaaagttaaaaagggggtttttcccccccccctttggggggggaaattttncttttaaaaaacaacccaccctcactcttcaatgt

SEQ ID NO: 47766 - DNA, 585 bp, Oryza sativa
  unsure (1)..(585): unsure at all n locations
atgtcagaccaagatttccaacaaataccttctttactgtcttcatcattggtacctgtccaccagaatttcctgataatggcagttaatttatatagaagttttttggagtgtaaaatggtagacatatagaaaatagggatggaagcaaacacagattttattaaagaaagtctaccagcatgggataaagtttttgctttaataattgacagcctggttttgaatttttcaatgataaagttgtaggcagagtttctggctttagtatttagaatgagaggatgaccaagatgtttggaattgttgttcattaaggagacagggaaaatggataaaatatcttgagtgacactgataggataggagtatgagagctgaacagaatagaagatttattccaacctggagtttgacctgattgatggcaaaaaaattgaataatttggaagatgcttctagcttcttcaggagtggcttgacctacaatcataagatcgtcagcatacattgaagagtgagggtgggttgttttttaaaagnaaaatttccccccccaaaggggggggggaaaaaccccctttt

SEQ ID NO: 47767 - DNA, 1501 bp, Oryza sativa
gagaaaataagttttttaattttgaaaaaaaataaatgaaaacaagagaggataaaaaatgttttttatttttgtatatatgactgacatatgggttccaatgacacataggcgccaccatggcatgccacatcagcacacgaagtgagttggagcccatttgaacctatatgacactcgagacaaattgagaggcctaaaaatacattttgagagttcagggatataggtggcacacccgcacaagtttagagaccgctcatatactttactcatattgttatataaggacaattctaattcagaaactactaaagtaatttccatactcaccatgtcatacatacatacatatatatatatatatatatatatatatatatatatatatatatttatatatatttatatatttatattatatagtggtttgttttttcgaaaaaaaattcttgtctaataacatctcatctctctcctttcatccaactattccattgttcccattgttggttcctaaaaagagttggttttttcaagataaatgatttttttcagctttattttgctctctttattaactctcttatcgcatcagtatttttttcctatatgacaacatatttaatgctatagaaactagctgaggtggatggttggtactgctttaaaagccagatatgaaatgctatcaaccaccctaatttaactatatcttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagacaagggcgacgaccacaggcgcttgacggcaggcacgagctagacaccaaagccttcatcaaccaggggctcctcttctgggttggaaaaaattaagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtgaacccacacgaacctgccttaacccaaggcctacgatgattcaaaccgaaccggcaacccgaccctgggtcctagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagt

SEQ ID NO: 47768 - DNA, 213 bp, Oryza sativa
ggcggtgagatggtccttttcttttttttcttttttattttctctcgaatcaagtgggatacatatcccaaatcaaaccccaaatacccaaatcaaacccaaaccaaagtaacatcacaaatcttatacatcacagatccatacaaatgtacaatgaatcacaatattgtccatacaaaagtacatcacagtgaatcacaaataaaaaaacaa

SEQ ID NO: 47769 - DNA, 1501 bp, Oryza sativa
tggaactttccgaaaagtttcaagaggtaacaattcgaattctgatatttatccgcttcatcattaagtaaactagtttaccatactggactctattttgcatagccaaaaataccttatattttgagacataggtagtagcaatttatctgtggtttgtaaatttgtatttgagttgcctagtacaactttttttgatttatttctgcgatattctgaaccaggaggatgtgaaagaattcaaagaacaagataaccgaggacattatgtttagggtctagccaagcagtagaggcatttgaagagaactggtaagcctaataatattcctgctcttttcatgaagcgaaatgatcatagcatctaatcattccagttcactatttcaaatagtattgggctctggtgcattataatccatttacttgctttggcagaggtgaaggatgttgcgtgcgtcgcccaagcagcatctccatctagctgtgctccaacaactaaggcgtggagtttgtccattctgcgccacctggcatcgttgcttcgctcttcatccacggttggtctgctccttcttcccgctcaatggctggactggactcctttccggttaagaacgccacggcgatgaacatgccatcagagagctcagttacctgatgatgctatgctccggccgcgctggagaagctcctctccgacgaggagttcatggacgcggtgaccacggcgtcagctgcaggctaattacatccactgcgagctccaatcatgtacttgtattattatgtcatcactgacacagtgtcgcttaactaaatgttcaacggatgaatgcgacagaattggggcagaatcgattgatctgaaatgcaaaatctgacgcatgcgcatcgcaggcactgaatttaactggaggctcttctcttcttcagctacgaagtattatcaactgttgcctctccatatcacaattacacaatttttattactgtttagctgttaccctttgacatgtttctcattttgctaacgtgttactgtcactgcatatgttgatgttcatacctctcctcatcaaaacagaatcctaatcacactttttttccaaggttttttttttttgaggaaaacttgataacacttactcaatgaaagttcaattgtttttacttgtctgatattaagaattaaaaaagtggtttatacgtatgtacacagcattcacaattgacttgaataagaggaaggatccgacctatcacctctagctcttgacttttactatctgtccggcggctaaggaaagacagctacccttcgcatcaagtcgggaatgatctcaaagaaaaagaaagcaaggatcatttggcctcttcgatcaaatagtagaggcagttgaagggaactgataagcctgctgtttatttgttgtgaaacaatatttcctgttctctttcatgaatggtcatagcaactaatttctctagtttgttggca

SEQ ID NO: 47770 - DNA, 151 bp, Oryza sativa
ctgctagctagcttgaacacttcaattgtaccctatttttctcttcaatggaaatctaggtggggaacctctcccctccggtgattattaaaaaaaattaaaacaatgtatcagcgtatgattcattaagtattagtttaaaaattttaga

SEQ ID NO: 47771 - DNA, 1501 bp, Oryza sativa
gctgagataaactttgggaaatttacccttaaaagcattcttggaagttatgaccagtgaacatgtgagtatggtttttatcagggaatgtagagtacatgttacctaaatctcttcacagaatggccctttcttattcctgagaaatatcacaaatggcctgtgtcctggatatggagtgcactgttttttctttgttcctaatattatgagacattctcatttatcaaggtcaacgatctatttcttacagaagatagtaatggaaaaaaatgcttccaaagtgcaggattgtatttttgtcatatgctgagaaattaaacctgtatgtgcaggtgaatggcgctaagaagagcaggatccactactcaggaccattaatgcctcctggagtaaacatggaagaaatccttcgagagcacgagcggcagatccaacaagctgtacggagggcgcgcctcgacatgggaaagggcaagaatcacgtcgagagagaccagtcggaatcgcttctgtacactacccagaatggcagaccgtaggcgaaaaaaacgctcaggatcgcgattcaatgtgttgtggagcccccatttcagccatgaaaaacaatagaaagtagcgtatgtttctgcgccgtcaaagcggagaggtttctttctgctagatgttccacccattgcagtggtttggttttcaccagcaaaaggaaacctgttcctgtagagattcaccgcctgtccaagcttagcatagggcgtcgaaaatatttgctgaagatttggttgtccacagccaccaattgtatatctcgagagagtatcctccccttgaaattgattcttacacctgttttttggcagatgacaagagaaaaaataatataatggaagtacagatcattggtgccctctggtgtttaccttgtatgtcttgcttttgtttcagttattttgtttgttcaactataatgtttcacttgatccttgctgatttctgtttttttttttggagcaaaggtaagtcattcctgctatcctgaatgtttacaggcaagtttggggtccgatctccatatctaccaacacaaatagacaaactgaattttggaaatttgggtaaagccaaagttggaaacttggaatgagcaataccataacaagtgtttgtaattactaaaattttgacatgaattcaaatgttcaccagtttcttgggggaaattaccaaaatatggcaatgcaagtagatacttcccctacctcataaaaaaaccaatatagtactaatgcgatatatttctagtactacgaatctgtatatatctttatcgagattcattgtaaactgtgtcatattcaatcctacatttttccatttttagacggagagagtacttctgttaaaaagggcacccttagtcctcatggatcccgggtgataaaccattaatagcagagagagagagagagaaactttttttttttcagttgaaaaaggaaga

SEQ ID NO: 47772 - DNA, 190 bp, Oryza sativa
gtcgactctagaggatccccttaatgcttcttggacctcctttcttttaaattggtttgcgtgtgttttagcttggcgcatactagctattgagaggtcgatagtgttcttagcataggtggatcactttgacgtaattgaacgagtttaataaaagcttcgattatctaaaacaagtagcctattacca

SEQ ID NO: 47773 - DNA, 391 bp, Oryza sativa
gtcttgcctcctaacatccatcaggagaatgatccatagtattcaagccttgaaagctgagataaactttgggaaatttacccttaaaagcattcttggaagttatgaccagtgaacatgtgagtatggtttttatcagggaatgtagagtacatgttacctaaatctcttcacagaatggccctttcttattcctgagaaatatcacaaatggcctgtgtcctggatatggagtgcactgttttttctttgttcctaatattatgagacattctcatttatcaaggtcaacgatctatttcttacagaagatagtaatggaaaaaaatgcttccaaagtgcaggattgtatttttgtcatatgctgagaaattaaacctgtatgtgcagg

SEQ ID NO: 47774 - DNA, 1501 bp, Oryza sativa
gcgaaaaaaattgtaatttttgtaggaactagttcaaatcccctagttcctctaaataatcttctatccaaagaaagataaatctttcttcgcaatgctagctagctaagttcatattcaatttcaaccaagagaaataagactgtaatacccgttgcaacgacgtgtgatgaccgcagaaaaatcttaatcatcagcactataagtacaattattacagccttagtggctcgtagaatttgtttgaccatgcacatcttttttgactcgcttttcgttgcacggccctctaattaatctgtgtttttgcagtggaaatctactggagacttacaccttgatcatattgataagaggacgttgctgtcagatgacatttgcatcttggccagatggctctggagtggttgcttggtcacatgtattgttcgtcgcatttgtcctggaaaaacgtgtgatgatctggtgttgtgtcaccatatttattgtccaatctttcagaaaaaaactattattattccttaaataaaaatattatcattgtcatatgttgttgttactattatccagaaatgggttaaaatgctcatagcaataatggcatatagcaaagttattttttaatagataatggaaataaaattctcttgccggatagctggatcagttaacagatacataattaaattctcttgctggaaatcaataacaaagttatttttttatagataatcagtaacaaagatagctggatggatgttgaaaaggtggagatatattccaatttttttagaaagaaatatattccaatccggagtccaacttttgtttctcttgctgtagctagcttgttaatcttttcctcctatactagtaccagtaattaattaattattatatccataaccaagccaatccccaatggatgcagtagacctttgaccacctcctcttcaagttagaatcttcttactaggtgctaaggttttgacaaaaccacaagaaaatcaaagctaacctagctaagcaaactgagagaacatttttgagtccccaaacccaatcaaaaatcccaaattttatactccctccgttttttaatagatgacgccgttgattttttctcacatgttgaccatttgtcttattcaaaaaatttacgtaattataatttattttgttatgagttgttttatcactcatagtactttaagtatgatttatatcttatacatttgcataaaatttttaaataagacgaatgatcaaacatgtaagaaaaaatcaacagcgtcatctattaaaaaacggagatagtagtgacagtcaaattcaaattccaagccgtcccagcaccaagagaccttctccagtactctactgccttaactatttttccttttgtattatactaacgcgtttctctctcctccctctctctgaccattactctctctctctctttctctctcctcttttttttttcaccaaccatcgtaat

SEQ ID NO: 47775 - DNA, 1501 bp, Oryza sativa
tcaggggataacagtttataagtttctccagcaatccggttaatcctccagctcaattcctgtgcttagggcggcgagggtaccaacaaagtgaaatcctgttgttttgagacaatatatttcacatattttaatttgggcattattgtgtttgtgcaaaaagtttcaggtatcaattcaccagtcgattgaaccaaacaaactaatcctgttgtgtttgttttgacgaatatttttcaatttacaatttcaatcgacatcaagcaagtgtataattcgacaaccaccaatagcgcgacgtcaccagataaagagataaaaaagaaaaaaaaagattgcgtggggggagaagaagagaaaggtggatgggataccctggagttgcgctggaaggagtagcggagctcggggtcgatctcgtcctcgtcgaagtcgtcgacggcgaggtcgaggtcctggcgcttgttgcgcgggacgtgcatggtgggcgtctcgccggggttgctggtgacgctcaccttgccctcgcgggacagcctcgccgcctcgtcatcgtcctccgccgcctcccccgtcctccacggcgccgacgacagcagctccttcctcttgcgccccatcctcgcctcgctcctcgacctctcctcctctccgacctccaagaagttgccttggcgagagagagaggaaggggatgagaggagaagatgaggttggtttcttcgggctctcatgggccgggccgggctgggctgggccgtcctcgcgaacaaggatgtattgggctttcgtgggtctaatctcatgcaggccgccagcccatttgagaataaacacagcaatgacgctataatctatatgttttgttaggaaggagtattgttttgtaccatatcgcaggatcaaggagagtagtaccagggagaggctacaaaagcaggggtatccaacaatgcaactcatacctttctcggccttttggctaagatcaagtgtagtatctgttcttatcagtttaatatctgatatgtgggccatgtgtctactttgatattaaatttatttttcgtggggagagggttcaccatagtggcttgcaaagcgttgcactaaagctcatgctaggcacaccccaaccaaatcaaatttaaatgttttgtttcagcttgttggttgtttcaggtcgattgcatcaacctgcactgccttccagtgcttttgaacctttaacatcgatggaagaagaagatgcaaagcaatgctcatcttttgccttcgaatttctcctcgtacattttatatcccacctagaaactttgtaccatggtgcaacattctatgatagtatctctcaaataattttacagcgatttaagtgtggctataaacggtttatgatcagaggagggtcggtgattttgactccgaaccccctaagtctacagtctctgaaaagctcatccacacgaacagtgatgcttgcttctcttctttcgtagga

SEQ ID NO: 47776 - DNA, 390 bp, Oryza sativa
ttttagccatgccacaagctcgagacccgcatccaaatccttgtaaaataaaaaaatcacttaaaaactatattttaaaaaaataaatttgtacgaaatttttaaatttcccccccaaaatttaaaattttttaaaaaaaatttccccaaatgcttgcaaaattaaaaatcactttgaaaaccatataaaaaaattaaaattttgagcatttcatcttaaaatcatattttaaaaagttcaaaaatatcaaaataatttgaacataaatcttattaataataacaaacggtctgaaacctgaaagtaatccaaggataaggagaaaggtaaacaggccgaaacaaacgcgaggcccatatacatcgaaggaccctatataccagcttagc

SEQ ID NO: 47777 - DNA, 517 bp, Oryza sativa
cctgcagcccgctacttatatgtaacttttaaaaatctctctataacaggctatttcgatgaaacgaaggtcgtgggaatggatcctctcacatatgtgcacgcagcgacttttttccttcttcacttgtacaaatcttgaaacaaatctaacggtttaaaattatgtgaaagttacatacaagttatagtgtaattacatacaagttaattacactacgattgtattgtaattatatctgtcaaattttcaggagaaaatttgtcgacagatatatagcaaaaatgaattgctatgatgggtacagttaacactttgtgggaatacatctatccaacgaacgacccaagtcatcacggcatagccgcatagtaaagctctgccagctcttgaatccacgcaagcatataccagatcaaacgaatgtaaaagcaaaagacaatcgaaatggcgtaatcacaagagcaacaaaaataaaaactggccagaatatatatagtgtctacgtcgacgcaga

SEQ ID NO: 47778 - DNA, 1501 bp, Oryza sativa
aaagaaccaacactagcatactaaaaagaaagaaagagtagtttatatcaatgttttgttgaactacactattttttaagtgtaactttgtaataattggctgtaactcgttttgatcaaattaaaagccggaatattctatttcattatctaaaaaatgaaatcgagagagagagaaagagtgtgtgtattttttttttgtgatataagcagaagagggccatcttttgaagaccttaaaggcccacaacatctaacatggtggcccagctcgggccactcttgtggcctgttgaggggatgcattgttcgggtgattagaacgcctcttcatttttagagttcaattttggttggagcaataatagtagcactaaacttccgaagtgaagtggacaatttgcaaacatgctttcctcgtgtccacatcccaacactctaacatcacaaaggtaaattttgtacaacatatataatattcctctacacatgagctccaaaatatatggtacatgttatttggtgatgaatttgatatgtagtgaacgaatgcttccagcaccgatgatattgttcctaatcatatcttgctccatgtctgtccggggaaaggacaatggcgtcacagtactcgcaaggcttcttgtcatgcaggtacaagtcctcagatgttgtcagctccgaattaagttgatgatccggaggtcggtaatggcggtgtcggcgaggagatcgctcagcctgaatggctatggcggtgtttgccagagagagcgtggtgagacgacgagggagatggccacccaagtgcaggggcagcatggagccgagatttggaagctagctgacgagctaggtcgggaagccattggaggttaaccgtggagaagatgcagtaggtaagcctgaaaatgatcacaacttatctcctacagcgtgctcttctctatgtttgatgtttggcacaaattcgcgccgagggcgtatgacaagagagctgaaaaataaaacatcacgagaaattttttttaaaaaaatcctacgaaagaagagaagcaagcatcactgttcgtgtggatgagcttttcagagactgtagacttagggggttcggagtcaaaatcaccgaccctcctctgatcataaaccgtttatagccacacttaaatcgctgtaaaattatttgagagatactatcatagaatgttgcaccatggtacaaagtttctaggtgggatataaaatgtacgaggagaaattcgaaggcaaaagatgagcattgctttgcatcttcttcttccatcgatgttaaaggttcaaaagcactggaaggcagtgcaggttgatgcaatcgacctgaaacaaccaacaagctgaaacaaaacatttaaatttgatttggttggggtgtgcctagcatgagctttagtgcaacgctttgcaagccactatggtgaaccctctccccacgaaaaataaatttaatatcaaagtagacaca

SEQ ID NO: 47779 - DNA, 618 bp, Oryza sativa
ttatttaataaattattaatagaatttatattaaatgatctttaatttacaagtgaagttaaatgtgggaaacaaaatttccttaatataaagcatggatggatttaatttttattaaattctccatgattaaatcaactctttggaattttctcggatttttcagagctcattcctaaatgatacaaagaacagttcagtaattatttgatcaataatgatctaattataattgttaagtgcttttcttgtttaaaatccttaaattataaattgttgtttaaaaggaattattagaaatgattttaaaagcttaaaagagaagatctaattttaatttgttaaatctcaatataaaattgggctatataaaattttgttaaatactttgcttaattctataattcctagatttttctgggatttatttgagctaagggagtatttttaataaatggaattgcatttcatgaataatttaaattgaaaaaggtttttaaaagtcttcttttggctttgggccgaaagtcggcccaaaacctctcttctctctctccctcggcccagttcggcccagtccgccgagccgccgctctctctctctctcccgctgacagg

SEQ ID NO: 47780 - DNA, 1501 bp, Oryza sativa
tgagtagtggcacccacgcataacgcgttcttccccctttgaaggaagggaggcgccggccagacgcaataatttcgcagcctcattaattgcatgatccgataagagcaagttcaatagtatagcccactacaacctccaattcatctatagccaatctaataaccaatttatataatagttgcttactatactattaatatatgatcccacctgtcatacacacactgcgtcttagagtccatgctgtagctggctatagatatgtagcccgctgctcttctctttcatcttttattttattaaaatatatttatagctggctaatagactcctattctaactgctctaatagatcgagagcgacgaagacggcttagcagcatcacatgatcgattgatcacaacttcacatgtcgttacatgcatacggccggcgacggcgagccgggcctggacggcgtcgccgccacgagagtagcgtgtcgacattgaccaccacatcacaaatagtcgatggagatatccacttgattgccaagctgccacgagagcctcggttagttgggattcctttgagtcgtttttgctgctactccattggcatcccgttagacatcacttaatttaacgagaattcatacggcgtaatactaaggccacgttcgatattaaatgtttattagcataattaaattttaattattacaaattaaaaaacaaatttattgacattttaaagtaacgattatataaaatgttttcactcaaaaatatatcatttagcaatttaaaaagtacactaacgaaaaccggaataaaatttgtatctcgataaaaaagggacctaactagtgtctatttattttgccttaagcgggcagtaggttcctacttccttcatcataaattacttgtcttttaagattgtttgttatattctaaggtttgaaaaaaagttcaaaaagactataatacccttataaagtaatttatggatgaggatggatgggtggttgagggggagaatggagagaaatttgaataagatgtgattaatgggataagtagtactgctagtgataagtattatgggacaaaatttaaatggtaggaagacaactaatattaatataggacagaaggagtacaatagagctgataccgttttagaggtctactatcctctttcattgtctttttgttggttggtttttattaacgatggtttggttgtgaggtgttggagtccttttgttttgttagctcaatagtgttattaaaaggtgtgaggcttaatattcgtgacgatgtttgtgttttttttttaaaaaaaatctattttgaaagggaggatacggcctgctgtcggacacatatacagtactccggtcagctgtatcaaaagaagtcgtacgtggacatatgtgtgagcgattgatggagactgctagatgcaaacgtgtccaaactgccatgatttactctgcttaattacgcc

SEQ ID NO: 47781 - DNA, 438 bp, Oryza sativa
ctttattccttgataccttgggttattataacttgactagttgagctttatatattggttcaactagatattagatataattgcttagccctgcttagaaacattagctcactattgggttaacttatgactcactgttatttaatgatggctgaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccataccttgtttataag

SEQ ID NO: 47782 - DNA, 401 bp, Oryza sativa
aaatttcaatattcaatactgttgtcaaggaaaagtagtcctttcttttcagagaagagcaagaacactgttattattctaagaaaagttgttaaattaataacatgagcactaactttgtttaatattgttatttgtttcttttgcatatttagcaaaaagggcaacgacactcgttgctttcaagaaaagtagtctaaattaggtattagcagtgaagcattccatttgcaatgaagtcatggtgcttttggtattgtaggtgccgttgatgattaaaatgctgggactaaacctgaaagacaatgcaaaaggcctggtgattactcttaccctgttgaagatccagctaatccatcaataattgttttgcaggctgttgaaatatcagcaggaattgc

SEQ ID NO: 47783 - DNA, 363 bp, Oryza sativa
caaataacgaatagacttaataaacgaatataaatatgtagatcatttagaaataacatcaaaagaatctatatataaatcaatttggaatggagagagtactacgtagtatccgatagtgacaaccttacatggagcaaagcatgggccacctcgagatgactagcaccgggaattgaagcagtgagcccgtacctacctatctactactactatatgccactccaaatactcgcagaattaaacggtagtctttgtcacttaattggcgccgaagcctcatatatactacgtatgtgttaaccttgcgaagctgcaatgttgcacttgcactgcactcgcctcgccgcgatctgatcgcca

SEQ ID NO: 47784 - DNA, 1501 bp, Oryza sativa
tgcatggtttgtgtagttggtaactggtaaggctgcttattgctgaaatggaaagaaaaaaaaacaatgtggcattgggagactgcaccaaatgtttcattgccatgacaaggatactgcatcaccatgtctaggtttgctgaactaaattgttgccactaatttgcaatagctgaaaaagcagcaagttttctcgcatcacatacgtcagttatttgatgtgttagctttccaactagaatattcaagttggctgacagcctatattgttggagttaaatcatatatgtgagctatgcatgcaattttgctatgtttcttttttttgaattgctgcatgtaatatcaccatggttatgtgatgatgtcataacgtgcaactgtaatcccatttacttcttacttacccattggctctgctaaaggtgatggttctgttgatatatgcattcatcacattgatattttgtgtttgtctattgttcagatcccctggtccttttaaaaattcttgtttagatgtctgaaggaggttgtgaaatgccagtattaattagaatccttttatctaacaatgtttgtgaatgcttaagcataaattatgtttttagtgaatcatggtgccatagcttatatgcaggcttattttgttattgttggtatgctgcaagtatgaagtgaaacactggtcatcctttttaattatcttacaaaaatgcctttattcttctgtgttatatttgtaatttgtaattgtactatttagtattttgtttttgtcatttagtgttcttgttttgtttctaacgttccttcttaaacagacattttcaagacatggggctcaatctggtggatatggtcagcaaaactaccgccctcagggtcatggtgcagcttctcagtggggcccacgttctcaaccccagcctggatatggatatccaccaagagggcctccacctcagaacatgccatactcccaaccttatggtggctacccgcagcagccaccaccaagaggtggcatgggctgggatcagaggcagggccctccaccccatgcttcccaccatggtggcggttacgactactataaacagggttctcaaccatatgaaggccagccaccaaattaccctcctgggcctggaaactacaatagttatgggccatcacagggcccaaattatggacaacctcagtatccgcagtctgcacctccacagaactatgggccgggttatggtgatcctagatacaatgctccagcaccaaaccagcagtactatggacagcctccagcgggtccacagcaaggctaccctccacagcaagatccctacgctaggccttatggtggacctggacaatgggcacccagaggtgcaccagccggagatggcacttaccaggcgccaccacctacatcttatggcccaccatctcagcagcctcctgcttatggtcagacatatgggccaacgactggacctgatgg

SEQ ID NO: 47785 - DNA, 413 bp, Oryza sativa
cacgttcaccgccttaacaagcaacacgtatgaagtagctgtacagatcgggccggaaatctgtgttcgcgaggagcatctttgtgtgaacagtttgtgtgaggtcattaaaacgggaagaatgcggaaataagccaacaaaatttgcctaatttgcagctgtcgtcgacctgtcgtgctgcacgcatggtccggaaagaagcacgcccgggctagcgctagagtccttactaaattttgcagttctagaagcttcctctcttaaaaactctatcagaatttacagaagtgctatatgacgggatcccgtcccaaccatgatggatgggataagttagcaaccaaccaatccatcgattctatcttcttctaccttatctattctaccatattaccacatctctctcaaagca

SEQ ID NO: 47786 - DNA, 400 bp, Oryza sativa
agcgtgtgaattcagacactacctcttgggctggaacagttcctctgttcttgtctgccttcctcccgttgatgctttcgccaaagatgctcatcgcagctcgaaatgacccacttcgtcccaagttctcatccatggtgatggcggcctccattttatcgcaccaaagaaaaggtgaattgcaccaaggctgaatctttcgaacgaaaaattcttggaagtacttatttgtttggagaacagttaagacaagggagagcttgtgtgttggtaaatgaggacaagtgtagcagctcgcgggtctatcctgcttgcatgactagaggagctcactaccacacaagtacacaacatgtcgatcccgttatattatccaccttgttcttgtctgaacttcgca

SEQ ID NO: 47787 - DNA, 322 bp, Oryza sativa
gcctatgattgtttgaaaggaatagcatttttttttgaattagagatgacagagaggatagatcataactactgtaggggtactgtatatagataagcagggacattagaggttgagaacacgttcggggatttggaggtgcatgtgcatgcagcagctgcgagatgatcttcctctaaaaataattagaatttggttcctaaatttgtgacctaaaaagaattagaatttggtttgatgcgcatgctgtgctctaaaaagaagaagatttgtgaggattagaatttggttccttgggcatgaattttcacattcatccagt

SEQ ID NO: 47788 - DNA, 585 bp, Oryza sativa
acgacatggaagaatggaagagagacctaatttttgttagcccaattatacccctgttaaatcaacggttagattagattggtacctcatgttacctcgtacctcatggtacttccttaaggatgggaaagatgctctaaacctatttctatctctctagtttattttgtgagagcgttttatccagctccattcctattttggatgagctgaaactatttagctgacctccaactctaagagatgcttttatttggcgtaaattgagcgttgtaagttattggctagtcagtttcaaaataataacaaaaaattattggctagtgaaaaccaacaactgcgaagttcagacaagaacaaggtggataatataacgggatcgacatgttgtgtacttgtgtggtagtgagctcctctagtcatgcaagcaggatagacccgcgagctgctacacttgtcctcatttaccaacacacaagctctcccttgtcttaactgttctccaaacaaataagtacttccaagaatttttcgttcgaaagattcagccttggtgcaattcaccttttctttggtgcgataaaa

SEQ ID NO: 47789 - DNA, 1501 bp, Oryza sativa
gttttttttttcttactatcatatatgcatgctatttgggcctttggaccggcaaatatttgggtggtccggggaccagcctttggatccaccaatgtgtaagaatagccaaattattgtggaactctaacctctttggttttctaccatttgaatcattaaacacgtgttcttttcttccttgacctctttaggatttttttaatggaaaaacagtagaagaggctcatatagtttatgtacaagagactttacaagaggggaataggaaaaaaaaatacaaattatcaatccatgattgccatatgggtcaatctggttcctttaacctatgcaaaagtagagtaaaatcctctaagaaaaagggaataaagatattggacggactgaggtaccatcaagtgattggtcggaatatggatgattagatgaatagaaaatctatagaacggcataccgttcgaacgggatagactaataatcaacgccccacacctcatcttggctcgtttatgcagcgtcgtccaccacccaccgcgcgcaagctactccctccatcctctgtccccctctctacgcccacgaccactagccgctggccaccgggagccgttttctcgccgcatcgaccgcaacgccatctgagccggccatcggcgacgtccccagcaagccgacatgagtgcaacaattgcagagcctgtatgaggctagatgtccacaggaagaagggagaatatgaggatatggcttttctagtagttcgtcgcctgcatctactcacaatctcatctctattttttttgttcttgttgttgatgttgcttcgatttcatgctaaggaatcaacacatggatgaggatatagtgtgttggagagaggaagaagatgacttgtttggtacaaatgatacctctgggtaccaggcttgatacttttttttttgttggtaccaagcctaatatgcaactactggtcttgacacctcgtggataccagaccaggtaccatcaaccttagtaccatgggtaccaggtctgataccataaatatcgaatctaatatcctaagtatcggatctgatacctatggtaccaaactgataccttgggtatcaaccggatctggtacctcagatatcaagtaccgataccagactaggtaccaccaaccatagtaccatgggtaccaggtctgatacctcaagtttgaatctagtatcccaagtatcggatctgatacctatgatactagatccgttacaggtactaaccagatctgatacctcatgtatcaagatacgggtaccaaccagatctggtacctctgatacgggtaccaaccagatctggaacttcaggtattgttaacgaccaaatttggtaaattctatcactattggcatcggaggtgaggatcagatcgaagtggaatccaagatgaagatcgctgcggaaacatagtaagaatcggctgcagttcaaatcggctaaggtcagg

SEQ ID NO: 47790 - DNA, 1501 bp, Oryza sativa
tatatgagagtattaagatcctgcgatagttaatttcttcttcatcctgtttaatttcttccgagttctcctgttgtttatttctattttttttctttgttctcaattgttgtttgacctagctttagctaaacactagtagccatggcctagtccctgtggataacacgacactcgccactactcggtggcatccgtgcgcttgcggggtgcgtagcacaatcaagatcaaatttttatgagaactgctagatcacggtatcccgtgtaacgggatagattataatgagttaatgacgagacgttgcccccaccaaccatgcgcatgtgtccccacgcgtttgtatctcttcctcccacacgtacgcatcgctctcccatacccttcacatgtttgttgcgctcccccacgcatccatgcgctcgtattgagtacctacacaacttttaggtatcagatccgatagttgatacctgaggtaccatatctggttgttacccgtattagatctaatacttgatacctgttgacagaaaacacgaggcctgggagatctgcttaactccagtgcaggtccaaaactcgcctttgggtgtatgagcgtgccagttgatttgatcctgcaatcaacaagaaatagaacaaaaaaaccgcaattaatcctataaatgatagccgatcggctaggtgccgatggcatatcatttatttcaagccgatgtcatgcgtacatcgatcggcaaatatcaataagcaaatcagaactaaatctacttgatcggctgtaaatattaatgatatataatccttatatcgatatatacttaaatcaagtgattgggatagatcggtcgccttgccgagacagtataaatcacttaaatcgaaatataaattaataatgggattatatacatttatagtatagccgatcaagtgaatctagcatgtatcggctaatactccgatatcactctatattaagatgttaaagcaagtagaatatactaaacataagcttaatatacttagatgcgacaagatcttaacataaagggcagatttaacatgtcaatccagcatatagaataaaagtagctaaatcagataagatcggctgaaactccgatactaccctaatcagcaaccagaaagcaggctagagattgcaattctaagcacgacttaatagatcaaactcaactgatgcagcattaagtatgaaaagaaaaacaatatctagacaatcaagccgctggaagtttcatagagtggtagatatatcacatgatctaagttaacatcattgtctaacctaatcggctgccttccattaacagatgttagctgattataggttaaataaagatattatcgaaaattatgtgagatatatgataactcgacaaattgtatagacaagattagagtatcataaagatggaagcactaatcctgagaacataagtcgtcatgacaagttttacctcttgttgaaga

SEQ ID NO: 47791 - DNA, 449 bp, Oryza sativa
ctttttcatcccccgcacggaaggatatctcaattgtgaatcgtatcgcatggtgtccggggaaaaggagaagtggaagagaagccagaagggagacgacgagagatttgtccgggcgcaagccaaggcggccgttctttccgtcgtgaacgcttcgtgtaaggttcggtgtcccatctctcatgtccgtttcagaagaaaaccgtattgctgtgttgatgctaattactgatgatgctgaggttcggctatcctggatgcatggctagttcttagagttctagggacaagtacaactattgttaaatagcacgaattcaaggttctgagtatgatttctgtacttcttttgatggacaggcaaaacatccatctgatttatcttgcgaattggattgcttaacctaatctgggaattcaagtcagtacgtacgatatgccggcaccat

SEQ ID NO: 47792 - DNA, 363 bp, Oryza sativa
taaaatagatagatagatagatatagttggtgtgtttgaccctagacagggtggtagtgtgcacgcaggacgcatcagctggcggcgatggtggcatggggttgctaagctaatttgaccgctgaaagtgatggaaagcaagcaagcaagtcagagttgccatctccaatcggtctccttatccccatttttctctctgtgctgtactacagtggagtaccacgactgtgtatgtgacagcttagctaactcaatgattaaaatctcgccagatccctcctgcgttatcaatccactgagaagtaagcgaacgagatcgcctgggccggctcgtcggagaaggctcacacgcgacgcgcgcca

SEQ ID NO: 47793 - DNA, 1501 bp, Oryza sativa
  unsure (1)..(1501): unsure at all n locations
accggccgcagctcgccatggccgtcctcatccccttcttcnnnnnnnnnnnnnnnnnnnnnnnnnnnnnnnnnnnnnnnnncgtgctgttcaagaccatcggcctcggaggagacgcgtcgctcatgtcggcggtcatcaccgggctggtcaatatcgttgccacgttcgtgtccatcgccaccgtcgacagccttggccgacgcaagctcttgttccagggaggctgccagatgcttgtgagccaggtacacacaaatatatatagaagctgatatatatacacctatgacctactccctctctgttcatattattagtcacttttttcctagttaaatttagtcaaactttgattaaatttatagaaaaaattagcaacattttaaacaccagagtagtttcatcgaatctagcattgaatatattctgataatatatttgttttgtgataaaagtgcttctatatttttctaacataaagaagtttggctagaaaaaaagtcaagacatatcgagtgcctgcaaaaaaaaaaaaatgtatgcatgcatgcttatgatcgattcctacaggttatcattggaacgctgatcggtgtggtgtttggtacgagtggcgatggcaacatctcgagggcgttggcggtctgcatcgtggtgttcatctgcgtctacgtcgccggcttcgcttggtcgtggggcccgcttggcgtcctcctgccgagcgagatcttcccgctggaggtccggccggcggggcagagcatcagcgtggccgtgaacatgctctgcacgttcgccgtcgcggaggccttcctcccgatgctctgccacatgaggttcggcctcttctacttctttagcggatgggtgctcgtgatgacgctcttcgtctcggccttcctgcctgagaccaagggcgtgccgatcgagaagatgaccgtcgtgtggagaacgcactggttttggggtagattttactgtaaccaggatgcagatgcacacgttcaagtggcaaacagcaaagtttgaaatgcacaatgccactgctgtctgattttatacagatgtagcaaatgtgagatgcgtattttgggactggttaatttgctgctgatatccagcatgcgcatctcgaagtagcgcggagcaaagttcaaatatccataggaatctcaaagcaatggttttgtttatcgacgtttttaggaaagctcacaccccactggtaataggaaaaaagaccaattaatggtgttatgcgatcatagggggtgagcgcgtatatatatatgaacgcttacgtccgtactgtatttcgaacacaaaaagacaaatggaatggcgtgaaattaaattctgaatcagctaggaactgccggaaagataacaggcataatatgatagcctagttaaaccaaaatgtatggatgggtttgtcgcgcgattcctgtagttgttaaggattgcaagaatgaatttctgaatataaacacaatgt

SEQ ID NO: 47794 - DNA, 539 bp, Oryza sativa
aagcatcacgtcaatgtcacgtaggacgaaaactggtcaacaccaccatgtagacgcacgacagcgaaactgctcttcaaaaccaccgaggaagacaaattgcatcagttttaatagttggagggtcaagatacccggttagtcaaggcagtcaaagtgaacttattcaacctgcaatccctctgtctccgaacgcaggcccgttggcccagctgcgcaatgcctgctgccgtgctccgtctcgaactctcgatcccctgtaacctgtttctcgtcttcctactcctttggactactagcccgacgcgaccaaagctgaatcaacctatggatgcagtggcccaatgcccactggccagctggtccactccgtcgatctcgtcttcttcctttccacggcacacggcagcgctgacggaatcactcactggccactcaacttgctactcatacccgatgatcaactgagccaatatatacactcgttctcttcagacttcagtgcaagatcacgattcacgagtccgcgatggcaggac

SEQ ID NO: 47795 - DNA, 1168 bp, Oryza sativa
ccacccatctccctcaacttgctgccgctcgatggctactgtggccgtctctgggtgccaaaacaacggagtccccaactcccaccctctgttgccggaccaccctattatctcgccgctgccatgctgccattttgccgtcatgaggaaatatgggtgagagagtgaggaaatatgggtaaggaaatgaagagaagaaagagaagggtgactgacaaatggttccatatgctaagtcaaccgaggtaaacatgacacctttgtaaaaactgctttgaagccactgagggagtcaaaatacattgattttaatagttgaggggttaagatatccggtattacagtttggggatacgagttagattatacatatattttgagggactcaaagtggacttattcctaaccaatatatggtaggaataagttcactttgggtccctcaaattattgtcgagtcgtccctcaaattattgtcgagtctgaaattcgtccctataccaaaataccagatataacgagtccctcacaatttacaaaaccggatcatatgaggtcctaggcagtatttacgtctggttttagctgacatgataagcttagttagcatgggacccacgcaggccccaacactctcgtccaatggttaacactctcgtcttccttttcccttctccccatctcctctcctctctctcccctcttcggcaacaatggctgactcggttgaataaaagttggctccgcgccggtggagcctcgcggggcgcttgacgagcccggtcacctccacgatccttgtcgaccagtccggcttgggcacggcgccgtggttgcacacgtagtggactggcgtcggcgtgatgaaaccgtcaagcatgaggcacggcagcagcggctcggagttaaaggggtgcttgccggtgagccagacgacaccgggtgcgacgcacccacgcgtcactgcgtcagaggtggcctcgtcgcatgggtcattgacgggaggctccacctcgaggcgcgagtggtacaactaccttcagtccggtggtatgtcgtcatcgtcgtcggagtcggtcttggagcccaaccgacggttgtcgccggtggatgggaacaagtcgatgttgctcgacgactcattgctcgccaccatggaacagcttga

SEQ ID NO: 47796 - DNA, 216 bp, Oryza sativa
gttaattacgcgtgatctaacagctcaaagagcccggtaccgtccaaatattgcgcccatgcgagagcaagtgtaccaatcgtgttttggtcgtgggagggtaagattataattttgcatcaacctttcccccgattccgattgagcgacctcccgatctccctcgtacgctcgtacaccacctccctgcctcctccattgaccgctacctccagc

SEQ ID NO: 47797 - DNA, 943 bp, Oryza sativa
tgtgcatctatcgtgtactccctccgtactcgtaaaggaagtcgttttggacagcgacacggtctccaaaatacaactttgacttgtttctataaaaatattatttgaaaagtaatatatgtatatttttacgaaattatttttcaagacaaatctattcatatagtttttatattttcaaactcaacaacttgagagttattcatgaactcgtaaaggaagtcgttttggacagcgacacggtctccaaaatacaactttgacttgtttctataaaaatattatttgaaaagtaatatatgtatatttttacgaaattatttttcaagacaaatctattcatatagtttttatattttcaaactcaacaacttgagagttattcatgatttatattcccaaggtttgacttaaatattgtcctaaacgacttcctttacgagtacggagggagtataaaatagcattgatagccaacaacataataatatgtgacttgtatgtgtccagctaagcacaataaaggatcaacccgatccatgtcactataaattctatggttttaaatactccctccgtccctaaatatttgatgccgttgatttttttaaatatatatgatcgttcgtcttattcaaaaacttttataaaaaatataaaactatatatatatatatatacataaaaatatatttaacaatgaatcaaatgataggaaaagaattaatagttacttaaattttttttataagatgaatggtcaaacatgttttaaaaaatcgacggcgtcaaatatttagggacagagagagtattacttaaaggatgctatcataattttagatatgtcactacttatacccttcaaagcattataatacttttttttaacaaactaccctctttattccttcttcctcttcgttggatatgttcctccagc

SEQ ID NO: 47798 - DNA, 1501 bp, Oryza sativa
tgttctgagaattttctttttcgcgaacgcatattatgtgaattgtctaggtatgaagtgtgccctgtaaactactgtacttaactctatacctcccttgtatttttgacacaagattattgagcaatgagtaaatcctagagattttcactatagcagaatcatttgctcataattatttattttgagaggacattattgttcttgattaacaatgtaaagtatatattctcctcaacacccggtcccaatgtaaccgtgaagacggagctcagccacacacgcatggcgcaactgccgcgacaccgaccaacccttcgccatgcctaaatccggcacctccatcgccgccttttatatcctcctctccctctcgccgtcgtcgtcgtcgtcgtgccgtgttcgatcgcgccgcgcatcgcattgacatctccgaggaaagctttggtatatattgttgcgaagctagggccgccatggcagcgtcgacgcgcgtgtgggtgctcgccgcggtgctcgtggcgtgcgcgatcgccgtccgctctgcccgcgccggccacgccagcggccacgccgccgccgccgacgaggaggacgccgccgccgcggcgccggcgccgtcgaaggggcacgggtgcaacccgctcaaggacaagacgtgccggcacgacgaccgccacgatccggagaaccaggaggaggaaggggggttcggcgtccggctgccgtccttcccgtccctcaccggagacgacggcgacgacgacgagctgccgtcgttcgacacccacatgaccatcctcggccactgaaaacaaggctgccatggctgcaccatcttcatcgtcatcatcatcatcttcttaactgactacgtagctctgttgattggttcttgcattttgcattgcttgctctgtatcgagaagaggggaaaaaaaggttgaaaacaagatggaaaatgtcatgtagaattgttgctagagtgtgattctcctagctgatatctccaaaatgttgttgttaatatatcggtattgttcaatcttcagtgttcatcgatctccttcatgaaagcagaggatgcctcttcctctgttcagttcatcttcgatcacaagcaaatctatagaaaatctttaacatacttatatattaaccacgtcattcaaaatggaacaaatttctacaaacataatcgcctgcctttctgtgcccgcgtctctcacaattcagccattgaaatcgcgatgcatatccatgctggattgagcccttcccgttctcatccgatctcgatctctgtatttccggcggcggagcgccacgaattcgccggaggccgtcgtcggagatgaacgttgaaggatcgggcatagacgtcgaagcgtctgtaattcgaatcctatggaaggccgattcggccataagcggcggcggagcagcgcgaacggcgagaggggggacgtgcggcggcggcgccgttcgattaagattgtgt

SEQ ID NO: 47799 - DNA, 1501 bp, Oryza sativa
atctggactactttttcctaccataggttctcactggtgatgtttaaagatcagatggacatttcctattgaagaagaaatgtaatcatgtagataactgcataataattgaccaaagttaatagcaacatagaaaattttgataacctgaagctacaagtagaaagtatatcgcgtgttaaagattaacttacattattaggtaaaaaaaccagagtgcatcatgctcagattctgattaggcgaatagcatgataatttgcaaagtcaattatggaaaacatgtctacattttcatatatgctacaatggtatttcccagaccatgttttctagatgacactaaatatccaaatttcgcataaattgaaacagtgggagcattaagagaaaggagccagcacatttttgttgcatcccaacataaatgatgaaatcagaataaaatgttatcaatgcacacaaaagaaaggataatgcaaacggacatgaattgatgatattcaagataaaatcatgacttgcgttaaaaaaacaaagtgagttaggtgcataggcatattatacccttatatttgtaatggaacttaattatttataagaaactatcacccctgatataaacaaagtatcatgcaactaacaaaacttattactaacttcatttatgtaagaatatttccttgtcgtttgctttggtcaatgcctcctcccataaatgtaacaagagaaccctaataagattgccaatgttgcgcagaagaacaggtatgaggtttagtgggaaagcctgcaaatcagtgtaggcataagatttgacaaaacacaaaaacaaatgttagctatatcatacagaaaagattatttgcaaaacaatgatatattagaaaaatacatgttccgcatattaggccacaacacattatgttactagcataacttttccacctgcaagaattaatcccgttatcatcttgacgccaatgtcatatggtgctacagggcagttaacctgagtttacaccacatagaatcatccacttttatgggtgtgttcggctggtatttttcagctgcggctgcagctgcagtagttaaggattgctgcagcttgcagcaaatttctgatgtagcagccgcagcagctgcagcttatatggctgcccaacagagcctattatggcttgatgcccaatgaatcagctaatcagatgccaaattatccatgctaatggttttcagctaaattccaaaggctgctacattatttcatgctgaaggtctttatgtattacccactaaataatagcttctaaacttggttcatatgaatttcttttgatcacacaaacatggaattatatggaacatccaaagcgatcttatgctataacacaaatttaaagcaaatgtgaaactagatgtaggaacaacaggtgtggatcgacataataacatgttaacaacacaagcatcaaggaagcaagacgatcttatgcag

SEQ ID NO: 47800 - DNA, 1501 bp, Oryza sativa
cttacagttataggagtattttgaaacggaattagtatttgccaccttaaacattgaaattctcaccatgcatttgttttgggttgggaacacttctcctagcatgaaaaaaatgaacaacagattaacatatgattaattaaataaaagatatatttttttaaaaaaaattatatgactttatgaaaacaacttttataaagaaaacacaccgtttaactgttgagaataaacataccatttaaccgaaaactaaaaattaggataacttagttgagaacacaccctctcaatttcatgtgacgcacaacgtttcattaatcagtatggcgattgtatgtcactaggctgatgaaaagacgtgtagcttgagcgtacaagagaaggtcgatagcgagacacaatggtggaggggagagagcgtgaacgtctctcctccttttgcagaagaaacaccggggcggcgttgagtgatcagttggtgaatggctctcctcttttcaagctctcctaatgatcattcacctgggccgtgccagacaaaagccataacaaactttacgtgtacactacagactcgttgagagcaaaccaaagatggcgtcgccatcgttggatcaaaactgtatggacagaggatatgttgttaatgagaacttgaacttgttacttgccatgctggctaaatagcagaatatttcacttactttctgtttgagaaatacgatacaaacacaagcgcgtttaacctcattatcgacaggtgaatcgtaaatacgaccataagtgtcagatataggactagattcgggtgggttggttctaccggaaaaccaacccattgagctacgttagcttcgctattttaattaggaatgatatttaaccattcatcttattttaaaaaattacataactaatatttgttttattgcgagttgttttatcattaaaagtacttcaagaatgatttatatcttatacatttatgtgaaatttttaaataaaacgaataatcaaatatatgtccaaaagtcaacgatattatttattaataaatagaagacttgtattttagtagtatatatgctagttgcgaatatcaggagtactattcgagtgttcgagcaagcttactttcagccattgtacctaactagtagtagatactgcaacaaattttgagatgtattttttctctaagcatatgggagtacccttttccggaaggaaaaagaaaacagctaagagaagaagaagaagaaaaaaaagaaataagtacaccggaggtccctcaacttaacagcgagattttttaaggtcccttaactataaaaccagaaatatttacccctaaactcatataaaccgtgcacacaaggttctatagcagtatatatgggtagtttcgctgacgtggtatcctagtcagaaaaaataattacgtgaggcccacatatcagctgcatatcttttttttcttttcctctcttcttttctc

SEQ ID NO: 47801 - DNA, 287 bp, Oryza sativa
tagttcagactacttttcttcatgattattgcagagatgaaaatcacccccaaagggtcattttgagtagtacaatttgatactgtattttgacatatctttcgtactgtaatacgctgacctgaaatttttatggccaatttcctgggcatcgcgtgattgataataccatgttctgtacgaaatatctgaagttgtactgtaattttgtatattctcgagcttcagatatctgtctctcctaatgtttctgacggctttacattgttcaaattttcgatgacagg

SEQ ID NO: 47802 - DNA, 169 bp, Oryza sativa
catctacaagtactggaagatttcttgctactagtgtgaaattgttatcttatctgtggtctgactcttgcattagttgatctgaatatgttaacatgtcttcttttgcaaatactgctgtgaagtatctgatttgtttcatgagctctaagctcgcactgattctgat

SEQ ID NO: 47803 - DNA, 462 bp, Oryza sativa
ttatgctacaaggaaaattcgtcttaagatggagattggtaaatatgtgatccaaatttcagcatgcaatatgttcagattgtcaaaacttggtggtacatttggctacaaaggaacgcaaagatcttcagaggagaagaaccggacatgcaaaggacttcacaccagatcatccaagatattcaagaaagcttattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagaaggctatgatggtcgactgcaaaggactcgggggctactgtggagattatgggtatcccatatctacacggcgatggtattcgaactgggtacag

SEQ ID NO: 47804 - DNA, 422 bp, Oryza sativa
ttcagtaagtatttgactggcctgcaatgcatgaacacctgaagttattatttgcttttcatgctccttttacttggttcttctgaggaaacacagtagaagtaatgctcatcattctgagaacattaaactattttgttattaccacatgcttgttgaaatgtcttacttgactaacaaaatactgaccattggcagttcaatatgatgttttgcagatatttatttggttagcattttccatagatgcagaatcatttgcccagattttaaatcaatttaaattcttatcataatcaatcatgaatctttcgatggaacggaaattgatttcatcaaccttttcttttgtttatactttacacttgcgcctaactttttcctccaagaaaattaataactgaagatacatcaatcccagg

SEQ ID NO: 47805 - DNA, 1501 bp, Oryza sativa
taattatgcgccgtgcaataatattaacaatttaattactaccttactttgataatatttacttattgtttccattgaaaatgtgatccgattgagcgtgtgactgcaacagctagacggtactagctgactagtcgacccttgtatattttgcggcccttaattagcaaaacaaattaagaaattaatttatgatagtggcctctgtacccaacaatactgtcgatcgatggaaccctatgtactaaatcaatgctacaattatatcgtcttaggaagaaggtgtatatcatatctaatcaaaactagtgctgtagatcgactactatagaatgagaaatagctccaaccattttcaacctatatgtatacttctcaagcttgtaattttggagtcgcattgatattttttaaagatatattgacgttggataaatgtgaatcatatgtgtctagattaaaatgattttatagtattataattaatttattccggttatgtacctctattgcaacagaaattaagtcgtttgtatatattgattttcaaatttcaaagcatcatgttttcaagaccagagagatatcatatatatacatcaactgatcgtgtaatccctaacaaaagctagaaattaattgagcttcctccttagttgatgtgcttattattattatttttgaaacacgttgcgctcttataaacgtgtgcacgctcaatctatgaatacacacatgcataccctatatatccttatgaacacatccaaaaactaggttggcatcttaagattcacaaagttacaatgggcatctcgtcgttgatagatacgttgtctagctaccactgaaagaataattagtcgtaaatgcgcgcgcacctataccaagtctaggattaggacttgaatccggctagataggttccaccaccaggaaccgaatcaattgagagctgattacttcgtgatgtgctaattaattttgttccatcataatatatatttcttaaaacaaaacatgatggagaaaatttcaacatgaatttcatgtacatgcttttttttaatgtttggagaatataatagtcaaagagatattaggatacagtaagttcttgtttaactgatcgatctaaatccggtacaatgtataaataaatacccacaaggcttaatattgtatcttacataagtggtgaagaagccaacgacactttcaaacccaaatgactaatactccctccatttatttttgataggcatatttccaaatctgaaaaaattatttttgataggtatatttcatccaacaacttatcatcttaataactttctcgaatttaatacatgactctctattcttccacacaagattagctacataggcattgaaaaatgtaaatattaataaatcgcttgtttacgaggaatgactagtagcatgtttaaatagatgataagtataattatttatctttggtctgtgtgccaatataaaa

SEQ ID NO: 47806 - DNA, 1501 bp, Oryza sativa
agaagcatttctgactaaaaaaacgctagcaagttactaccaactaaaaatatcgctatcatttagtacaacaaaagcaattgcgattgaagactaaaacctcacagctagtgtatgtatactatgtccagttctcaatagattttagaacattctgctcatggttcatcacttaggccaaacttatccagcatagcgatttcagtggaactcaaaattaaacaagattagacattgcaatcaccagcagtaattagtaactacccagcagtataaaatcaatgcaacaagagacaacaatccagtacaggcaacctcctcatgggtgtgccaaaacaacataatactagcatcaaaatttcctcagtaaattgcttatcatgtccaacaattattccgtaatcggctttatttcccccacaaagggacccaaaaattagcttgacgaatctatgatatagtagctctgctcatatcaatcacagtaagatcataaactcaattgctaaccaaatttgaaaaaaactgttaagttactcaggaatcagccttttcagtcaccacttctttctcctttctctcgtcaatggtggtggtcggcgaggaagaagacgacgacgacttctcctcaacctgttgtttcttctcgtcggcggcggacgcggcctcctgggccaccgcatctagcttcttctccccgccttcctttgccttgtcggcggcgatggcggcgtcggcgtggtcgttgacggcctgctcggcgcggagcacgggggcgtagtagtccgcgtgcgcgtccatgcacctcttgaggttggcggtgacctcgaagcagcgctccaccatgtcggagccctcctccttccccgccgcctccacgcactcctcccacgccacgaacgcctccttgcatccccctcccttcatgaacaagcagaacccacactccccttcctcctcctcctcctcctcatcttccccttccccctccttctccacatccgccgccaccaccacagcctcctccgccgccgccgccgccaccgttacgacggcgggttcttccgcctctaggtggggcgctgcgatggcgggatcagacgccggagacgccattgccgtgatctggtggtggttacctctgcttctttcttgggaaagaagttggggaggaggaagaagaagaagaagaggaggagtcgcgccgccgcccgccgccgagttggtgtcggagagggattcctcctcctccaccacctccttgggccctaatgggctccaggcccaaccaaagataggcccaattacaatgagcctagttattaggacgtgttgaagaagttcattttacatcccacaattcgaccgtggcaaagatgagggacgtaaataagacttatttagtacggcccattaagaagcggataagagattagtagtagtagcaacgccaccaccgctgctccactcctcgcttctcccgccatcttctcctcctcca

SEQ ID NO: 47807 - DNA, 1501 bp, Oryza sativa
aatagaaagagagaaatgttatgagactgcaaaatttgtacttgagcaacataatgaacacacaatcaacagagaaaaaaacaattagagctagcgcatgggctctagtaatatatgatttacttactttggcactggaggccatggataccaagattgacgaaacaaatgacggtcctcgatgatggaactggatgaaaaaggtctcttagccccattaagagaatccacaaatggtgtactcatgtggttggttttagtcaaggccatgccagttcttgctacctgtataattaagatgaaaaccacaagttaaattctaataatattaaacaaggaaaactggccagtcacatatggcaggttggaacatgcattggtaatcaacatcatcatgatgatcaaagattactagggtttaatctgtttgtcacactgccatcataaagcctaagaaatttcatgaactacttaccgatgatctgcacagtagcggcgtgaatttcttggacaggatgcggatgccggagacagccatctcagcagtcgatccgataaaaaaaaaggattggattttgaagagttttgttcttgaacgaatcaatcactgcaattgctgctgcttataaagaagtgctcaataattccgaatccgaacaacatttggaagcaaaaaaaaaaggaaaaaaattagtgtaggattaattaggtttcaattattataaactcaaaatataaatttatttaaatctctactattataaaagtttaagatgtttttgccgtagttttttgtcagttattgtgtgtccaaatcggatcaggattcaggagtttggagtttcgtcggttccgccggtcggtaggcgtgcacgttgatccgtcagcttcacctcttcctgacctgtccgtcccgtcccacgcttctccaagggacgcttctccgactcgatctcttcgtctcctctttctcaattcgaactgatctcttgcgtttcactgcctccatataacaacgcccatatttgcttcattaatcacacggtcttttttcgtgattggacaaggaggacgaggccaggtggctgcatcggccctggtaggagtccatgacctccggtgagcatgatgcttcatccttgtacgcaatggctgtgagcttgtttacttgaaggaactgatcgtgattttgttgtaaggtgggttaattgttgagcaaattttagcttttttggttgcaaaactatttttatggtacagttcatgtgaaacatcaacttttcccctgcagttcattactcgatgccttcttgtttcagaaaaaaaaaaatctccctccgattttttcataaatcggatcggatcaatagcaagcttctgcgatgaggaggtgactggctgctgcttatcccacggccatggagtcacgacgcagaggttcgattgtgctgcgaccttctgttagccactggattcactagcatgggataggtctcaatcg

SEQ ID NO: 47808 - DNA, 1501 bp, Oryza sativa
agagtccgaattgggccgaggccggtcttcgtgtttgggcctccaaggctccaactaaccaaacttgagtttcgtctcgttcttttaattttctttaaactagaaaaaatgcccgtacgttgcaacgggtgaagtttattttaatcttattattgttaaatggtttagttaagatgaaatttattgttaaatgcccgtgagttcgcttggatatatattttttttagaaaatcatgagctgcagttaggagtctgatcgtccaccggtttccagcgctccagagcggagtagagcagtttggtagctcacgaggctcataaccttgaggtttttaaacagatttcttatatgattccttctattatcaaaagtgaacgatcttaaaaaccgacccaaatacggatatgtatttccaaaagcaaacgaacttaaaaattgactcatacacggatgacgtaccaaaataccggcaaaaacatattcaaaatttataatagtagagatagagatatacgtgacgagcttcatgatatgcccgtttgagattagtcatctgtgacaggtgccataactaatctcgtttgactcatatgctgggccaaacctatctatgacaggccttatacttagctcgattgagatcactataatccatgccggccaaatacccgattaagataatatctcatatcagtgatctttgcttagtgacggtagcccttcccgacaccgattgagacctatcccatgctagtgaatccagtggctaacagaaggtcgcagcacaatcgaacctctgcgtcgtgactccatggccgtgggataagcagcagccagtcacctcctcatcgcagaagcttgctattgatccgatccgatttatgaaaaaatcggagggagatttttttttttctgaaacaagaaggcatcgagtaatgaactgcaggggaaaagttgatgtttcacatgaactgtaccataaaaatagttttgcaaccaaaaaagctaaaatttgctcaacaattaacccaccttacaacaaaatcacgatcagttccttcaagtaaacaagctcacagccattgcgtacaaggatgaagcatcatgctcaccggaggtcatggactcctaccagggccgatgcagccacctggcctcgtcctccttgtccaatcacgaaaaaagaccgtgtgattaatgaagcaaatatgggcgttgttatatggaggcagtgaaacgcaagagatcagttcgaattgagaaagaggagacgaagagatcgagtcggagaagcgtcccttggagaagcgtgggacgggacggacaggtcaggaagaggtgaagctgacggatcaacgtgcacgcctaccgaccggcggaaccgacgaaactccaaactcctgaatcctgatccgatttggacacacaataactgacaaaaaactacggcaaaaacatcttaaacttttataatagtagagatttaaataaatttatatt

SEQ ID NO: 47809 - DNA, 284 bp, Oryza sativa
  unsure (1)..(284): unsure at all n locations
tacccctttcttcttcctccaatccttcctctcttgagcaagccgggatcagtggaggaggagctgagcaggtcctaagtgcatgtccacaagctccttgtccatggcgcattgcacaaccgagaagtttcctccagtatcagaaaagcagcacactgaatcctacaaatgttgctcctcttcatcngatggcagattgngaaatttcgatttccccaaactggctgtgtagctcggcacacagcctgcagccatggcgctccgtcgccactgccgcttgaaga

SEQ ID NO: 47810 - DNA, 172 bp, Oryza sativa
agtacttcatcaatgagtataaaacaactcataataaaataaattataattacgtaaattttttgaataagacgaatggtcaaacatgtgagaaaaaatcaacggcgtcatctattaaaaaacagaggaacagagggagtactattatacacccgggctgttcgcttgcagt

SEQ ID NO: 47811 - DNA, 686 bp, Oryza sativa
ccctgctctatataaataatcccccccagttgctgaagaagatgaagcggatcccgctgacgaggagttcttccaggagcaagccggctacgatgagttttagggtttcagcctagttcccaagtcgcgcctgtgatgtttggtccaagtcttggcttccgcttcccttttgtaatgcagttgtaagctcgggatctgtccgcagcccaacatgactgtactcctactctataataaagagacctctgttgctgtgatattctgtcttcctgtgataccagcactgtttcctgggactgttatcgattaacaggttaatttggagcgtcacgggctagttccggtcgggactagttcggggcgtgacaagagatggtatcagagcacaggcttggccctagggcgaaacccgacatttaggacgaccctaaggatactaagttcaaaactacttgcgaaaagctaaggcttcttttggtttctttattttcaatagtttgtttctaaaatggttactgatcttttctccctccttcaaaattgtagatggcagtgaacgccagcttcagttcccacggttttggtgagggtcaccacgtcgctcagcttcgtgacctcgcccgcttccttggcttttcgtgtcccgagtacacggggtactccgtggaccgtgttccccctcgctg

SEQ ID NO: 47812 - DNA, 634 bp, Oryza sativa
aatagaaatcacaataaaataaataatcataatattattttttatgaaacaataatcagatgtaaattaataacggcgtatattaaaatcggagggagtactctctatttgaaagcacgagcttccgaatatgatctgtagctctatcctactcctctataaaaaaaaattcaaactggtccagattcatccctacagtttgattttttttacggagagacactactacaggaatgattttccttgacgggggtcattttagattgcaaacggcgtgtaagtagttgcgtctgcgaaaatcgtgctccattttcacgtgcgactctttaagatgactgcacaaaaaaaatcaattatcgcaggcgggccacttaataggtccgcatgcaaaaataggcttgttttcgcgtacggacctgttaagtcaccgcacacgaaaatagcctctcaacttttaatccgccgtcgctgccccacatgcacccactctcatcgctatctccttagatcccatctcacacctgctcctcccatctccctctccgcctcctcctcccatctccctatccgcctcctcctcccactcctccctctccctatccgccccctcctcccactcctcccatctcccagc

SEQ ID NO: 47813 - DNA, 670 bp, Oryza sativa
ataggttcataagtgttgaagttagatgcagtcgaaagaactttaggaatgtttgctgaaacgtgtctactgccgtgatgccaaaacagagatttttacttgtattaaatgaggtcacaaacacagagcccttccttagcttattatgcacaaccctttctcataaactttatatttctttgtcggtgtgtcctgagtaagtaaagtcctttgctttttcagtgactacaagtacttgttatcaataaaataatggaaaatgagtgatttattccacaatatatttgtatttgattctagtacatgagaagtttcctcttttcccccttttttggatgaaacatatttcagttttcagtcataaaaagatacaagtatggaactaatagtcacaatgcatttttaaaattcttatgctaaagcattcctatcatcatgcatatttgcaattgcatcttttgatacaactttcaacttttctgtcacattattccaatttcaaccaaacttccaagtttggttgaaattggaacgatgtgactgaaaagttgcgtgtgtatgaaaggtttgatccgatggaaagttggaagtttggaaaaaaaaactttgcaactaaacagggcctaacattgcataacttattatatgctctacttcttttctttgcaga

SEQ ID NO: 47814 - DNA, 538 bp, Oryza sativa
gatatcagaattaaaaatgtgactcgtaataataatataaaaacctatgggatctcgggttatgggacatgttgccaattgccatctctaatcagacctctgtttcgctgtttgttagtgattggaaatctaaagtagtgaaaatactaaagtttttcaccaccacaaagcgccatgtcatcggaataatattagccgttggatgcaacaaacattgaacccatgccgttagattttgaataggcctcagtatagctttagtcaaaaggtgaagacgagatttcaggagtcttcgatcagagtcgagagaggtaggcgaataggcagcatccacgcgttaaaaaaaaaagaaaaaaagaaaagctgccgccgcggcttcatcctcctccgccgcatcttccattcttcccatccccacaagctcctaccctggcctcagtctctcctaatcccctgcctcctcctccctcctgtccatcccccactcatttgcgtctcgccggatcaggccctgtcgcgtcggatcgttcactctagg

SEQ ID NO: 47815 - DNA, 1334 bp, Oryza sativa
atcaagaatacatcatatgctaccaaacatattgttacattgacttgatcaatagtagtactactaaagctagacagtggatgcctcatgcctggtcgcctgctcaaataatctggttactaggttacctttggtacaactctcttctcttcagtacacaaataaattgatccacatgaactataattctactgcaagttttcttacctcatactcaaacttatgattaaaagttcgcgctctaatacccacatctaaccgcgggtgcaaaattctccccaaaccatacccatacaggtaatggatatccataccactacactaatttagagcacttaaattttttacaataatccgatgatgacgatggcaagcaccaacatcatattaggcaaccttagttttaacattaacattcaaaagcaagtaaaaaatcatgtaagaattatgtcatatacgactggttacggataaggcatacctcatatcctatgacttacggaatatacgagtatggtataccatcggtcatacgaccgtaggtgataagggaaatctataagatattatagaaaatatcctcataggccggtgattaacagagtcctactcggagagaattgggtctattctatatcgtgtagggttcattctctccaagatctacttggagactaaggcaactcacgttataaaagacacaccccctaaggggttcagatcatcgaattatagcgctaacatacccaccatagtttacgaagccagattcgtcgggagatctcgtctaaccatctcgacaaggatctcgtcagtaacgccggattcatctgttgtctttgtactatatggttttccatatcaatctcatataaactggattagagctattaccttaggcacaccttttttttacccatgggtaagtggggtactggtggctaaagaaccgaatcatacctatcaacctgtagcgcccgttccgtcgtggcgcctagcgggaaaattatctcctaaaaaccctaattgcgaaatttgtttcttcgcttgtcgtctagtgtccgtgccatctcaagatctcaaatccccgatctatcgtcgagtttaattccgaatccaatccttccaaatcaaattcctccgcaaaagtctattttgccaccccagggttcgatgggccgaatctcgctcggcccatctccctctccccctccctcccggcgcgctctctctctctcccccttcccctccgctctgcccgcgcgccgcgcgcgcgtgtgcgagagccacgcccagcgcccctccctccgctctgcccgcgcgtcgcgcgcgca

SEQ ID NO: 47816 - DNA, 540 bp, Oryza sativa
agatttattccacatcccctctaatactcttcgatcccctccaaaccggatcccctccaaaccgaataaacccttaagggctataattttgctgttaattgttcactagaagagcaacaatggagttcaactccggaatagcatgtaatttgggatatggaagcaagaaatgttcgctagacagagtcacaagcaccaccccactaatatttgggtcccacaaagtgaacctcacataactatcgatatttgggctcaacaaagtaaaccttatataactagtttgtactctcttcatctcaatatgtagcaaccactgcgaatttggacatataggattggatcgtcggttgctacgacggtgggagcagaagaaatgacaagccaatttgttctcctttgtttgctctgacctcccaattcacagctgggtctatgtatcacttatcaagtactacagtgtatcaaaagctctccaatctgtgctgcctttatattagttccaccaagaagacacaaattccagcagagatagtccga

SEQ ID NO: 47817 - DNA, 1501 bp, Oryza sativa
tgccaacctgctggcgacgagtggtggtgcatggtggtggtgggtggctttcgggagatgagctcgctgcctctctgctgcgtgcgcgcctggacgtacgacgagacgacgagttcgcgcgcgaccgaatccacatgtattcatacgcacgcagacatggcaagtcggcgtgctgcaccgtcgtcgccgccggccggccggcctcgcgcgcggccacgtgcccgctcatcgtacgacgcgcgcgcgcgcggctgccgatcccaaccccacacccctcgtcccggtcgtcaaagaattacgcgcgcactcacgtaacacgagtagagaagtacagatctcacagggataaaaaagaactaattaccaagtggttctgcgtaaggcaaagcttttttttactaaccgagaggcccactgtaaaatcgctgtaaagttaattaaccagctaggtttgtacgttgttcacttgttcagcctcagggtcagggatgcgatttgccggagacttttcactaccagggattcttgctactccccatggagtccaccgtgcgctcgcctgattgagttcactgccacccgttggtttgatgcctccacgccggttcagagcgagcggttgggtaaaatcaggcgcgcgtcaccggtggcgacggccgacgtacgggtgtcgtcgcggccgtctcacaatgcggtggctcgcgcgtccgtggcattggcacgatcgcacaaataaacgcgccctgtgattttctcggtgaagcggcgtatctccgcgactccaccggtgttttcgccggttcaacgcagcccgaattggcgaatttggccaacggcggcggcgaccggcgagaccacccccgattccgcgcttcggctcggcatgtgtctttatccccaactgcatatcatcaaactttcctaatacagttagtacgtgaaaattctataagtattttctatttgcgtaagtttggttgcattgtatacggtatacctaccaatctcatcactatagtgtgctgctatggcctacacagaaaagtaggatctatgggatataaaatcttcatcaatcataaaataattaaacctaacaggcgatctatttactgcttggtaccctgactctattagaaacatttcccagtattagggaagacttgagtactagcgtggcccagcccagtacactgctcggctgggtttctgagcgacccagaaggccggactctaacgtgggcttctttcggcgtcggtttctggggccgggagtacacgagggggagggacgtctccgaggcccatgaacgagagaccgtctccgccacggcccgcagcctcgggggcttagcccttgtaccgcccgtcgcgcgcaaaacccccaccacgccgccgccgccgccgccgtctcgtcagcaagcgctgcccggagagagagagaaagagagacgcgcccgcgccatggggaggccgaagggcggcgccgcggcgtcctcct

SEQ ID NO: 47818 - DNA, 1501 bp, Oryza sativa
aaatatggggaaatcacatgcccctttctgtaaaaacgccccatgaaaatttattgcactgagctgcctcttcatgccgcttattaaagtctccaccctccgcccgggaaatcctttttaatatatttcgagaatttttttggttctcgggctcgccgcggacgcgatcccactcctcctctcctcgccggcctggcctcccgctgctcccggcgattctcccggaaacttttttttttcgctcgacgcggtgaagtgaagtgaattgccggtgctatccggggagggagagaaagagagagaagtgaactcaggtcagttcttgatccttctcctttttcatcttcttcttcctcgtctcgtcgttttcttggtttggttttggttttctcggtgttggttgttttccttcgccgcccatggcggctgatggctgctagagtggctatcttgttcgtgttcgtgttcccctgttttttctctgctgtttttttcccttatcgattcttttgatgaatttcggtatgaactgatgagacggattgtggaatttttttacatcagcggtttggttgattagagtttcatcttccattcgccaacggcaagagcaacaaaaaaagattataaaattttctcaaagtcgtcgtcttcttctcctcctactgctactgtcttactgctcccgtttactactccccatggcgacaccatctgatgcgcgcagttaaagcctgcgtcagagttcttccgccgccgacgccgagatcggtgcaaaggccgctgatttcgcccgtcgtcgatcccctcgctcccctttcgtgacagagaaggggcagaaaaagaaaaaaaagaagagagatcctttgcttcgtctagtaaagcttgctgcgttttgcatacctgtcggtctctgctctgctctgctctgctccgccgtgtaaaaaaaagaaggaaaaaaaaaacttgtggtttcagttagccttgtactgctctgtagcagagtctctagtagtggtggtcttgttcggtgttcgtgctgtgttctgtacctatgtgcgtttggtgagacagactggtcgtcactcgtcacacaatttcgcctttgctcatcagaaaccttttttttttctttttctagcattgtgttttgtgagattggtttgtttcttccttcttattttttttttatcttcctctcttttggggtgtactgtcttctcgtataaaggtttgtgtaaagtgggtggttttatcaggatgctggggggcttttctctctagagggaatctggtttacgcaaagcacggcatttgtttgtcgatagatggacatcggcattaggtctgtgtgttgttttctttttaatgtaatctggatgccggatgccggatgcaatgcattgactcttgattgatttttttttattttttggcaggaaataagcagctctattttcaaggaaattgtttgaggcatgactaggacttaagcacacaa

SEQ ID NO: 47819 - DNA, 1043 bp, Oryza sativa
aggagacagctcggcggcattgaagtattctaaagcctaaactacctctatggaccccaatttattacacacacaggatccaccatgcttcaatttacctaggataaattgaagaaaaatacactagtggtagcttaacaagtgtgatcgatttacaaataatccttgtacgtgtttctagctctaggttacatcagggggagcaccgttaaagatttttagaaagatggaaaaaaatcctcattcatatgtgagtttagagaggttttctcccataatttgttgtagattttctgtaatttttcatttaaaatgggggttaaatgaaattgatttgtctgaataggacaaaaaaaagtgagaaaaatagatattccgtacccaatgtcgctatctaactataataccgttagaacacatatgtacaacggttaaagcgactatcatcgttatatattttacactataaatctaatatatagaagcaacatgaaaaagagacggcgctatggcgtttaataccactcttttttttccttcatgtcttatgcgcaacccttcttttttttctatttttttctctcattcttgtaagtaaaataagtgttatgagacgcctctttatatcaattgatattatatatgtcctcattatgtgcagtccacttgtcaatatgtaggagcaataggtttggaaagagttgtacttgattttgcttttgaattcctccttttgaaactataaacgcctctttcagtgacatacaaaccaagtacgtttatctactaaacacaatctgtcatggtaatgagaatacaatatacactgaactctagatgaaaactagagcatacatacaagtgacatgtcatttcaatagaaaaaaggagagagaatctattatatatggatagttctaggaatatatgccattgactttgcctcttttccgaatatgccatcaagcttcttatttagtctgcaatgttgaaactaccactagttttcccggtgaaatgttcttttacaaaaggggggcaaa

SEQ ID NO: 47820 - DNA, 170 bp, Oryza sativa
ctgctccaggcttactatttgactgagaatcaaatgatgccttgtcgcatttgaaatttacatttgtatttttctttgattttagattacttcaccaatctaaacatgtatgatggtctatttgagatatttttaatgatcaataatcaccctggctattttgctacaga

SEQ ID NO: 47821 - DNA, 513 bp, Oryza sativa
atataccctttcttcaacttaatccatggcaggccaaattttttggtggtttcctgacggcagaagctgtgatcagaaagatgaacaagcttctgggtatcccagaagacaccgaggaaggtgctccatcgaataggaacccaccttggatatggtgttgcttgaagtcttaccgtctggacaagaacgatccctggggaagcagaaggtatcggatttttggcacagagatcagggattgaataggggagaaagatttggagcaacttggaaattactgtgtacagtggcatttgcttgtggtacagacacgcaaattgactgagttgtaacagctaggtgacagcctttcggttggtgctactacctacaatgttactgtgatgctgttagcatttggtaatgccagatgatttattttagtttaatcaaatgaattatatgtatcacataaaacttttaattgattttattaaaattatcaactggcataaacagaatttcctctctccc

SEQ ID NO: 47822 - DNA, 736 bp, Oryza sativa
ggcctcacccttgacatagttaccaaagttagtcttgagcatgtgttcgacgttggccgggttggccgtaaagacgccgccggtgaggccaagcgccttgaacgacatggtgtgcatggggctgcgctttaggacgccggccgaccactcgaggatgtgattcttgtgcttgatgaagtgcggcagagtgccaacgacagggtaggacttgagtccatgggcacgaggctgcttcttggggtcctggtgcaggtagaggaagtagagaagcggtagaagagggaggatgaggaggagagaagctgagattgaggagagttccatggaaacagtgaggtgatttttggcttgcgacttgcgagtggcgcaagtgcttgcgaaaagaggtggattttttggtttcggatcagagttcgagtgatggagtaatattgcggttttgctaattcgcgcgtactagcgacttagagacgtggcgggcccttgtcactcggtgagctttctgtgtttattttttccgggattttttttggatacatgctaactaatacggttagttttagataatgataataattaagataagatttgtttttttataacagattgataagaaatctatacatgaagtcaaattttgaaaactttcaccctaaatttgataactttcaactcaaaatttgaattttttaagtcaaattttgaaaactttcaacttaccatctcaaatttgaaa

SEQ ID NO: 47823 - DNA, 1501 bp, Oryza sativa
tgggtgtgtgatagtttagagtttggttgtgagtagtggggtgtgtgcatgtgcaacattgatttaatcgaaaataataagcattacaaattttaacgtcaccacattttaagtgaggcaaagaggcatgctctaagcctccagctagcacaatcctcaatggtatctatatatgctactgtaaagggggagcgtatcctatgtacacaggccctcacgtgtatacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgtaaccttaaaactgtcagattttttgtttttttttgttatggctaaaatataatgaatttgacgttaagattttaaccctaggtgtaatacaattgaaagtatgtgtatgattttttctagattttttggtgacattttttagttggtgtgcacgtgtgtacacgtgagggcctgtgtgcatatgatatgttgccctgtaaaggagaatcgttctccgcttcactttcccggggccacatgtatgcgaaaaatcagtgaggaaatagatcttgcacccccatctcctcttaagaaaacaaaatattttttttctagaaaaccggccatcaggaaaaatatatataaaaaagtccgaataaaaaccaaaacgctcggttttatttttatcccatgggatatgggtaatttgctactacatccatcttatattattctacccttcaaacttgtcccacaatataacagatattgatgttgtggtgcactgtactatttatcacatcaaccaactataatttaactttcttcatatcttatccccaactacaactcacccacaacaaactctcacttaacaggggcattatagtccttttattcttaatctttcaaaaagaaggaataatcctagtattatagaatgaatgcaatactatttgtaaatataaactcgacggtatgaaaccaatttttctttgtttagatgggctcaaatattggtcatcaacgcaaaacaaaaaattgtaattaacatatgattaattaaatattaattattaaaacttagaaattttatttatttgatttttttaataaataatttctatgtagaattgttttagtaaaaatacacaccgtttaacagtttgaaaatcgagaaaacagacaagttgaaacggagtttagagcgcaccctcagtttaatttcctggtatgggccaggattttgcatccgtttcactttcacacacggtatcttcccccggcgacggaatccacctattactccagtccagattgagaacgcgcgcggcccacggccgtcgcgcttaaacccggacaaggtggcgagtcctagtagtagaagtatttacggagcggcgcgacgcgatctcccaatggcgt

SEQ ID NO: 47824 - DNA, 1501 bp, Oryza sativa
ccgtggaacgcacccacaccagcaacggtgctgccgtactggccacacataacagcactacgtacagcagcgcaaatgcagcctgccgttgtcgatcagtgaagcaacagtaccgcgctaggctagttacctaccgctgctagatcgctactccactgaagcgtaacgttagagtatctctaacagattagctattttagactcttcatatgtctatttagccaactatcaaaaaaagtagctagttataattaccttttacttcaacagtctctccatcccattctccaatttaacggtgggtcccacacgtcagtctctactacttctttcctttcacacatgagcccgcgtgcatgcggatgaggcggccgcgggaggagttcgacggagccacggagggggtcgccacacgagatcggcggtggtcgagacggtgatgggggttgcagctttgacgaggatttggccgccgccaccgctaactgctttgccgaggcgggcggcggtgccgacgatgggggccgagttggcggagacgacgccggtgacgagaagagcatgagccgggagaacatcgacgcggcgccggggccgggaggatggggcggcggcgctgggcagatggagtgctaggaggacgtccggcggcggcgttgcgcggatggggcggatggggaaagggggagagataggatagagggtgggatgcacaccagatggcaagccgtcctggctggccaactttggccagtgaggaggggaatttagccagccggatagcttggagagttatttggctagtctgttggagtagatttttttgtccaagttagccaaattttagcttgtagagtcatttggctagtctcttggagatgctctaatctggggagttttgttggaaggttaaaattataagagtcaaaacgaaacgaaggcatatccggacaaagaaatttgcacgtaacgatcaggtccacaccacagcccacacaggctactgaagctaggatgggagcgtaaaatctccaggacacgttgggggtagctttcagtttagtctagtgcatgtgcagggcttcccatcccatgcaccagatgcgtatggccaggccacacaaagtatatatggcgtgcagcgtgctatgtggccgctggctacgtttcgcaccaattaatattggagctatcgttcttcttcccatcatcattatctgctcgagtaagacggatcatgtatactactaccatgatgatgagtcattttaacagtctgcaagtactaaaagtaagtactagtagtaatttgagactgtttccgttggtaaaagtaaagaaaaactgtatatgctgaaatggcgccgcaagcagaggaggaacatccgtccgttcccggcctcgagctgctctcccgtctttacaatccaccgcgtactaccgcctccaccccttaaaccccagcaattaattcactctccactacactcccactctccac

SEQ ID NO: 47825 - DNA, 1361 bp, Oryza sativa
caataaatcgttcggaacaagtaaactacggttttcataaaatcaaaaagttatggattaaaaatgtagcatgtcaaaagcattaatacaagaaaactttcgaaaataaataaatccaataaaagcataatgtttaaacggaggttggaaaatagagcgtcaagggagaaaactagaaatgttttcataaaatatttaaacttatggatgaagaataaagcgttaacggagaaaccaataaatcgttcggaacaacaaaactacggttttcataaaatcaaaaggatgcaaccaaatgtaaacgtctaggccgcaaccaagataaattttggataaagagagaaatgtaactctagaacttattcataagtctacgattaaaacactagaacaaaaaaaaaagtcgtaaggtttaaagaaatagacaacttattaaagtagcttattataatctggagcccagcttattataatctgataagctcatttatgtgagctttttctaaattattgggtgaaaaattacccaccatgccaccccactccctctttagacttgcaaacccaataatctaggctctaataatctaggaaagaaacaactaaccgcttattgtactacagattataacaatctagcttatagtaatctgactcaataatctagattataataatcccaaactgaaagaaacaggaccttagtctctcacatattggatgtttgacactaattagaagtattaaacgtagactattaacaaaacttattccataaccctggactaatttgcgagacgaatctattgagcctaattaatctatgattagcctatgtgatgctacggtaaacatatgctaattatggattaattagacttaaaaaaattgtcacgcgaattagcactcatttatgtaattagttttatataagtagtctatgtttaatactctaaattaatgtccaaacatccgatgtgacagggactaaagtttaagtttagtctctgaatccaaacaccacctaaatcatgtccgatattaagtccgtgctaatccttctctctccgattctataccctaatagtataggtggaatcagctgactacactctggtcaatcagctgacgagtagaagggacggcgccaccatgcggtttggcggactctgaggctagcaaggtctaacgccgccaaggtttgctctccctagtgacgcactggcgtgtggagctcagagatggcaccagatccgcatcaccgacttcgctgcctcctcttccgcacgacaaggtcaccattgttagacattgggcacctcgatgactctaggtggcctccgtggttgtagaggaatcca

SEQ ID NO: 47826 - DNA, 510 bp, Oryza sativa
tattgctttggccatataaatagtttatgcttttgataaaaaaaaccactacaaatctattttaatatataaaactgattgatagaatttaaaaagtttaacccatttttgtttctgaatgtcaaataggagtaactttttatcagagagattatactgtaaaaacatacgtaagctaagaccagggcataaaaaagacgaaatttgtcacgacagtttccctggataaatcaatttcaggatttggattcttaaccatattcactcgatggaacccccaatctcgttgtcattgcttaagaccccctgattttgaaaataaaaaacagcactgtatattttgaagacgagaaaaaaatcgcaaaaagagaccataaaatgaacgaaaaaaatttgaaaatcgagtgaaataggcccaaaatccaaaagagatcaaaagaaaagggaaaaaaaaaaactctccgccaccaaagcgagtccctccccctcccgtctcgagcgccggtaaac

SEQ ID NO: 47827 - DNA, 1002 bp, Oryza sativa
cttgcggctaacttaatgtgacagttaaatactaaatgaccggtgttcggaaaagaaaatatttgagcccactgcaagagaaatgtactattcgatcatggcaaatgaagcttgaaggttacgttgctagtgaggaatatttctcgagaagatatcgctgggccgctccaaccacacttacaaactagcggcaggaactctggaggaccacatcaatgtgggtttctagcatcataggggtattgtagtaacttcctgtgcaccatcggggttaagattataactccacatttatgtttggggactatataagccagtcctaatctcatagtaaaataccataccatatattgggctttacaactcgaactcatctcgttcttagaataggcgggaaaaatgatacttttccgcctatcctctgttgatctgttacccaaggtcacgaaataatattttattatcaatgttttgctttgaatagttccttaaccaatatttttgttttggattgggtatttttattttcatggtgttttagaccatccttaattttaattatctacatctaacttgttacatgaaaaagaaataacttgtatatagctgtgagatttaagagtttattgatgagtaggaatcgacgtattctagattgttcaaacaatcgttcatatgtttgagacgagggtcggtagtcaaaagtgaaaaagaaaaaacaagactaccctgtccaaaataagaacgtcgattaaaagatgttttaaagtaaactatcagtaatgaaatatgatccgaaatgagaattactcaaaatgttatattatgatcatgccatcacacatgatcgtatcaatatccatcgacacgtgcacatgtgggcatgcgtgtgtgggcagcgtggcgccggcacacacaaagggagaggggagagcgagaaccacacgcacgcacgcacgcacgcagccacaacaggggagagattgcgagcgcgatggccgc

SEQ ID NO: 47828 - DNA, 1146 bp, Oryza sativa
ctgccgcattccgcctcgccccaccatccacaaggggcttctcccccaccccttccccgccgccgccccattctgcagccgcagccgcttcgcccgcagccgcagccgccgcttcgcccgccgccgcagccgctgctaacactcgcggccgcgctcaccatccgtccccttcaacttctacaagcgactccccgccaagtccgacgtcctcctctgaacaatccaagtatccaactactacctacccattccgttcccttccgtccttgccaattcacactcatcatctggaccaagtacgtgcagcagcaacaacatacaaggagtttttaccggccgccctctactctcagggtgtgtttgaggggaaggggattgaggagattgagaagatacgcaaaacgaggtgagccattagctcatgattaattaagtattaactattttaaatttcaaaaatggattaatatggttttttaaagcaactttcctatagaaattttttgcaaaaaacgcaccgtttagtagtttgaaaagcgtgcgcgcggaaaacgagactcaatctccccaaacaccctggaacgaacggtgcctcaaaattcacaaggcgcgcacacgaggtccagtcccgggcggtagtagacgcagacgcagacagtcagcttcgcccgccgccgcagccgctgctagcactcgcggccgcgctcgccccgctgctagtactcgcgtcgcgctcgcctccctccgcgcccacgccatgccgtggacgacgacgatggacgccaacgaggatggacgatgccggcgacggacgggtgtcggcgcgggcggtggcggactgacgacggcggtgccgggcggagaagacgacggtgctacgaacggaagagacagagtggcacggaacaaaggaaattcgtgctccgatggcgtattctgaaagtagcatgaattggatggcatattctgaaagtagtgcgaattcgatggcatattctgaaaattctcgcactcaacaaatcgactaacttaatcaaataagcaacatcactccataatctgcgcctctgcggacttcacgaggctggcatctccatcgtccaatccaaaatcaccaattcgacatgggcacagagctctcgttga

SEQ ID NO: 47829 - DNA, 671 bp, Oryza sativa
gggttggggaactagatggaggagagagttgcctgcaaagagaaagggaggaatgaacttttgtgctgctggtttcggctttaagtactgtacaatggagtgtttatactgtcagataggtagcgtgtacagttaatcagtgcttaatgtcagaagataactaaactaaactagcgattttaatgcaattgatatatttgaaagttctgatggtattctggcaatttcctgagaaatcttaaattcaaactctgccgtacttgttagctgctgtacgcagcttgttataatctgcaatgtctgatcctaaagcccacgcattcttatagttaaccatgtgctagagaattttgcttaagatgtggattccgattaagattaaaaaaaatcacttgtttacacatccagttttttagtgtaagaacgtgtatatatattcataattcagtgattagttctagatggttccatgttaggaaacctacacggctgaaagtttcttttcttcctccatgtactgtgatactgatattgtgatttccagtagtgccagatggactgtagattgtagtacattcttgcgacagaatcatgaaaacatcacaaaaactcaggaaactccactttttggagcgagcgcatgagcttaatttagtaaactcattatgaaa

SEQ ID NO: 47830 - DNA, 201 bp, Oryza sativa
ttcgatctttctcctcgcctgaaattaactaattataatctgaatcggagcgcaggtcatccgccacttccgttgtgcgcacctatccatacccctccatcggttatactctactacttagctgtgacgactaacgagagagagtgagaaagagagagagagagagctttttgatcagtcggcaatggtgacgcactctga

SEQ ID NO: 47831 - DNA, 513 bp, Oryza sativa
atttacagattccgtctgtaaattacgagatgaatttattaagcctaattaatccgttattagcaaatgtttactgtagcatcacatcgttaaatcatggcgcaattatactcaaaagatttttctagcaatttacatgtaaactgtgcaattggtttttttcgtccatatttaatactccatgcatgtgtccaaacatttgatgtcacattttagaccaaaaatttttgggatctaaacacaccctaagcttagttgcagcagggttagtcatcaactactcctacatattttcggttagttccctcgtggtgctcaattaatagagttattatagatagataaatgtgcttacgacttcacataggtcagagaacaaaagtcaaacattcccttgatcagaagaactggaagtttcttaggcttgtctaattttaatggtagagtttaaattggtgacattattggttccaagagggcaagtggaactaaatgtttctaatttacttaaga

SEQ ID NO: 47832 - DNA, 1501 bp, Oryza sativa
cctgtttagatcctccaatggcaaaagttttaccatttataaaatggcactttttgccattttggatctaaacacaagtagcaaatgttgacaatttggcatttagcatttgctagtccatagtagcaaattgtgccaaaaagtgctttggaaccactccctctttctctttagtgctagaatggcaaaactttaacatgcatctaaacaccagctagtacttttgcaatgtcaaaacttttgccaccagaactttttaccatttggaacaaatggatctaaatatgccctatattgtcaaatcatagggtaattagcttacaagattcatctcataatttgcgtgcaaactgtgtaaatggttcttgttaaatttggaatctaaacacggccatagccgtaagccaaggttcttttagagtgagggagtacttcgaagcaattacaatctggattactaattctgtgatgtactactgataccctacacagtactagtaactctggattagtagtacctggcacctgcactatcgacaaaattgtttttagaagtctgtataagcaattctatgctctttaatgggaaggcaattctgttatgcatataatggagtagtaaaccactgtgcacttcagaagcaaataaaataaaataaatacataaccaaaaattatctaaaaccaaatccttcatagtttaagccgcacattccatttagcacaactttcgttgtggttagtaggacatcaaccgggcattgccatagcaaatactcggattattgatcggaggacgcggtacttagtactagtagagttaagttaacaacacacaacaacgaaggattatcgatcggctcaaacataacagccactacacatatgattacaacacaacaacggcagaactagtagttctatctgctactactacagtagaaacgaacaaggaaagactacgaacaaccaagccaagccagcctctctatatgaatctatctcccgttctatccttccatgcatccattgatcgatttggacaatcggtagggatagaatgcaagatagataccatgcgcaacccacgccgtcgccggagacgacgccgacgacgacgaccagctagcgtgggcgcacgacgaggcggccgaccacgtgcgccttcgtctgctgctcgccgtcgcgcggcggctcgaaccacaccggcaggaactccttggtgcggcaggggaagcacgacgccgagaagtgcgccacgaacgcgtcgagcccctgaaggtaggtttccaagaaagggggccaagatcaaacacctatcggcaagcaagcaagcgcgcggcgcggcgagcgagagcgcgagcgcgcgtacgtacctggatggcggcgggcacgacgtcgcagaccttgccggacatggcggcgtcccagcggtggtcctggaggaacgcgcggagccgccgcgccgcggtcgccgtcgtcatgttgacgaaggcgtacc

SEQ ID NO: 47833 - DNA, 1501 bp, Oryza sativa
tccttcatgcatgtgttcaaagaatcggtgtgatgtttttatgaaaaaattggaaactaaaccaggcctaccagtagtaaagtaaactgacctgatgttgtatttgaaataaaaagtctgtaaagaatttttgtaggattaccatcgttttgaaaaaaaatagggaaaatgatttacattctcggtctcttctgacaagctagcacacaactaaatcctttggtatatttaactctttggaacaaatggttggagatttcaaaattccattcgtatattttggagtaaagttagcataaaatcgtatttccttctggtcgatctcttccatgcaagttttgcattttccccatacgttcagtattgtcaatacgaagaatcattcgtgtgtattgaatcgcaggcccaaattgaattgaatctccagacccatttaaatagcaggaaccaaaaaaaagggggaatagaaaaatatataaaattctaacaaaaatacaagtgtaaaatagatgattgcaaaacgcggaaaaaaacataaatgaccgtttgattggatacatgaaaaacgcgagaatcatataagaaagatatactcaaaagaaatttcttcatagattgaagctcttgttaagtttgaaacctataacattgtccattcataggaattttaaacaatatgatacgattcaatccttggtttcaaagttattcatataaaaaattcttataaaattaaaatcctttagggcccctttgaatcaaaggaattatggaggaatttcgtaggattaaaatcctacaggatattttcctatgtagctctttgattcaaaggattgaagttttccaaatcctacaaaattcctatggaatggcttgttgcatataggttttggaggaaacttagcaagaggtccaacctcctggtaaaaatcctttgggtctatctttctcatccgattcctatgtttttcctgtggtccaatcaaacgatcattcttatgttgttcgtgtgttttgcaatcctctgttttacacttgcattcctatcagaatcctatatttttcctattcctctgttttttcattcctatgattcaaaggggcccttaaagttttttttttatgattttcatataaatcaaatgggactttaattaatcataggtttgaaattgaaagggccaaacaaaccatactgctgctacaactagcactcctaacctgacacgatagttttgggttccaaatgatcccttttaggctatccaatggaccagctgtttgcttctactactactccttgcttgacacgatttggagggagtagtgaccgtgtgtagccacgtgacatgtgcatgcccacggggtgttcggcgaaaggccagggccaaagcactagtactcctcctcttgtatataatggctttctccctcaacaatcgatctcacctctccccatccgaacccccaatttttcttggctagatttggcgcgaga

SEQ ID NO: 47834 - DNA, 1501 bp, Oryza sativa
ccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagaaaagtctcacacacatattaaattatggttcaagttaagttctctctctcacacactcatggcagtcctaccaatagcgacaccgatgtagggcacgcctctcggccctacctcaacgactgtcccaccgtagcgcacctgcctcactcaggggtgaaccatctatgcagagatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttagttttatttctcctttcgcaaatcatgtcatcaatatcatggcaatgtggtgctcatgtctccacatgccgcatctcaattaccttcccaaaggtaattgcccaagcatatagcatttgataaatatgagtatgcatgattctaaaatagcatttctaagcatttgtcatagttgattagggactcatacgtaaacatggttacgaaggaataaggggtaaacaataatcaaggcatggcataatcgcaagtgggatgttcatcattgcatgcaattttatttgtaaacaaaacaatttcgcaattgggatcaacatgttcaaggaatagtgatgacttgccttgctcaggatagtccttattcttgatataattcttgatcaaccttcaccttctggaagttgctgacgttgcctcacgactaaccgatacacaaagtctataatacgcgagaaaaaccaatattcaagcaacaatcaaatatgcacaaacaaaatatatttgttgaggttgaacctaaggttgctcatattattcgcgcttgctaatgggttccaacatgctaagggctaaagtctcttaatctttctgttatcatggtggtctatttaggagctagccaatgtagtatgaatgagatacgtatctggctaatttgtggtttagtctagctaatggctatggaaggattatggctacacatgcatctatctaaataaaatggtcgtatactagaggttttgttgtcggatgtatttaggatcaatcaaataattagagtgaatcatttgtattatttattttattgatgggagccttactttaattatgaacatattttacttgtcacaacaaattataaaaggttaataattatcca

SEQ ID NO: 47835 - DNA, 1501 bp, Oryza sativa
ctctcgtacaactagtactacaccgttttgaacacctgcactgtcgcatggtagatggagtatcgcgctgtgcctgtgcatagctctccggaaaatctaccgtcatgatactcgtaggcctcattcgaatgtcatgaaatggtggattaaattttggatcaaaatggcacgctttttaaatagctaaacgctacgtttcatgtgaaaattttctatatcaaggttgttctaaaataccagattaatccattttttaagtttgtaataattaaaaatcaattaattacacgttattaccacatcattttatataaaatacttaatctccatcctcatatttatcttaaggagattcagacactaccgtagtagtactagtatcttgcattgcagccgccatacactgggcagcgtaaactccatcacttttcctatggaacggtcacacagcctcataggggatgagttggggagtgtttctttactccttcctaacttaaatttctcattttaaacgttcacacgatgatacttcctcggtaaaaaaaatctaattatgagtttaaatttagatatagtgtatgaccaaattcaaattcaggattagttttttttagagagggaggactccgtaataacaaaaaaaaaagtcgtgtacatgtcggatgtgacggcgacttcctccccttgcagatcgatcagaattcagggcagacgaccggcagacagcaaatacggtagctgtcgatcgcgcgcgtcgctttggccagctaggcggcttccgcgccggccgtctccccggcgggtcgttctgtaaacttaccaggaggagagatgtaacaaaaagtaaaaagttaagagtgttagctcttatgcaagagctagcttaacacaaactccaagacaaattcaattaatatataagtgagagatagagagatgagaagaaaattatagccaaccttatagctaatctattatatatgttgactttaaaattagctaatagtaataagtgagctatattattatccttactcttgctccaacacatgcaaacgcgttctagctagggggacaaaaaggaaagatgcagtgcgtatgcctcgggagccacaccgcccgctgtttcttctcttctccctgacgatcgtccgaccgatcgacgatcgtgtgttgtgaatccctcgtgccgatcggtccagttcgatcgaacgaccgcctgaagaagctaaaagcacgacatgtttattagatggatcctaatcggtgacagagccaacggttaatgaccaaacgattggagcttgttttctttctttctactccctcctcagataatatagcatctaggactaatgagacatcacctgttacgatgcactatctagtcatatgttgtatattttcgaacggatggagtactatgtttattacaccgctgatgtatggtgtactgcagctaggctgagttcttaagcgatatactatgatgtgacca

SEQ ID NO: 47836 - DNA, 1501 bp, Oryza sativa
attatttacataaagtttagcctcatattttgtaactaaaatataaacacacatagatgaatctttaacttgtttaggagagtaatcacaaagctagttgtatttggaccacttaaaaaaaattagttgatacaatgtcatgtgaagtagaatatatatatatatagtcggttgatatccattagttaaccaaacagagccatcttaaaatcaacatgtattgtatagcttacagtaaacagaaactactcaaatatatgatccaataataagatattgttgcttacacatatactatacatcccattacagtggtacggtatagtattaatttgcatgttgcatatatgaaattaagagggagtgtatgacaaacatgtatattaaataaatactagttataaatcttgacctcatataattataattatagttcaactgtaaattaggattattcattataaaattatgtgatgggataatctgtaaccataatatgattaacctaaacaactctaacatacaaagcatggataattattaaccttttataatttgttgtgacaagtaaaatatgttcataattaaagtaaggctcccatcaataaaataaataatacaaatgattcactctaattatttgattgatcctaaatacatccgacaacaaaacctctagtatacgaccattttatttagatagatgcatgtgtagccataatccttccatagccattagctagactaaaccacaaattagccagatacgtatctcattcatactacattggctagctcctaaatagaccaccatgataacagaaagattaagagactttagcccttagcatgttggaacccattagcaagcgcgaataatatgagcaaccttaggttcaacctcaacaaatatattttgtttgtgcatatttgattgttgcttgaatattggtttttctcgcgtattatagactttgtgtatcggttagtcgtgaggcaacgtcagcaacttccagaaggtgaaggttgatcaagaattatatcaagaataaggactatcctgagcaaggcaagtcatcactattccttgaacatgttgatcccaattgcgaaattgttttgtttacaaataaaattgcatgcaatgatgaacatcccacttgcgattatgccatgccttgattattgtttaccccttattccttcgtaaccatgtttacgtatgagtccctaatcaactatgacaaatgcttagaaatgctattttagaatcatgcatactcatatttatcaaatgctatatgcttgggcaattacctttgggaaggtaattgagatgcggcatgtggagacatgagcaccacattgccatgatattgatgacatgatttgcgaaaggagaaataaaactaaacaactgttttcgactggggcggacggaggatttgggtggtatctggaaaaggctagtaccgtccccggtcaattaaggaccgagcca

SEQ ID NO: 47837 - DNA, 218 bp, Oryza sativa
atctcctttctctctctctcttttcttttcttttcctttctctctcttttcttttcttctcctttctctctctcttttctttttctctctctctctctttttcctctctctctccctttttcttctcctctctttctttttccctctcttctctccctcccggctcctttctccctctctctctctcggcttcttgctctcccgggcggcgacgacga

SEQ ID NO: 47838 - DNA, 1501 bp, Oryza sativa
atatgaactggaattcaccaagcgggaacccaaattggaataaccagcagcgagacaatggaggcaggcattctgggcatggtggtgattttaatggcggtgactctggtgggaggtcttggaggtcgcagtcaggtggtgatggagggtcgtggaggcctaaaaggggagtctgctattctatactcgacaagggatactgcaagaatggtgagcactgcaacttttcccattcaataccgaatgatggatatccatcaagaaacagtcggcacttcgataggcaaaattcaggtaacgagagacggtacgacaggcaaaacgagaggactgatcggcagtttgatcggcaatcgtcaggcaacgagaggcgtgatgacaggcacaacggcagggatagtgacaggcatgatgacaggctgactgatactaggtcacaatcaagagagaggcagtagatccgttctcagtttcatctgttgtatcctcccttttgttgtagttcctcagtagacatccatatcacatatgcatgtttctgaacttggtgcattgtagcgagttgcatctcctcagaattgtcatgtagaacagttgtagttataaatcatgtgcatcctacccttctgtttcttgcttcggaacaagcagtaatacattctgaataaatcctggtgtcaggtaggaaatgggtactaaagcaccccccctggtgatatgctccaaccttttactgtgctggatgtatgcttgttgtacacagtaattctgtctcatgtagcctgttgattgtcctgcttcttttctgtattgagattcttgtatcagttctgggattgtaggccatttcaaatcttctgtttgttctgcttgcaacctggcgtttcagatttttttttggtgctgtttatcaggtcttgattctgatataattttcacttctgtgtatgtacatggtcttgttaaggagtataaatggaaccataattcgacttttgccagaattgagaattggtaacaaccatttgatttttttttatgaattattcgtaccgattcgatcaattgaaaccaacgccgtgtttagtactaaaataattctaaaagctttcaacttttttatcacatcaaaacttttctatacacataaatttctaactttttcgttacatcgtttcaattttaaccaaacttctaattttggtgtgaactaaacacagcccaattgtgacaagtatcacggcaacctgaaattaatcctacagtacaaatcaaaattttaaaaatccaaagaagtaacgtaactactcgtgaattgtcttgatcctctgacctgactggtgggccctctagtcggcgggtacgattcgggaacccaatcgccgaggttggcgggcccacatgtcagccagcgcaggggaggacaaaatttgacgacgaaatctcttcgtcacggggagtcgagaggagaggagaggagagaggaaaagagagcgcgata

SEQ ID NO: 47839 - DNA, 256 bp, Oryza sativa
atcgtgcgcgcgggctgtgtttcgcacatgtgtgttgaacccgtgtcacaaaataggaatgtcggtctttgaacacttcgcacgttcgaatcgatcgtccacgatatatttgcccggattttaaccaaatttcatgtgaaattcgacatgcgaattaaaattaaaatatccctctcctgtcccgtagctggcgtcttgtcgacgggtctctgtagctgacatgtggggccatggcgcgacaattcacgctcggtca

SEQ ID NO: 47840 - DNA, 185 bp, Oryza sativa
aagcccacctccgtgccaagaatgttcgcgcaccgcctcgtcgacctctccactcgctgctctacctcccgcgccgcctcaccatctcggacatcacggcgcaccggtggtcgaagcgcaccgcggtggcctccgcgctcctctccccactcctcctcgccgccatcaccgcgcctcaccacagc

SEQ ID NO: 47841 - DNA, 396 bp, Oryza sativa
gatggacctgtcctggctattgtttctgtcagttgttagctaggatggagccggcaagctcctgcattgagttaactttcgatcacatcgatccctttcctcaggccaaatcgtacaagaagaatttattcgatgggccttttgctctgtacatatagctggaatataatcctccttaccctttaatcccatgcaactactctttctacgttgccacttcttccatctgaatcaaacctatatctgatagcaatagcatgttctttctttcttcctatcttcagagttcaggctgttgtacttaatttgtgggttaattcagctcttggataattacaggattacgaaatgatccacacattgaccatgttctccaagctagataggaaagaatca

SEQ ID NO: 47842 - DNA, 217 bp, Oryza sativa
ttgcagctgtacagcaagtgtttgccaaggcatcgatacatccaacctccattggggtgcttggttaagtcggtgtacatcaccattccgcttgctttggtaagaacttgtaagagcttggttaaaagcttgagtgtgtgtgatatttgagctgccactacctagtagttgataggagcgtgcatatttttgtgtgtttcttgtttgctactaacca

SEQ ID NO: 47843 - DNA, 186 bp, Oryza sativa
acataataaatcatagatctgacaatattgtatagattggaaaaatagatatgataaattgtatataaaatattgcgtactttgtagatacatgccggatgtatgtacgaaattattagactaatttaaaaaattaatcttaaatacctcgttttgggtgtttgatgattattgcttgtggacagc

SEQ ID NO: 47844 - DNA, 1501 bp, Oryza sativa
tattttaggagtatagtttttgcgtggataaatcttgtactttcatttttagatccaacaatagttttttttattttcactatatatcattaaatatatagtgcgaggctcggcttctgaaacattttactgcagagttgcgagcgagtcacgagcggaatgacttgtaagttgtaacgagggaatacgaggaatcgtcaatgatctatcaggatcaggataatcaacagttgcagggatcagtaacttaaaatgagttcaacaagcacctcagtaacaagtcaagctcagcattgaaccttctcccttacacaacaaaaaccgattcacatgttactacagcttagtcaagctcactcgtgtcaagtgtcaatcagacagaacagaaatcaaacattccaacagcaaaatcggccattcgagatgaagaccaaagtggggaatgaaaatcacgcactcctttaggacatttggatctgtttctcttctcgctatgcttatctcgggttcctgaatcagacaactgagaggcagaggctgtaaaaatgtgcagacaagtaatagaatctagtgttctcaacggcataccaaacgaagaacaacatacctagttaggttgtctgttgtcgccttctaagcttttgctaggtgatgcgtcaaaaccatgatcgaactggataacctgcactgtttaaaatcgaccaccagacatcatcatatggttggtccttgaagcaccttcacaacttcctccgctctagcctgtatctcttttagatattcaacgagtatgcgctgctgataagaacctccttcctgtcaaacaaaaagataacaagaggaaaaatgaaaaatgtgctgaggggatgctaaactaaagacaaggtcctgacaaactaaaagagattgcgttctctgtataactccaaaggttgggatattactgtgcgaattaagactctctcaattctcttctttataacagcataaaattcttctggtgaaacatttcctttccccactgttaacccatcaagcaacagcttgttccactcgttttccggagctgcaaggcacaatctggatatattaaaggttgagatcagttgattgaagacaaacaatctctccgcacaatgatacataccctttattacagattcaagaaaactttcaggcactattacttctccccctgaaaatgaaagatagacaaatcaatttaaagggtaatcattctcagtggttgtggttcaacagtccaaaacgaatgaacaggatttacctttgtaagcgtaactacgcttttggagaaaattggacgcatacagctgcaacaccttctgcagcatagcttgaagtcctggtttatctccatcttgtttagcctaaacacatgtaagggtgtaatagtaaaatgagtagcaaaactactctatgctgagtaatatatcaacaaagttaatccacaatgtagaaaatgacacatacctgcctcaac

SEQ ID NO: 47845 - DNA, 1501 bp, Oryza sativa
agggagattcgagacagatgtcgagcacatacccattggaggacgatccaacaattcatttttaaggaacacctgagtttgaaacaagttacaagcaagatactgctcggcacacgccataatgctcactggtgaaatcaaattaacaaaatccgtgtgaagttgtgaagccaaatgaggacatatcagtatatccctgtgactaatggtcactgtacgcgtcggtggcaaacctaacaccgcacagaacaaactggccatctctttccatccgaagaaccactacgctagctacgaaacaaccatatgcctctgacggattatatcacgaattatctacttaattatcatcatttttttaagaaacacgcctaataaataccttaaaaacaaactatcgtaggaatttccttttagaaaatgtatttagaaaactttgagcaaataaccattttgtgaataaattagaaagagcatggccaagcaagctgagcaccaagcaaatactcatttcatcctaaaatataagaacttagaatcagataaaatttatgtttagatagatttgtagttctagtacgagagtatcgagtaaagcaagcaaaagaacgggcaagacgcgttcggccgaacggcaacatcgtcggctcacacacgcatcgcacgcagacccagcaatacggcgcggtgagggagcacgacaccgatcgccactccaccagtgagcacctcacagccccatttttttttaaaaaaaaaaaaacaaaccagtgagcgtttgtgctgcgtcaggtcaggacgaagaacaaacagaaaacaaaccaatccactggggcacggccgcacagtgcatacagtgcagttgcagagtcgtaattagggcatccacaatgtagtctaaaactagttcataagcaataaaatattctatttagccatctaacaacattatggaactagtccatagcaagaaaatagcaaaagccacccataagcatatgagttgcccatatagaataaaatatgttatttctctctatttcctctctcctcttaatactagttgctatctatatacattgtgaagataacaatagttatagtccatatgtgtgggtcccatctatatggactacttttactgtatatattgttgttgccctatactagtgttggtacaatagcaagctataagccagctataaatatattttaaagagataaaggaaaagagagaagagcagcacggactccaaaacgtaatgtgtgtatgacacgtgcgaccagatattaatattatagtaagcaactattgtataaatagactattacaatggctatagatgattcggagttagtagtggcctatcctattaaacttgctctaatgctccaataggagtatttagtgggagatttgaatccagtccaagcagacagagaagagaggccgcctcctgcacaccgaccaacccccctcagcctcagctcagctcctccc

SEQ ID NO: 47846 - DNA, 588 bp, Oryza sativa
attttttttatttcagacaaaaatctatgtttgcctaagcactgtaactaaatgtgatagacctatcttacgattttcgtgtatcaaagcttctttacataaacctataatacgacatttcacacgtaaaacatctgattgcgtaatactggaagtaatcatgctaggcatattttggtatctacatgtatcaaagattctttatgtaaactacaatatgatcctgcaattgagcactagtttcattcataagcatccagaaggattttcttttcttgcatttccatgtgtaggatattggttggcatcatcaacctataaggttgaggtgggaccacatttgtgcaacctgaagaatggttggtaattttgttctttttctgactgcttggtggttggactctgttcacttattgacactgctctctgagaacaacatgaatgaaacttatgcctcttaatagtttctgttttttattgaaaacacatacatgtataagtgtatattttatagtcattataaatcttttttgtgctagcctttgtgctttgcttctgtctaatgacaatgaaaaatgtcactacagc

SEQ ID NO: 47847 - DNA, 1501 bp, Oryza sativa
gctgtgcaatttttgtgattacgtgtgctctccagttcatccaagtaaactgccaagccagcccatgtccccaacgccacaatcttacagggccggccccactggtgcttcgtttcgcatgggccaaatgcagcaccgcttgccagctcgtaattgcggcccattaacctaaatgggccgatcgagtggtggtgcagcccaaccacaaggccacgacaaaaaaaacgtcctcctcttcgagtcgtccgcttccactcacgccggctcatcctctctctctccaaatctgtggacatttcacgcgcgctctccgctccagcctccagccaccgcccaccggccggcgatgtcgacggcggcggcggccgcggcgtccacctcgctccggccggcctcccagtccgcgctccgtctcgcggtttcgctccctcaccaccttcgtcgtctctgattctgtgtaatttatcatgcgccttcgtctaaccgagtagtcttccccggttaaatcgcgcagggttcgccgcggcggtggtgctggggagccccggcgctctcccctgcgaggagagcattccacgcggacacgcggaggcggttcgtgttctctccttgggcgtttgcttctagtatggaatggagttgatggccttttgtccgaattagttttgcttcctgtggtgtatttgggggaagtcatcgcagacctgtggattacccttcatgttgcattgttgtctcctgtgggattaagtgtttcatgagattggggtatttcgttgtagattactgttctatgcttttaaattgcaatgccggtaattttgttgctacgagttattgttcagagtagattacttctataactctcgctgttccattggagttgcttatacagtgcgctctctaactgccaccagcacagttcagatgttcttcagggtgttttagtaacatgagtttctacggtcctgatgcacatttctgattcatgtgcaaatctacatctaccattcattcctaggatttcatactatttggtagctgcaatgcggcaggatctgtgatttgcctttccgaattcattgtgatggtgcaaatagacagatgaacagtctattattattcttaatttaagaacctatgtttgtattaaacaggaagactttgttatatgcaactgataaaggcccagaagaatccttgaagaagacaattgaagttgacaggttgatcgagatgctgagggatgcaaatcctagagaggtaactcttcatatcttcaatctgactgtttattctactactctccatcccataatatagcaacgtagtgctggatgcccgtatccagatccatagtactagggtacgtcccatccggtcctaggttgctatattatgggacagaggaagtattagataaggttacagtctcaggttttacaccacactaaaagatctctccattcaattgtaccaatttaaatctgttaccaaacct

SEQ ID NO: 47848 - DNA, 1501 bp, Oryza sativa
tgtgcggccgtgccccagtggattggtttgttttctgtttgttcttcgtcctgacctgacgcagcacaaacgctcactggtttgtttttttttttttaaaaaaaaatggggctgtgaggtgctcactggtggagtggcgatcggtgtcgtgctccctcaccgcgccgtattgctgggtctgcgtgcgatgcgtgtgtgagccgacgatgttgccgttcggccgaacgcgtcttgcccgttcttttgcttgctttactcgatactctcgtactagaactacaaatctatctaaacataaattttatctgattctaagttcttatattttaggatgaaatgagtatttgcttggtgctcagcttgcttggccatgctctttctaatttattcacaaaatggttatttgctcaaagttttctaaatacattttctaaaaggaaattcctacgatagtttgtttttaaggtatttattaggcgtgtttcttaaaaaaatgatgataattaagtagataattcgtgatataatccgtcagaggcatatggttgtttcgtagctagcgtagtggttcttcggatggaaagagatggccagtttgttctgtgcggtgttaggtttgccaccgacgcgtacagtgaccattagtcacagggatatactgatatgtcctcatttggcttcacaacttcacacggattttgttaatttgatttcaccagtgagcattatggcgtgtgccgagcagtatcttgcttgtaacttgtttcaaactcaggtgttccttaaaaatgaattgttggatcgtcctccaatgggtatgtgctcgacatctgtctcgaatctccctggctcaggcacatgggtatggttattttttatgcagaagcagactatcatttcttatgcagaatgcagataatgttattgtcctaatcacttctcattattttttttctatcctggattaactattagtacaagtggaagtgggaacctcgtttgttctcatttgtggaccagaagaaagtggcacaaatggaactgtataaaaccgggaagttccatataaaggctgtgtttagttcacactgaagtttgaaagtttggttgaaattggtacgatgttatagaaaagttgtgtgaatgaaaggtttgatgtaatggaaagttggaagttaaaaaaaaaactttgaaactaaacagggccaaaccctactcgattcagaatattcttggtagctatacatagagcaaaaatattatatcttcatgcactcatcatcttttactttgcgctgcaatatgaagtagtagtgacatcaaaatacctttatggcaatcaaaaagattattgatatcatatcattttattaagctactgatagtggcactatggacagatgacaggcaacttgcgttgacccggagagtagacttactccctccgtgtcaaaataaaccaatctcgtattaagatgtgacacatctcagtacatcgaat

SEQ ID NO: 47849 - DNA, 291 bp, Oryza sativa
  unsure (1)..(291): unsure at all n locations
attcctgcagccctggcgttggaagggaggcatggaataactgaattctggagcacgccaacatatgctctctcgctgcatgcatacggcgcgggcaattaactccaccccggggtcgcatgctgcatgcagngctagtanngcagtggcnacnaangnatacagtacagtacagtacattccaaccagctaactgtattcagaacgagagagagagagagagagaggggtgaggcagccggcaactgtaccctgccttttcccctcgactctctttctctctctcgcagc

SEQ ID NO: 47850 - DNA, 604 bp, Oryza sativa
atttaaaaatgagcaatcgatagaacacgaagcaatgaaacaacttaaccgatgaggattacttcgagaatgataaatattttggtgtccttgatcttaatgtcatttgcttagggtatatatgttcaaacttggatgaggagagtaatttagtaggatcatttttataaattctaaacaagtaaaaaaccaaaagctacaatgatgtttgtgaaaaaagctagaggggttaaagggattccacagcctctcgtacatagctccgccactgccctcgagggtgtggagagactccgttgttgggatgcatgaaataacgtcgtactcctcctactggtactcgatcaattcaagctgcatgcacgcctgctcgacgaaaattactctacgtgcggaatcaatgggcaaaattttagtcttggaacgaccataaatatcttcattgattttcaggttatattcggtgcagctgtattaaccccttctcacagtgcaccaatttttttaaaaaaaataaaatgtgaaatttaccattatttgtttggaaaatgcaacgctttatctatctgaaatgatgatgcatcgatatgctggagaccgaaca

SEQ ID NO: 47851 - DNA, 375 bp, Oryza sativa
agtacctcttgcccattattacattttgttattctttatttggtggccatctcaaaaatgcttaagcagagttcccatcagtgaggccataaacaaattaaagctctgattaggattacccaaccaacccaccttatctaagcacaagctttctttcaccagggccttgtctttgagtctcaccaaacctgacagtgacacaagcaattaatcctggcctctgaaatatgtcaagttgcagatgacaccaattccttttgacaagttactccttatcatcccttcttccttcctgccccctaatgataggctaaggtcctatgctcagtagattatgtattatggattaccacaccacgcttcccgaacccctaa

SEQ ID NO: 47852 - DNA, 395 bp, Oryza sativa
  unsure (1)..(395): unsure at all n locations
taatttatcattttttcaagtcaggtgggtaatgaaactgtgttttgagtgaaaatagtattttcttgtcagcgaaatgtcacagttcggtcctcttgggtattgcaaaatggagtacatatggctccagtaaggtaagtttttttggctgctnnnnnnnnnnnnnnnnnnnnnncacgaacagtttgataaagcctattacggaatacttgtttgtttcaagtactggatatttgatgttacacacttgaactgaatctgtagcatgttattgtcttcaagacatcatactgcatagtctttatatccttagcagtagggactgtcgttattatgctgagttcagatctgttcgctgttgttcgtggactgaattttggatcccctcttgcaga

SEQ ID NO: 47853 - DNA, 382 bp, Oryza sativa
cgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggtcatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaaga

SEQ ID NO: 47854 - DNA, 605 bp, Oryza sativa
cacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccaagaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaagttgcataacca

SEQ ID NO: 47855 - DNA, 526 bp, Oryza sativa
tgaaatgataactttttttattataattttcgatatgtcgggtagaaaaattggcacgggtgcacgttttgggtcaatctttgcactgtaggtagtagtcactgatcagttggtggtatctgctaatgcaacagagtggtggattcttgtttaatgctatatgaactaggaagggaaggagtgcaatcagcagtaggtttatagtttgtgatccccagatgagaaatgttgtgttctcattttcttttaggaaccaaaaggccaggtgaccccagtcccaattttcatggaattagataccaaataggtctacaacagctttgagttaagttatactctgtttgaagcctggaattaagcaaaatgcagttgacatgaacaatcggatatgcatatattcttgtgctttccaaattatgaaatggaatatattgttcttttggtgaaatttaattcatctcataaaaaaatgtctctcctcagatgcggtctggttatgggcgttcaatatttgagccagtcctac

SEQ ID NO: 47856 - DNA, 1501 bp, Oryza sativa
ggggaggaggaactcgcctgaaaaaggcggatctgggcccgcgcgcccgtctccctgcttggctgcttccctctcgttccaaaagacgagcaaagggaagagggcagaggagtactactactcctgcagtcctgcggtgcgtgagctgtgcgtgggccacggccacggacacagcagcggagcgggggacgttcccccgggatagcagccgagcgcgccgcctcgtctcatcactcggccggcccgcgcgagattggctgacgaacagtggctcgcggccgtgcaccgcatgcatgcagtggcgctctgggctggcggcatcggctgccgcgccgtcacccatcgctaggtaggcaggcaggcacgcgtagggggaaacgggtggactctggtaaagccgcacgttgcctcacgggctcacggcaagtagggtacgttaccgagtaggaggagtaccagcaaggcagggatcggcgcggcggtatcattgttggtttcgttgctcctgcatgctgtgcgagtagcctgcgactcgcgaactcgcgatttcgcgagtggtcgcccggaggggcccggtcggatactcaacgattattgaatgcacggtgagtattaaaaatctctgaaaagagtatactgttagtaaaaaaaagagagagggcatcgtgacagagctggtcagacccgtcgactgcgtcgcattgaacggcatcgtgcaaacgttgtatatgctcgcagcctgggcattaataacgtgcagaagtacaacactggtcgtgacggccaagagcatcaattcatcacacttgggtaggctgtcccgtaaaacagagagcgtcaaatgagacgcaatcaacacaagatgcttccactgtatgcttgtttcatcagtttcgcagatgaagcacacccaggtaccaacgcatgtactaagcttcactttaccaccatgtgttgatgaaaagggtcggaatcgcaccgttctgaatccatccaaagcggaactgtgctaagaacagatgacggcactgtgcttccttttctttccacgaggcgctggcggtggcattggcatcctggtgggggaacagtgacccccaaagttgcagctgccagcactacggccgccccacagtagccagtaaacgcgctgcagctgcagcacgcccccgcaccgcgccaagggctaaaaccgaagtgaaaaaggaaaccgcgaccaacccgtcgcctcttcacccgcaccgcaccgttgcagcccgcccactcgctgactcgctccagccagcagcagcagcagcagccactgctcgcgacggaacagacgacaccaccacgacgcccgcgtcataaaggcatgggcattgtcgcaggctagccacagcgacggggtagcagcagcatcagcagcagcagcggcaacagcgaccggcattgatagcggcagctgaggaaggaagagggcgcgcggtcgccgcaggagcggagcagggggggcatgggc

SEQ ID NO: 47857 - DNA, 1501 bp, Oryza sativa
ggaaccacgaggccagagagatggacggcgacacgatgatggggtgcagcatggcgcgcgcgaacggcgagagcccctgccccgcgcccccgggcgcggagacgaggagacgcgagaccgcggtgagcccgtaggcgtcctccgcacccgcggccgcgtcgaagatgccaccgtgcgcgagcagccgcatgaggcggcgcaggaagggcttcctggagcgcggcagcgcgagctccgcgacgagctcgggaaccgtaacggcgccgccacggcggtggacggcgtcagggatgccgagctcgacggcgcagcggagggacatggacttggtgtacgcgaagatatggttccacagctcagcttgggcccggaggagctcgtcggcggcgaggtcggagttgcggctggcgtccattgctcagctgctcagtgtttggcccgagtgattaattagcttttggttccgtagtcaaacatgacaactttaggatactacgaaattatgaagaatcctatattcttgcctccttcaagttgttgggttttgtcttcattgtgaaatcgcatttcgcatgcatttacaaggagaaggtgctgccgaaatccataatgcttaacatgcaagtgctgataaaaaaatgttactagtagattagctctgagtgatcaagtcagaagtcaaaaagtagttacttaagttgtttttctttactaacatatcgtgcatgtataagtcgcagttaaaatttaaattttaaaacctaaacttcaagttgatttaaatgttttttttcatcatattttacttctagcctaaacttttaagttgctcaaaatcagtttgagtaaattttattttggttcaacttttattactgatgtttcattttgaatcatcgtatgagaaatctttttttaaaaaaactcgtatattaacttgagataattggactcctaattacagctcgtgattttctaacaaagtatatatccaaacaaatttaacacggtgaatttcacattaactaaattatatcaataataagattaaaatagtcttcacccgttacaacgcatgtgcattttttatagtttaagaaaataacatagccttacggtccagtaaaccttctttgggtaaaagtacattgggggacataagggtttaatctttcggttgggctatttgtatctgcggtggccgaaatattaaaattgtatgaattttttaatacaatttgatcaaatttaaaaaaaaaaccaaattcacgaaaaaataaaaaaaatgcggccgaaataatatggtatcggctggggcggtccgataggaccaacttcggaaatttcgttcggcaattttaaacccgtagtgttagagatccaaacaaccacaaaattaaattactggagtagtagagtgctagtagaccagaagaggggagtcaaactcaaaagtgtatcaaggataagcagccgaggaaaaggtatttgacggaagcct

SEQ ID NO: 47858 - DNA, 609 bp, Oryza sativa
ttcatgcccgttagctgtatctcttcatagtatcaagatgcatgtgtagtcgaaattctgcagcttaaatagcctaatagtacccatattagccattcatgattcatgtaccaattttactctgaaaaattgcagctgaattgaaatggagctacacaaaagggaaaaatatagcctaatagtacccatattagccattatgctaaacttttggagtctcttgtactcatttccagttattctttctttctcgctgaaggatttcagcaggtttgctgtagcttggacggccgatccttttcccatggccattagcgtatgattgtttttctatcgagatgacatcatctccggtcatgattctgacttctgttacatttaatcaccaacaaagagtatactatttcaaattgaatcatgatcctataaaaaaaatagaaaaatgatgtcatccggaagcaaacaagcgaagtcacgagcagaacacggacaaaacaaaaggcacagcacacccaaacttccaaactgagttgccatgtcgcgttcaatccacacaccacaactacgggagacatgacgtaaacacaatatatactggagataatctag

SEQ ID NO: 47859 - DNA, 495 bp, Oryza sativa
ggcacattcaactttaaatatccttcatgcatgtaagagcaattgtaaagtctatccgtgatttgtattctctccattacgttgccgtttctttccattaatattcttcttaaattatttgtgacatttaaacatgtatttacttcacctcaagcacaccgtatgaactcaagctagttgttagattctatattttgccttctattctcagttatcttcacaaccatgcatgcatccctgagaatagattgtttgtattggccagcttcggttgatttccttttgtctccgaccatttttactgtagatgagtgaggtccatgctgtggccagccagcctaagtttccccgttagggcttgttcggttgggccgttcccggctgggatcggggtctaatccccgtggaaaatcccggcgtggaaaggataccagcccatgcaagtataggcgttcggttaagtccaggcgagattttatcccggcccaccccagt

SEQ ID NO: 47860 - DNA, 1501 bp, Oryza sativa
atgctttgctataagcatccctaaacaaaaatgacagagtgtaagtacttacagaagcattattctttaatgcttttgggccaggaaatgtctttccacacccatggctctttggtagaagacgatcctcaacttcttctccactaatacctcttgcaatcttccataaccacgtcctgcgtgagattaaacggttataagctgagttattattaactagacatgacatccgaaagttgtaaaatctgcatgaagtatgcttccttgtaatgcataaaactagccttctatcagctctaaagttaagtcatgtactaaagataaaatcagtagggcaaccaaacaacagtagagcaaaaaaataaatgcaagcaccaggttaccctgtatttactccatagtactcttgtaatttgtcctctgtaaaacttagaagatcaccaacagtattgaccccaaggtcatcctgcaaggaactcccaagcttaccaccaagttgcttcctgcataatttaagcaaacaacacaaccatgagaccagataaataggatgtttgaaaaactttgtccaacagaaaccaagaaactagcaaagatggaggtgtcacattagctcattacatcttctttatgggcagtgatactagaaaatcttgaactgctgatgatggaacaactgtctgctgagcaggtttgtgcatcccactgacaagttttgctaacatctacaaaacacagcaacatcttgggtgaggattgcaataggaagagaggtttacagagtaaaagagaccaaacttcaatcgaaagaaaggaatgcatataaaccttattgtgagcaataccagcagaacatgtgaattgggtttcctccaaaaccttgacccgtaattgcgcaacaattatagccccacaagatagtaacttatcctggtaatcagcatcggctcgacaaagccatgccctcacgctatcttctctgttgctgacatcctgcacatatgaagccctattggtcacattcatatcaaattgcagagaaacaacaattaaatcgtggagaacaaatattacagaaggaaggcccaggatatttgactttgtggcctcctcaaaaatcaactccaataactccggtggagattctaaaagcatttccttggctgcatcagtaaggtcaagataaacttcgtcgatggatgctcgctcacacttccccttggtcgagaggattgtgacaacctgagagtttagacgcaaaactgtcaatgccatggaagcaccttcattttccattgtcaattgtaccaattaagatgcacagaccaacctcagagccagcactacggtaaacattaagatcggccttgtcacgggccaccggaacctgaaccaaattgatacttggacagaccatcttggcctcatcaccacgcatggacctgaataaccacaacaatgagcatacaatcgatccgtcagaaaacccagccgatcaaat

SEQ ID NO: 47861 - DNA, 1501 bp, Oryza sativa
gtatattataagggagcagctaattcttgacagtcaacacgacactagaaatatgtagttttcatgcaggagatatttacagtgtatatgcacaagtccagtctgagatttttactgcaattacatgagaggaacacattggacacaataatgaaaccaatgcaacaagacctgaattatccgtttccattccttttcatcttcaagggtcttaagtgccttctttactgctatcaagggaaactccaattcccatgcaacaaatgaatcaagagcaccatatacttcctcctttacattagacaagcctttaacctacaggaaaggacaaaagaacaataatttcaggtactcgaggcatgaataacaccaggtagtctgaatctgttgcagcaaaatccgtcatgcaaaaatgtgaaatgaaacacttgcagtcttttgatgtttggcgcctgctttatcagagagaatacataagctgcttaatgaaaaagaggacaaccacaactatcgcaaactgaagagctgcagcagcgggtgaattctagagtagctattggtaagcaggtgtacgataaaccatataatttagcacctcaccaggaagatgttggatgcaaaagcggatacaaactgcaactgaaattacagcacaggaaagcagaagaacctcacacattcgacaagcttttgagacttggaaacggttccgattctcttgcgagttttccacacacgaggatatcttggcctcgggcccctggcaccacatacctacatcacaatcgtaatcaaaaccatcagtttaactgcagctccagcactatcgcaagaaccacatgcagtacagctgaactgaacttaccactaaagtactgaactttgaaggatgcgtaatggcagccctttccaatccaaaggcgaatgcaggcggcccgcacctcacagaaaacatcgtgtaacctgccgtgacaaacaatcggataaaccttccgcagcagacagtgctggtccgtatacgaaacaggaaaagggatagcgagcaagaactgcgcaaagaattgggaagaaaaagttctagctgtcctctcctcttccccttctcgctcgccccacctgaataggggaatcgaagggacgggagcacatctcaccttgtaagaggggaggagcagttgccgccgtcgctggcctcggtgaatccgtgcgccgcggcggcttcgttctccgcggggcgtagagtccgggaacgggaggagggacgcagccgcacgaccgcaacgcaatctctccgccccactgggcaagataatttcagcgttggatgaaaggtgaggcccactgtcagtggctcaggcctgtaagagtaagatatcagtatcgttttctgtcaaataaagaggaaaagaaaaaaaaaaggaaaaagggaatagggaagcgagggcggagtactgcgctcttctcctttgcctgaggcggctggggtgagggcagctagcga

SEQ ID NO: 47862 - DNA, 377 bp, Oryza sativa
tgtatgtcaaggaaaacccgagatcctagtcggttacgattatattttatctgtaattccatgttcttttaggatatggactgtattttgtaaagcggaccccttcccctatataaggaggggtccggatgcttatcggggcacggttttttgacctagattatacaatcaataatacactcggcggaatcatccccggacaggagtagggtatacttcttgaataagaaggcctgaacctgtataaaattcttcgtctccaaacccatccactttcctagcttgatagccacccccttttagtattgccgaaatcttgtttcgacagttggcgcgccaggtaggggtagcgtcaagtttttaccggctaagtgcga

SEQ ID NO: 47863 - DNA, 168 bp, Oryza sativa
aatatgtgatgatttggatatgggaggggatggtgtgaaatcaatattcaatattaaaagcagaaaaaaaaagaaaaaatgttaccaaccgggactaaagattaatttttagtcccggttatttgaaccgggactaaagatagcgatctttagtcccggattcgtagt

SEQ ID NO: 47864 - DNA, 176 bp, Oryza sativa
ttggtccaacaaattatatcgtggtcgacttcaaggatcttttcgacctctacaggctctgagtggtggacacaagcctccttaagtgctactccttgtaagtattgtcgcccaactcattctggtaataacaatcggtttaacttgcttacaagatcgttgatcctgtgtgtagg

SEQ ID NO: 47865 - DNA, 279 bp, Oryza sativa
ctcacgaggttgttcccgaagttcgaatccttgaggggattctactctccgttgaggagctcactaagagtcgggtcttagctaaccctttcctcaagaggttgcactaagcactcctccttccactaagggtatctcttcccttttggaggtgagatccgaccttcacaaacttctcccggccaaccataagtagatcggtggctcgggagcgacacctagccgcctaggagtcctcaacctccaagagtaacaaatgaagcaaagaactcccggaga

SEQ ID NO: 47866 - DNA, 1501 bp, Oryza sativa
tagttttgcattattcatctctaatatttgaccgttcgttttatttgaaaaatttttatgattactatttttattactattagatgataaaatatgaatagtactttatgtgtgactaattttttaaaattttttcataaattttacaaataagacggatggtcaaacgttggacacggatttccacggctgcacttattttgggacggagttagtactaaccacctcggcaataaactccttcattccctgcctctatagagatgaagcccaagcccttcaaggagtgcttcatcactgctatcaattttcactgcaaattcctcgtgcttgctgctacccctacatacagaaaaacacacacacacacacacaaacacctgacctgcttattcccttcatccgtgccagccgactgctatggcggcatgttattcttttgttgtatgttttcttcttcacatgcacttctataaacatatcattggagtatgagactcatcattgtgccacaatagcgtatcatataatcatgtgattgttcaagatgttattcaaattcgttcaagcttctcctgagcggcacaagaaactcaggataggagctttacccttaccgtactgatgatgattgctcaaaaaatcagacatacagggtgtgtttagttcgcgtcaaaattgaaaatttgattgaaattggaatgatgtgatggaaaagttgaaagtttgtgtgtgtaggaaagttttgatgtgataaaaaagttgaaagtttgaagaaaaagttaagaactaaaccaggcctgtatatggttctcccttgtgtcagttagtagttcttgccaacacaagtgcacatttgcgtgtggcagtttcatggcagagcgtatatgcgaatgcgatccacggttttgggtaatattatctagcttttaataagaggatggatgtgctgcttcattacatattctatttttattcatctatcaacaaggctgtgatcacacactttctattttgataccattgtacaaaatgaaaaagggtaggtaggtggcttctattatttgcgagttgttgaccttggccattatatttcttagctgttttatgttgcagtgaattaggattcagggtcaaatcgtatatatggaacaccattcttgcggtattcctatatcctatatataaatagtttaagtttcactgccggcctttttttcttttcagcaaagttagcttcagtcaactctgttctgaattggtttgttaagtactagatggaccttatggatcattgaattccacggaaatacactgaaactgatgagacgtgagactaaatcaccgactagtcgactacttttcgttcggccattaattgaaggccatatttattcgggttaattagattcgtaacattaaaaattgtcggtttggaaatatatcattactatttatgtatttgtaccgatgccattgatgctggtttgtaatctcagtg

SEQ ID NO: 47867 - DNA, 315 bp, Oryza sativa
catagttaccaaaattttgacaacttgccaaaattttggcagaatttcttatatagttaccaaaatttggcagcaaactaaatgtagccacttttttgataacttcaccaaaaatttggtaaggttaaaaatggcatcaaagtgaacaggcccgtagccactttttttgcaactttaccaaaatttggtaaggttgaaaatggcatcaaagtgaacaggcccaatgtctcaatccgcaagtcacgggttcaaatcacttcccacacatgctttctcttatattttgcataaaatataaatggcccgtggtgtagg

SEQ ID NO: 47868 - DNA, 1501 bp, Oryza sativa
tctctgaatctgtagtttcattcgttgtaattaattcacctctcttcagatcgatcggtaaactgatctagacacctactactgcatctgcagatgattgttcagcagctgctactggttcagaggaatcctaaaactgaaaaccagtcgcagtctctgcacgctgctggttgcagtaacctcctccaaagccactgccccttgaatcacttggcagtagcaacggtttcttggcaacgtgcactgctgccatcatcaatgaatgttttaatttttcccagttgaaatgatgaatagatgctctattcttatttctatctagtgctttactgcctaaccttcactatagtttttgagtttgttggcaaaaaaaatctttgccttgaatttgaaacttgtggattgcataaagcatgatctaaatctagattgttgttggatatgaatttgtgaaatagagttgctatggtctttctctaagtgatactggaattccggagcatatgtttttttaaaaaagaataaaatttataagttcctcaataatatgatgatcttaattgaataaccctataatcatatgttgcttctttttatgctgtcttgaccaagatacccacttacgtgcacccaccatatactggagattaacaaaatatgccttccacctatcatggttgttttacctctaccctaggtgtgagcaacatttccatccaccaaataaatattccatcatgtccttaaaatgtctctcatattagtagcttgcaataaaatatggctaaaaaaagaaagaaagaaaggacatggaaggtagaaaatattctcaatcattaagagaagaaagaaaatgagaaatacaggaaaaggagtgctcattaatatttttgggcaatcataaaaaatagttggagaaaaaccagtcatatctcaagatattatctgatatgactgaaagttaggaataaagcttagaagtgtcgacgggggatacccatagaccggatatagagagtattgggatccgttggtacgaggatctatgtagtacgacatcaagcaaacaaaagataaggattatactggttcaggtcccttagcaggtaatagccctaatccagttggtatgggattatatgatggaaaccacagattacaaagggaataacagaactcggtgataccgacgagaacgcagtcgagttggcacgactagatctcccggcctggcgacttggctcctgtaggctccagctccgtaggctgtggggatgtgttggcagtaatattcgatgccttaggtcctgcctagggggtcccttatataccgcgggtcagttgatctccaagtaggactcggagatatcggacccctcacgatatagtaaagacccagtattgtccgagtagaactctttccgtccatagattctatttctatcacgggttagatttcctttatgtatacggaaactatccgtacacgcgcgggtatacc

SEQ ID NO: 47869 - DNA, 1501 bp, Oryza sativa
acaagtccaactcatatggcataattcccccgaaaactttgttttgtgaattgtctatagaaaatattgcaaaacaaattaacttttgcattctgaaatatagttttataaagaaaattgctccaaaaaagaaaggaagtgtttgtttcaaacaatgtaattgaaaaattgtctcccaaaaccgctttgaaattatattaaaattataggaatggtcaaaattagttgcaaaagaaaattttcttgaaaaacatctgtgaattttggttccaaataatttattgcaaaatcatgcaaaaccaaattttgagtgcatgacttcaaaatcatcttttcaaaaggttttcaaagctaaacttctggaactattgcctaaagttttgcttgaaaaggaaattattatgaaagctttacaaaagcttcgtgaaaactgttttccaagcgattatttccatatgaaaatgtggcaatttctaaaaaggttctaattttttttgagttttcttttgggatgttcaaaagtattgttgtctcaactatgaaccatgcatacaaactatataacattttggccctgttggcaaaaaaaagaatattttggactaagagttgattacataataattataatgtattgtgttatgtcatatttggattttgtactagttgttcgtacatgtgaaacaaatcattatattataaatgtcaatagaactcttactaagacaagggtgttataaagtagtttaaggccctcttttttttccaattccatattttggacttacgtttgtacgctttccaagtttctaaatggtgtcttttttaaacaatgttttaacttcttagaagtcaaatcattcgtttataccctcaaatagctatcacataaatcagataattcatcaatttcatatcctaaaccgtaagatgtagtacacatatttttttcatgcgagtcatggtgatcaacaaataatcaaaatcgtaagatgtatatgtaagagctactatgaacaattgtaaataggtgtcaaaattaattgctattaattagatatctagtggcttgccagccacataattaatttctctctacatgtatataaacaaggacgaagcaggaacaaatattaccatattctcatatatattacgcggtcaatattctaattacatgtgttaagtcctttaaaattccttaaaatgctctcaaggtgtcacatagttctataataaattagagcaagtattagaaattttaagaaaaaagcaaagtatctatttcttgattttcacttaaaacggtaagtctaatattataaaccgttagattaaattgatctcagaacaaactaaatactacgaggtcccacctctcctcccgcggcataggtatgcacctacatatgtcggtatgtaagcttcccctccctttttttattttgatctctttcttctttttttgcatgcatacgcttcccttcttttcttactatat

SEQ ID NO: 47870 - DNA, 327 bp, Oryza sativa
atgaaactagtttgatattttagatggtgctaaatttttccataaaattagtcaaacttgattagaaaaaagtcaaacgacttgtaatatgaaacagaggaggtattctttgagagatctccaaggactgaactcattggagggtaggtagacggaagacgaaaatatataccaatagttttattatagtatctgcgtaaataagttattccgtagcagctgattttaaggagaatgacatgaacccctaatatttaaacattatagtgttgcgcctctatggctatatgcctcccaaaactttgaaatcatcatacggtatagtga

SEQ ID NO: 47871 - DNA, 438 bp, Oryza sativa
ccgtggctggattgcaggattggtggcgccgtaaaacacggacaaatcgaaggccccggcgtcgacgacgagagtggcttggacgacaaagcggatggatcaaagtcgtagagagggtgaactcgtatatgagttacgacgatgtgtggccggctgccggcatgcgcgatcgagcgctcatcgctagagttagggttttcttttgattgtcaaggttttcttttgattgttctcactctattcgtggcttggctgcaccagggaggtggacgttggttccaacagcgtccaagtatggacgttgtttacaacggcgtccaattctggatgctttctgtattagcgtccatcctactcctgtaaatccccccaacgatttactaattatttaatttaagggtaattgtttattataaataaaaaattcggaactcagga

SEQ ID NO: 47872 - DNA, 567 bp, Oryza sativa
cacaccatgaatatatacgtcatccctgtttttccgtgcaccaagcaagttaataaaatgtgttgagctagctctgatgtattgtattgtgtctaattagttatgtagtaactagttgctggtccatatctatttgtttttttcccattgcttactagccccaacatttggtgcttgatggacattcaagatagctcttgaattaggattcctggctccttggtttatatttttctccaaatcctctgaataatgtgctgaaatctatcacttgatcctcccagaaagtggcctgctaggtacttgatacttctcaccatccttggattcctacttgaagagtactattgatttgctgcctttaactacttagatagtgccttgaacgaatcatttatcattgtgacattgtagccctggcataactctgtggcactctgctcagtttacatgcattacatgttcattgattgcatacaatgccattctgtagtaacagtgtgtttaattctcctagattatgagagctaactgaatttaatttgatctgcagattgtgtgcgccaa

SEQ ID NO: 47873 - DNA, 1501 bp, Oryza sativa; identical to SEQ ID NO: 38473

SEQ ID NO: 47874 - DNA, 1501 bp, Oryza sativa
atatatttatttgacatctactctactgtacaatatcaattttatttattagcacatttttaagttgaccataatctaatcatttgatattaatatattttattaaatagtgagttatataccattggaaagcttatgaatttagatgaatttaggttcaagtttcactcgaatcggagctaaaatgaataatttatactaatttaaagattcaaatttgagttaatccgagaaattgtaaaaatgcactgttcataaatgatttatttttaatcggaaacattatccaaaacccaccgtggttgacatgtgggaccggccctggttgacttatggtcaaacctgcttgtttaattaccattgggtcccgcctgtcataggaacaaaatatataattgtgttttcttagattttaactatagggaccccacctgccattgagtgggataatcaccgttagggataggattactgtgcgctaatcacatgtgggtcccacacggtttctctctctcctcatcttcttcttcctctcgcccgttaccgagcgaggcagaggcgcggctcggcgcagccggcgttgccggcccgagccgggacggcggcgggcggctcggcgacggccagggtgaggcgcggaggagctccggtgatctcccgccgatggcagccggcgcgcgaggagacgggggcgcgcggcgccatcaggcgacgccatgcccgagctcggctacaaggggcttcggtgctagggacatccttcggccgaattgaagggtgcgggagcatctacgaggtatggggattcgatttcacgaactatatggagaggggagctcccgggatagcctacccacggagagctcgccggcgatgaaacggcggctggggcggcacggccatgggcgctaatcgtcgattttgaagccggcgctagcaattagatgtatggaggacgctacgggcgcgagggtgtaccgcgagatggcgagatggcgaaacgcagcgaagtggagctcgacgcggtgcaggacaggggcaaacggcagcgacgtaaggtgctcgacggcgtttcttgatgtccagcggctaccccgcttcccccatggcgacgcggcaagcacggttctttcctccacttcctctaaccttctgctccggccggggagcctcacaatggtgatctctagcggtggtgagagggtgatcgcaaggtgttcgatgaaatgcatacgagaagaaggctgagagggatggggattttgttgagggcttcgcttaggatgcaagcaaactatggggataagatcaccagcacatgcctaggcgagctagagtactaatggtgatcggataagagcaatgaggtggatgacgcggctgagattcatctccttctccattaaggttctgtggcttaatcatcacacctataacctatagactgcaggtctgggcgctagctggaggagagggctccgttttatccattgggcgtgga

SEQ ID NO: 47875 - DNA, 884 bp, Oryza sativa
caacactaatataagagtcaagtatttcctattgtgatcagcaaaagcaaaaatcctaatctgatgatttttaatgaattcatataacataggcatgttcaactagaaattagaacgattaatactagtactatcttaaggttggtaattatttataaaagtaacacaacaagaagtgtgccagtaagtgccgaacatgcaagagtattatggatttcattaacaaaaaatatgaacctaacacatgtaagggaatatatcaaacaaaagcagaaataaaatgaagagacaactgaaacagaggaaacagatttatgcagaagatatttagatataaactgcaaaaaaaaagaacaggaaatgaagggcataaaaatgaaagcttcaatttatataaaattgaagatgctgacagaaaaaagtttactcaactccaaaaactagaacaaaatatgaagtccaacgattttctgatttattctttacagtgtacaatgtaccaattttttgtcctgttttattttcatgttctgttcccttctcatatttttgttaccatctgctacatggcttgtgatgctgggatatttaaccaattaacccaaacgaatcaagaaaaccagtagagatttggaaaactcatcgaactatgtaagaagaaaaataaaagccaataaggaaaactgagaaacaaatcttggtgggtggtaaaatttactgaaccacatatatagctcgacaaccaaattaattagcatcagatattgagtggaacagaagtaaaccactacggaattctgatgaacatccaagaaacaggaaatcctcccaatttgaccaccaacaaccaaacctcaactcctcaactacctgtctacctcagg

SEQ ID NO: 47876 - DNA, 1501 bp, Oryza sativa
gcaaaaggactgaaaccatattaaaacaaaactaagttcttatcgtttctaggttcaaagaaatgtttctacagttggttgtattttttttatttttattatctgtttgtgggtctataaaaaatattattttttcatggcaaaattcgttgcatgtaatcaccgacataggagagtgtaaaaaatatttcatagtaattaaaactagcagtatcattgctacatttgctttttaattcaaacattagttcgagaactaaaggtcaccgccaccggttattgtttttttttttctgatcagtatttataagaaaaagttctctgtgtgacctttgtccggagaggatccaaaaggtgaacatgatttgaatagtgttatgttttaacggcatgcgactaattgatgtatgtaacacgagaaaataacagaaggattaatgcgttgtttattatgtgcataatcgagttattatactagaaatgtagcatctttcccttatctctcgctctaacaaaattaggtcatgaagactatggctgcgttcgttccagatacattgagttagaaagtacatcgtttttcacacgcacgcttcccaaactactcaacggtgtattttttgtaaaatttttctataggaaagttgttttaaaaaatcatattaatccatttttgaagtttataatagtttatactcaatcaatcatgcgctaatggcttacctcgttttgcatatctttccaatcttctcaatctcctatcctggccctcaaacacaccctatgttgataccgtgaaatagagcgtaggctctcgtataagcgaattaacacttattgtcatcgcgacatagttatacagggaaaggaagaaagcatatattatcattggatttttgtcttcgcccattgtaacgcacggacatttttagtagaaaaaaatcttaaggttttaattgctatataataattctataaaaatactttaaactgaaaggatcacgacttgcatcaattcacaaagggcagaaagttcattaatttgtctgcagcccaaactaaagcccattagaaggcccacaaatctgcagtagcccacgtaagtacaaggtggtcatcactacagttgcaacttacaagcatcagtgcatcaaattctgaaattcatatcactctcttctttagttcttttaattaaggggtcgttcttttgacctaaccgatgacggattattgtgggctgcttccttaatttctaaacgtcacgatttttgtaaaaaaaaaaaggttacttttagaaactttttaaatcaacatttgaacgtgtttacctctttcgattcatcattcatccttatcaaataggagtacttgtcataaattcacttttatccattatatatatgtcagggttatggataccacatacctaatgatagttgactacatctcggcaggacccaccacataccatgtctcatacggaaactgacttcggata

SEQ ID NO: 47877 - DNA, 1501 bp, Oryza sativa
tgcatcaagaaacgacactgtttgagtattaagagttaggtggatttcgggtgatatatagtaaaccttgtggtcgaaggagctagctgttcttggcctggacgatattaaaagcttggaattccaaacagtgatgtatagatgcatcttgttgtcaataaaagcaggtgagagatgagatccccttgtccataacgaagcttttactggaaaaacattccactttcggaaattctctagtgtgtaatccgcttcccttttctggttcccgccttccttgctgtagtcgcgtcttatccttggccttgtaatgctgtaagcgtggcagcgaaggcgtattagcagaagcacgtgttattattccaaggaccagcagcaatcgaccagagtaaacgtaaaggcatccacggtttagtgaaaaagtagtccataagcaatacaatattccattcagccacatagcaacattgtggaactagtcatagcaaagaaataacaaaagttacccataaacatatgaactgtccatagagaattaaatatgttacttgtctctacttcctctctcctcctaatactatttgctatctatatacattgtggatgtttacaatagttaaaactcatatacgtgggtcccatctatatggactacttttgttatatacattgttgtttccctaagaatcaaacaagcattaggttattattcttgagatgacaccaagagagatactactacaagttagtgcacctaaaacgagaaagccactagcgcatgattaattaagttttaattattacaaactcaacaaatagatatatttgatattttaaagtaacttttatatagaaaattttcgcacgaaacataccgtttagtactagtttgaaagcatactaatggaaatcgagataaaatctaaatcttatgcagaaaagaagagggatggacctgtatgataatttggtcaataatccatctcaaatggggcggcctatatgaactggttttctggccgaatacgcttttgatgcaatctggtagagaactcttgattgatcaattccattatgaggaaaaaaaaagagcagctttgatttgactaaattccggtaataactcactctatgctccattcaaaactggaaccagggcggccacaagaggaatgaataccttctccattgcatgctgacaaatgacagtgcatgtttgctttttaaatttttttgcaggaactgacgaactgtgaaacactggagatcttcagggcaaaaggaaaagtctattctcagttgcccagcatatccatgccaaagaggcaaagaacacaccattctggcgcacgcaaatttgtttcaacactcgttgcactgtacatattacattctaaagtgatgaggtatatattgtcgacgtttgatgtctcgactacggtatttggatagtatggggatcgctggtgttaggatatacgtgagactgaggtaaaagaga

SEQ ID NO: 47878 - DNA, 1501 bp, Oryza sativa
accgttacccgagccaagccgaaacaagcgagtgccggccccaatccccacccttatcccctggcccacacccggcctcgtctctctctcacatacacctctccaccggcatcctcccttcctctcctcctctggatacgcttcctccttttcctctagagccggctgtagcggtggaggaggctcgccggcccctctctttcccgatggccctccctcctctccgtccaccctcccctcttctcctccagatccggtgatggaggcagtggtagagaaggccggtgtgggcgaggtggcggtcggtggatatgctccatcagctgtttttttttattattttattgaatgctataggtactagttgtgggttaagaactggcacctataatctctacaggtgttggttctgaaaccatcacctattccctagagcatagatgccgataaaatggtaccggctgggaaaccacctattgccgattcccaaccggcacttattgggatttgtgtaatagtgactgcatgccaatggtgttgtgaattatgggctactttggaatgcatggttcttaaaatgtaggaaaaagatatactatctccgtttcacaatgtaagactttctagcattatccacatttatatagatgttaatgaatccagacacatataaatgtgtctggattcattaatatctatataaatgtgggtattgttagaaagtcttacattgtgaaacggaggaaatagaattaaagtgctctaacatctcaaatcttatggactgaaaaaacacaagaatagctgtttggatagagcacaggaaaaacacaagaacaaaaaaaatagatagacacaaatattttttttccaaaagttaacatatattagagttcctatcaaatcctatgtttcggaccaatccaaaggatttttgatagatattcctatgatccaactgagcacgtatgaaaactttttatagggttgaactccacgattattttgcaatgattggtgtacgagccagcgaagcgttcacagtattgttaattgtgcatgttgttagttgtgagtgaccgatggccctacagtacgttagttttaggaaaagctgaagcagagatgaagccatctgttgctctgctttgcccatctgaccaaactaacaacataatcaaatcgatctcattgtgaatgctgtattggactatagttgtcattgtgtttggtgatggccattgtggagattatgggtaccccatacccacacggcatggttatccgactagttataggggataacttatatatatggaatatgtaacagatcatgacttgggtattacgtttccttgtatatcacggaacggcctaaagtcctggtttgataagattgtaaagtagatttaggaaaccgataccgtattggataaggattctatcttgtaatcctgccccccctcctatataaggtgggcaggaggccctctagggggca

SEQ ID NO: 47879 - DNA, 159 bp, Oryza sativa
aaagtgaaagtaagcaagcacacatatataccaccagcagctaattaactgatcaataattaattagattcatgcaactgaagcgttttcaatatgcatctgggcaactaattaactagctaaatattaatcctgtgtgttttcttttgcaattacaga

SEQ ID NO: 47880 - DNA, 233 bp, Oryza sativa
tattgctgttacctttttcaggatattacggctccgagatgtgccctctactgtcctgaaagctatgccatgttcgtgcaatgtatttgttgtgtccaggcacagattgactattaagtttgcaaatcaggctcgaacaagcagtatgttttgcccatattctctactatttcttttgggaaatgcaatggtgaggcactcattttgccttaaacctttctattttttgcaga

SEQ ID NO: 47881 - DNA, 281 bp, Oryza sativa
attatattatagttatttctagaagttttttcactttagatactcccataggcaaaatagtacataagacaacataaaacaatacatctaacatttgtaatgatttctttaaaattttagagcaaatgtgcatgttgaatgttcaatacctagttaaaatgaattagttataaatcttagaaattttaaccattgtaatcatttgtagaagttataaactgatatatgacgcattataacaagattactatgtcagtagtggggaacctggcgtcaacagg

SEQ ID NO: 47882 - DNA, 1501 bp, Oryza sativa
tgaccccaaaatgtacccccactggacagttaaacaactgaccattgtataatatgtttgttgggttctgtagccagctctcaacatgattaagtgtcatgcgcatggacttacaaattttgtaagttcttcccttagctatatcatttaacccttctctagcctccaaccaacaagctccatatatatattttgagtagatgttgttgtcattgtagcagcaggaatgatcaagtagttgcagtttactgtaattaggccatataacattccctctataactttttcctcaccacccacataatggaactgttccaagttaaatattgccaccaatgtatccttatgagctcgatcagatttttcatgatttaaatctcctttaggtgcacaatatagtgcaacagaaggtgtttggtctcttatgcaatttgcactgcaaaaatcatatcccatcaaatgtgcaaaaactggtgcaggctatgggacttgctcagttcacatcacgcctccgctatattgacttggttgtgggtcaggccacggtttcagctctacttccgtcaaccatgtgtttaccagcagccaaagtattatggttccaatttgagttggtggtggccatggtggcatgaaataaaatattatccccaaataattgcccgcagcccaaggcaataccactccttccatcttctaaccactctacctgagcaaggaggtggccatgggtttctcttgggatgactcatcaacagcttcttgtagcccttggagcatttggtcgaacacctgttgagcgccacccattttaggcagaaattggagttaagcttttgtgccatgactagtgtggcctttcccgaggatgctattccttctggcgcgccaagcaatagtgagtacgcaaccccagcctggatagtaccggtgttgacgttggggcccaacatcaaatggcttgggtgcatcaccttgggaaggtgagtggtgtcagtgcaggttgctttctcgtcaaccatcaactccatggactgacttgatatcggaacgaccttgaacacacccatcctactttggaacacaatcacacctctatcagtgacaccgttgacatcggggccaaacaacaaacacttggtgtgcgtctccttggaacaaacacgggggtcaatgttggtggtgccggttgcaccatcggtggctaccaactccttggagtccatggcagtgttggagcatgtaaccaccgcagccacggtgaaatcaggctcgacgtcgaggcttgagcatattgtcaaacacatgataggcgtcaactcggaaaggtccttgctaatgatgaagggcatgcgatccttcccctcaccatccccaagctccaggatgatcgtcggagtagccccctcgtcgtcgtagatggatctcgctgttgtgctcgggctgctgccattggggcactccattgaacaggtggtgggcgtcaccttggactgctcat

SEQ ID NO: 47883 - DNA, 345 bp, Oryza sativa
actcataaattgaattattatactgcaagttaattattttgctatagttcaacttacaaatataaacatttcatatgaaaaatgagaaaatactcatcgatgacgggctttagttaatgcccgatagagattaagtcatgtagaagttgaatttaaacttgcatatttgtgaagtgttatatcgcatattaatacaccttctcaattatttttaatttttttataaccattttagtgacatgcaaacaacaaaaagatatctcctcgagagattaaaataatttccccgtcacggctacgaggcacttggaggcaccgcgctggacgccggagacgagccgttgg

SEQ ID NO: 47884 - DNA, 751 bp, Oryza sativa
acttgtgagaccccttgatttttgcaaacggagcataactagcggcgtctttgcatgcgtccccttaagtggcccgtacggaaaaatcgattttcccatacgggtcttttaagaggaccgcatgtaaaaatgacacttaagcgcccgtatggaaaaattatttttttttatactggccacttaagaagccgtatgcaaaaataaaatttcaaaaatttaaaactatgaactccaaattagatgattcttttttctaaatatttctaaaatcatgctctatcatgttattgtgttcttgctgctattattttggttattttttcttgtgactttgttttatcaattaaaattttaaatttcaaaactttaaataatattttgaaccagtaattgatttcaactgaaaaagtcatcaccaacaaagttgtataactcatcaagatctataacttctattttagtcatttcttcatccgacaaggttatttataagattgttaataaaatgtacatctctcttgtagttttataaactttataagagatatgtgcatttttgtgaacaattttataaatcactttatcggatgaagaaatgaccaaaataaaagttatagatcttgatgagttctacaactttgttattgatgactttttcagatgaaatcatttagtatttgaaaatgttgtttgaagttgtcataatttgaaattcaaattcaaactgttcaaacaaagtcatatagaaaaa

SEQ ID NO: 47885 - DNA, 1501 bp, Oryza sativa
actagatgcacctaataggtgtagccctcgactatgcagttaagtgaacaaaccaagcatatagtcaataaataaataatccaaccaaccgagtggcttcgataattatagttaaccaagcgacttgatattaatatgtagcatatgcggtgtaaatccctgaataacatgatccgagtgatataccgactgctttgtaaaatatgatgagtgtaacctaaagttggctacatcattgaaaattcacatagcaaaacagctataaaaaagcttgtatgttgtgaataaagaaattttcaaagtattgggcgtacgccatgcgcacactgttttaacagatgtgcttaagtctctaaaagacacatggtttcgccgcacccggaaatatacggcatatgtggtgtaaaatccgagtaaataaactcataaaagatttaccaaccgcctgaaaaatgaccaagatatataatcagcctaagccataatattggtcaataaaaatgcacacttacgtggcaaaaagcaacgatattgtacccaatcaattgcttaaaaacccaaacaacaccttgacttatataaaaaagtcagcagggcagctatataaagctttattgtttgacacattttaagatgcattgtaccaactcctaaaaagttgagtaactgtggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaatagatcttccgggtgatatagaccaagtgtagctcatatgaatagcttctgatctgagtgattatcccttatgggatactccaaaatagatataaaaattgaatcccgactggcgccagtattcggttgataacccttacggggaataataaatagtccagtctttgagcatagaaaatagacccatgatcatgaattcatgttgcatgtatccggaacaagtccaaattgaaggtatgatacttgtgtttgaactagtaagcccctgagcatatagctcgtccttctgtcgtagtcacaattgtccattgatggtagctgacgcagttagcatagagacaagacaaccgatatagagataatattgcccaccagaggtggcaaaaatattggtggtagtgaagatagtgataccaatcaaaagtgatgaaattgcacagccgtggaggcgaagaaaccagtcggcaacagtcaggtcagccagcaatgaatatgaaggcgcccagcgataaagttgtctagccatggcagcgaaataatcagtcggtgacagacgagacagctggtgaagaagatgaaaacaagccaatgatgaagacgtagacgcgaatcaacgacgatggcgaaatcctccaatca

SEQ ID NO: 47886 - DNA, 1501 bp, Oryza sativa
ccttatccaatacggtatcggtttcctaaatctactttacaatcttatcaaaccaggactttaggccgttccgtgatatacaaggaaacgtaatacccaagtcatgatctgttacatattccatatatataagttatcccctataactagtcggataaccatgccgtgtgggtatggggtacccataatctccacaatggccatcaccaaacacaatgacaactatagtccaatacagcattcacaatgagatcgatttgattatgttgttagtttggtcagatgggcaaagcagagcaacagatggcttcatctctgcttcagcttttcctaaaactaacgtactgtagggccatcggtcactcacaactaacaacatgcacaattaacaatactgtgaacgcttcgctggctcgtacaccaatcattgcaaaataatcgtggagttcaaccctataaaaagttttcatacgtgctcagttggatcataggaatatctatcaaaaatcctttggattggtccgaaacataggatttgataggaactctaatatatgttaacttttggaaaaaaaatatttgtgtctatctattttttttgttcttgtgtttttcctgtgctctatccaaacagctattcttgtgttttttcagtccataagatttgagatgttagagcactttaattctatttcctccgtttcacaatgtaagactttctaacaatacccacatttatatagatattaatgaatccagacacatttatatgtgtctggattcattaacatctatataaatgtggataatgctagaaagtcttacattgtgaaacggagatagtatatctttttcctacattttaagaaccatgcattccaaagtagcccataattcacaacaccattggcatgcagtcactattacacaaatcccaataagtgccggttgggaatcggcaataggtggtttcccagccggtaccattttatcggcatctatgctctagggaataggtgatggtttcagaaccaacacctgtagagattataggtgccagttcttaacccacaactagtacctatagcattcaataaaataataaaaaaaaacagctgatggagcatatccaccgaccgccacctcgcccacaccggccttctctaccactgcctccatcaccggatctggaggagaagaggggagggtggacggagaggagggagggccatcgggaaagagaggggccggcgagcctcctccaccgctacagccggctctagaggaaaaggaggaagcgtatccagaggaggagaggaagggaggatgccggtggagaggtgtatgtgagagagagacgaggccgggtgtgggccaggggataagggtggggattggggccggcactcgcttgtttcggcttggctcgggtaacggttttttaaaaaccaacacctttagtttattataggtagtatcagtttttatctagaactaacac

SEQ ID NO: 47887 - DNA, 1501 bp, Oryza sativa
ttcgaggtggcagttccatgattgggagttcgagagtcgcaccgagctccgcttcctctttgatgaagtcgaggacttcattttccagaagggtcttgggagacttgttagggggaactgccgtaacctcctccgcatactcattctatgggagagagtcggtcaaggtgaacattgcccgcaagaatgaaactgagaattcgttccctcaaaaagttatcttgaggctgtccaatcggggcgtatttatgagaagctgctcaattggaagtccgattaggatgtcaaaatctttgatttcaaaaacatgaaaatccaagactgcctccctgtcttcaaagcagagaggtacgtcttgcacaatcccaaatccttcaatgatattttcattcgagtgcttgaagaatttgtttgttggagttatagctttatcgcccaggtaagcgaatgcaaatgactcagagatgagattaaccccgacagttggattgtatagaatatcaacgttgttcccttctaggtgacaaggaagggatctagtgtcatctctgatctcgacgagtttatattcgaggaggaagactaccctaccgtcgtctacgagttgattatctatgccgccaagtcgatgacagctcgataggttattccaaatattgtactgatgtgattatgatgaataagagcaacaccggcttcgcccaacagaagtaaggctattacccgtcagataaggtgcccgaacctatataaaaatccttgtctctatcttttttacctcaatcttgcatataccctagtaccaacgatccccataccatgtaaaataccgtagtcacggtaccacccgtcaacacatacgcactactagggatatcattacaataattcataagaatcattttttactttcaaaaagagcatgccaaccaaaataaaggataatcgaagttgttgattttgtccgttttcaattcctgcccgacttgagataaagctaaacgataaatcgagctcgtgtttgaatgtctcattgcttggcttaggcttattgctataagcaaatttaaaattataacttgaatttgacattttggttttttttattgtactttattttacaacatttgcttttgagtcgctaagaacatgtatataaaatatttgcacacaaaaagtctgtaattcgaataagcacataataaacgaagcggtggattataattatttattcacctacgcatatctacaaattaaattggcttccattgcaatgcggacattttttttttctagtacgagaagaaaaaatataatattgctaagtgcgcaatctctgcggagccatcacattggttcttgaaaaaaagaaaagaaaagaaaaggaaaaggcacgaacctctttttctcgtcgtccatggcgatagaactcctaggccagagtcgattgctgatctcccctcgaccaacacaaaatcaattgaaaacacagcgttctctg

SEQ ID NO: 47888 - DNA, 675 bp, Oryza sativa
ttttttcgttttaaatgtcaccacgtgcattttcaggttaagaataaattaattaatgcatatacttcttgtttagttttagtggaattccgatagaacaaattaaaaggtcccattctggcaactgtatgggctgcttatattattatgttaaatcttagttgcctggttcttatcactcatgctcagtctgaaccactctaccttaatttgttgcaatctgcacacatttctgactctgaaaactgcacgtcgtcgttcttccatttctccatatataaattcaaggtgattgtactgcaaatctgcagcatctcctactcctagctgtacatgattgcagggtagtacgtactactaaaacgtacctacctaaaattgcagatattgttgccaaactaattaaaatatcaatatgtatacatccagatagaatattgtaacgtgtgataccacaagtgcagtttttaattgggcaagctgggtctgaagttaaatattttcaggttatctgcttgactgcttggcattagaaattggcagtgtccctgtaaagccagctattgtgtcagggcagagagaagagaaatgagatgaggcaagtgtgctaatcagctctcagctcagcatggctgctgcatgcttacctctgatcacaatactgattcggcccca

SEQ ID NO: 47889 - DNA, 1501 bp, Oryza sativa
ctgaatgatttggatagatcagattcagaggcaatcctggatatatctcaggatggttcgccatggagactagggaagataaagcaactgtacatctgcacgcatgcgtattgtccgtgtcaccaacatcaacatctactgatttgtaactggcagcttatatagatttatatgcagcaaaatgtacaataactgggtagatcaatcagcaacttggcacaaagcgcatgcatactttagtttgaccagcttgatcgtcagaacacaagtctacgatgtgaccatatatggggtgaagtcagcgcggggcaattcctttcgcaaatacgcgtcaatttgacgaaatccacaagtccatgtacatacatttcgtttcattcttactacgctgtgtacatgtcaattgtcaaggttagcatagctgttgtactaccgcagtttcctacatgtcctttgtcctctccttcaattttctactacaaacactgttcctaatttatggctttactgcggtacaccacaatattatttgttggaagtttggaagagttcagcacacaggacacatatatactatggccacctagccgtcattattgcaaatttgcaagtaacatgaatgcatagttgtaccaaattaagtacataatatatggtacaggtatacagtgtatagtactatagataccatgatggtacacatatgcaaatgttgatgtgcatacaccctagctaggcatgaaaatgaagtacttctgaaaacactgaacatatgctaaggtagctagattaggcccccagcacccctgcaaggctgcaatcataatgcttaagacacaagcatgcatgtggtaaaatgagggaggagatcagagaagggggaagaggaagctaaaaaagctggacagggatgtggataggtctgttgcatagaattgtttgcacgttgtatagcaaagctagcaatgcaagcagcaagggaagttgcaggtgaatattaatgaaagtaagcagcctttttctagctagtcttaagagaagctgcatgcttctgctgcccactgcatagagaaagtcctcatttgtgctttaggccttcatcagaaggaggagatgagataagagaagagaagagataattcagactagaacagaaatgcagagagagctagctaggtgcagccaaattaaatagacacccttcactctttccattacactgcaggcccaataggagcactttgataggcatcagcatgcaggagcaggacctctgctcccctttgccttttcatggcgccccatcttatatgcaaatgtcaatgtgtcattgtgtctgtatgcctaggtacagctaaatataaaagtagcttaattcagcttgatagctatgcataccagaagaagtcaagaaaccatgcacatattgctcaagcattagcaagtaaatcatggcagtacattgacgtgtgcatgagagggaaaatgacttcaattgatg

SEQ ID NO: 47890 - DNA, 424 bp, Oryza sativa
agacacgaccttgacgtcgggactccttgagtgtgacaaagagtccctagcagaggaggcaaatcggtcgtgccctagtcggtattgtgatttgggagaagattggaagacattggagctaggatgggagtcttggatacacaaacacgagttgggaagatgcaagataggtcttgcggtaggcaagagatgttttggctcctatcttaatcaggacggtagttttggaataaagatatcggacgtgatttaatcagaataggacaaaggaaaaaaaatcatgatgggacaaaatgccttataatctgtaatagagggaatactgttatattattattttattacatcatcatcaaccgattgtctttatatcattatttacatcaagtgtcatattctacattaaacatatagccgatagctc

SEQ ID NO: 47891 - DNA, 240 bp, Oryza sativa
agattcccggcgcactagccggcagcctcgccggccgggggaatattaatgttttgacgacaccatcaccatggcaaggctggcggcgtgtacacgctttatgccgtcgtcgtctcgatcgtacatacccggctcggcggattattccttggctactaagcaaagcaggaaaccccgggaatttgttcaggcggaggcgatgagattgatcgactgatctgatctgatcggatcacgagc

SEQ ID NO: 47892 - DNA, 1501 bp, Oryza sativa
acaggaaaacactggtcaaaagagcagctttaggtttaagttgcttaattagttggcataatgaggacgaggccatagccgaaagaatttgcagctgcgcttattataatcatcagataaggcaggcactattcttaacagtttgaccattgaggcttcaaatatttcatcatgtaggtgagatcaatcaaattaatggactatagcttgatcacatagcacatgttcgccgcatgaattcccggcaccgcatgtcaagttgcactacgttcaattcgattacgtgtagcgcatttcctgataaacgcattgctggaatgctagtagtcactagctaattaagcatacgtgagcaaacgattcgacattagtttttgcaccgaggtatgaactgtgaccatcctatgctaattcagccactaacaactgttttagcattgccaacttgtcttgtcaactcaattatttcacaagaaaaaaaaagactacctaagatagctagatgctctgataaaagcactattattgcatcaacactgtgagaggttccaaagctggaataaacacggcagcaaaattcagaaaccaaacagacaggataaaattacacagagaaagcaaggaaaaaattcctctgagagtcacagagattgctaagttaagagcacatgcaacagtggtgcatgccctgcgtacaaaagcttggacagaataagcacaaggcataatatcattgagggaggcacgagctttggaactcgttccaaagcgacactggcttgaaatctgaagaagagaagaaaaaaagagtcgcgagattttttagaatatttcagagaactttgcctttcctcccaaacctgacatatattcctccaacaaacacttttcctgccttctgcaccacttctctcagccggtcaatcactaagcaaacacttcgtttttgcagagaaatcagtcactaaacactcttgatactaaacacttgataagcctgcatttacataatctcttgtctcccacgctttgcagtgacagtgtctctgagtgtttagtaggcgttgcaatcgagcgtgagtttcgaaagggaaaaaaaatgacaccttgcatgcgtgattctgaatttccgaccattgttctgttgttggacaattggtattgtaatttgtaaagaaacatgaagaaacgggaacgctgaaatgtgaacttcaccaaaagacactcgctgccattcgtgtccgttctgatgcaaaaaggctagacacgagcatcattcgccagctcatttccctgcatcttgagaatactcgtctctctttttctagcataattagtacttacctgtaacaagattccaaggattaatccacggatgatgtggcagaacaggtgtactggatcaatcctacgccctttcctcacaaaccgggggccccctttcacccccatttcaagcaataaaatgagggggaaaggcaagggttctacactacactgc

SEQ ID NO: 47893 - DNA, 1458 bp, Oryza sativa
atcatggataaggtggccaagaaccatctgctacgagctagtggtaatttataatcaaaatccatgccgtctgaattcgaaatttaaagggagtagcaaattcaggagtgtaaggccggcattcgttcaaaaaaaaaaaaagaagtgtaaggccggccggcaccaactacctccatagtccactaattcctgcaaacgcataggtcccaagttgggagctcaacgcatttctggatggtgatcttccaactaccactacatactactttccaaaatataagcgtgcagggttgtctttgtaggttttcacctttgtgtgtggatgtttgctaagctactctaagctaggccattttccccaaatgtaattcagtggtaaagcatcatacttcagccaggaaaaatatatcaccggcgagttaccgctcgttttgttagcactaatcagttcagtaaaaacagttggggaaaaaacattacctgaataatgtgttaagtgaccgttgctatggcatctaaaaagagtttttttagaacagagggagtaatttgctactttggcatataattaagggaaaattgcaaaaatcaccccataagtcatttgaagtttgacattccaccccataaattattttgttgcaaatatccacccacctactcaattttgttgcaaaaaccaccccggtaaacatatgcttaaccgaatcaacatatttttataaaatgtgagccatcaatatggcctttgccaaaactaaatacttctagagtattcgtgatacattttttgtgagattccacatataaaattgttgacgagagcctaaacattgttgcactgagttttgctatatgcaaaaaaaaaatcaatcaaatatggaaaataagtctaatgcaagcacttagacaagattgacttggctagcttagcctgtggtaatcctacatcagcaataacgaattgattcggttaaacacgtgcgcattggggtggtttttgaaacaaaacttagtagcaggtgggtatttacaacaaaatgacttatagggtggaatgtcaaaattcaagtgactttcggggtggtttttgcaattttctctataattaataacatgaccacaataatgtttctgaaaggaaaggtgtaggtgtagccgttaatcaatgaatgaacagtaccactatcagtgtatatgtcccatttacaactactgcgagtccctgtcgaccctggttagcaagggtactacgttaccctgctgaactgtactgtacatgagatacgtgttgtctgtctgtggtacaacttaccaactccgcacttgcttagaagtcaatcatccacggtaactactcatcagaaaatgcacttcaataaaagaatcatgcattaaaacacacacacacacacacacacacacacactatatggatgacagcatcagccaaagcca

SEQ ID NO: 47894 - DNA, 516 bp, Oryza sativa
attgtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagaaggctacgatggtcgactgcaaaggactcgggggctactgtggagatcatgggtatcccatatctacacggcgatggtattcgagctgggcacaggatacctaatgtagatagaatttcttatttgtatcttgggtttgtttcttaacttgtgtatcaaggaaacaccctgaaacttagtcggttacgactgtatcttacctatattttcatattccgttagggatatagattatcttttgtaacccggactccttcccatatataaggggggtccgggcgcctctaggggcatatgttgatttttctcgaatcatacaatcaataatacac

SEQ ID NO: 47895 - DNA, 528 bp, Oryza sativa
ggcttcttcttgtttttcttcttcttcttcttcctcctcttttcgccggggcgatgaaacctgttgtcgaaactagatttcggcaataataaaagggggtggctatcaagctggaaaagtgtatgggttttgagacaaaggatttatacaggttcaggccttcttataaaagaagtaataccctactcctgtccggggatgaatccgccgagtgtattattgattgtatgattcgagaaaaatcaacatatgcccctagaggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagaaattctatctacattaggtatcctgtgcccagctcgaataccatcgccgtgtagatatgggatacccatgatctccacagtagcccccgagtcctttgcagt

SEQ ID NO: 47896 - DNA, 441 bp, Oryza sativa
aatgctccattgtttttcttcaaatactgcattgttttataatatcaccatgggatgtttacctactgtcatagccatgctatcttgtaccatgttcctttgttagcttgggatataacatgactagagattggactagggaatgcttagctttgcttagttcaactagcacacaatggggaactacattaaatgcatagatatcagattctaggattgatgttggttaatgctcaccactccggtgttggttaattaattaatattaaatggtgggccgtggatgcatggttttgatggtcgcgcccaggaccattaaggaccggttcgcgggaaaccctagaagaattcctcgtacttaccacaagccagcgtgggcaacggctgggcttatagtgtagctttcctctagccgacgcatccaggcaagggtgggcatga

SEQ ID NO: 47897 - DNA, 1501 bp, Oryza sativa
aatattctttttcaaccaattgacttgttccatgagcagcagccagtgcacagctaatacaaataatggttgcagttttcaatctaggcctgaaggtgccagggtgtgcaatgcataatgcagtctgaaacttcgtatagtatcttcatgctcgtttgtgctatgcaagattcaaaacagactttttttaaaaaaaaatgaggcatatgattttcaattactagaaaaagatgagaagacagtcgttaaatgttcacttgatgctaaaacattaaatgttcagaccacaaacaatcgaagctaagtactcgcacaagcacgggcacatccacgatacaaggaccaaggaagtagctctacaaactgacattaaaaaaaaaaaacagctctaagtagtagtattacaaaactgacataaagtgttacataaccattcaaacaggcacaatactacaacaacgattacaacaaattactagctgtgcagcgtgagcgcgatccacgatggtggtctatggtttctcacaatgtaagatctgttcctcctcacacagctgactaccatccagaatactagaccactagttgttgggacgatgtaacctactacttcagtatttacaatgtttagaaatacacgtacagcccaccaacaccgtggtaatacgcagatgtgatgtgattggtgtcctaaaccaaagaagagaataaaaaatggtacagtctagttatttgagtcgaacaacatgtcctggaaggtaaggctgctaaggcaacttaacatactcgatcaagagtgcaatgctgagcacaatattacaagagaatatcttgcttgtctggcaatcgagaaaagaaattccaaatgttcgatggtgtattcttcttctgaaagcaccaagctttatatagatgaagtgttactgctatgtattatatgagagtaccttgcttgtctggcaatcgacgaaagaaattctcaacgatcgatggtgtattattcttcttccgaaaccttgggtgcctcattatgtaaaatcctgcgattcccacaagaaccttctttggtacaaaatacacaacaatcgataccatgacaatgatgaactgaaagattgcagttgctctaggatccctccaacataacaatgattggatcctctccccctgagttgctacatcacccacaactgtttgaaccctgccggcaacgctcctcagtctatcgtacctcattcttaccaggtcaatactacaacttgattcgacactatcaaactcctcatcaatctcatctggatgtacactgcctaaacaagatactttatgatcaaaaaaaggaggcttccttggtctgaaccggtaattccacaaagctactaagacaaaataaatgatcaccatcgagagtactagcttatggaagcacagagccaggacaaagatgacacaagaaatcaaggcaacggcaggattcttccatgaggtcacgctctgaaac

SEQ ID NO: 47898 - DNA, 1501 bp, Oryza sativa
actccggtgttggttaattaattaatattaaatggtgggccgtggatgcatggttttgatggtcgcgcccaggaccattaaggaccggttcgcgggaaaccctagaagaattcctcgtacttaccacaagccagcgtgggcaacggctgggcttatagtgtagctttcctctagccgacgcatccaggcaagggtgggcatgatggagtttggatgggccctgcgacagcctatgcggcttccggattcacctaggcacgagaggggactgcccgctgccttgcaaggagtgggggtgaaacctgaggtgtggtgtgcttggttagagggggttatgcgaagggtcctatcacggcctctttccggtatgtcgtggtggcatgtcggcgcacggaaacgtgtcatggggctatgtcttgtgggtacagttgtacacctctgatcagagtaaaactatttgaatagctgtgcccgcggttatgggtggtcaactatttggacagtggatgattaatattgattaattattacaactgttttactgctttcaacttctgtttataaatgcccgctttatgcaaacgaaccattatagctatcccttgataattccctgcatcatacccctattccggtatgacttgctgagtacagtgggtagtactcagtcttgctctattttccccaaaccccagagtttgagtatgcgtcagatggtgatttctccgaggagtaggcttcatccgtgccgtcgaggatgcctgtggagtggtgttcccgttgcagatcaagtcaaggcttagctctagttatcttttgtttttccactgcatttatgtaagactgttataatgtttgtaagacgtggatctgtatggcaactttgtcgtttgtgtacctcggccggtcctggacggggattttaatgcatattctgcttggaattctattcgggaatttctgggccgtaggacaagccaaatggaaaaacctaagagccctctgaatccttttcattgcatatgttctttgcaattggattagttctaggaaaattgggatctgttcttgtggtgcaagggaaaattttggtcgcccgtttaagtgggatttgccaaaccaggtcagtctaggcttttagtaaaattacttgggatttattcgacagtcagtcgggatttgatgggaggaatgcattaggtcctaactcaggaatatgggttgcaaggtatttatgctcttattattattagtatgtatctaattttctcattattttatcgctatgtaagttcgtcttatttattcgccttcatgcaaaaatgatctatgcataaaattccactcttattcgcttattttaattgagtcttttactctttcatttaaattggatttgagcatgcattgatcctacccctttgtcttctctagatggccgatcacccacccaaccatcgcggagaaggcatggatgactttgtggcagagttggctcgca

SEQ ID NO: 47899 - DNA, 413 bp, Oryza sativa
  unsure (1)..(413): unsure at all n locations
aaccagtttcggccagttccctcagttcgacgcactaccataaaaggtaccactccatagttgttggtttatttgaaatcgacacctattaccgtttctcatctctataaagaaaagtatagaaaaaaaagttaaaaactgatgccggtgtgagtttcatttaagaaatgacctatatttatattataggtgttagttctagataaaaactgatactacctataataaactaaaggtgttggtttttaaaaaaccgttacccgagccaagccgaaacaagcgagtgccggccccaatccccacccttatcccctggcccacacccggcctcgtctctctctcacatacacctctccaccggcatnctccctttctcttctcctctgcatncgacttccttcttttcctctaga

SEQ ID NO: 47900 - DNA, 560 bp, Oryza sativa
atcacaacacctgtagagattataggtgccagttcttaacccacaactagtacctatagcattcaataaaataataaaaaaaaacagctgatggagcatatccaccgaccgccacctcgcccacaccggccttctctaccactgcctccatcaccggatctggaggagaagaggggagggtggacggagaggagggagggccatcgggaaagagaggggccggcgagcctcctccaccgctacagccggctctagaggaaaaggagggaggcggatgcagaggaggagaggaagggaggatgccggtggagaggtgtatgtgagagagagacgaggccgggtgtgggccaggggataagggtggggattggggccggcactcgcttgtttcggcttggctcgggtaacggttttttaaaaaccaacacctttagtttattataggtagtatcagtttttatctagaactaacacctataatataaatataggtcatttcttaaatgaaactcacaccggcatcagtttttaacttttttttctatacttttctttataga

SEQ ID NO: 47901 - DNA, 1501 bp, Oryza sativa
gcccccagggagcaggttggaatctgaactccaagctgtactagttctgaatcaaagcgtggatgggatacatgatcaggcaacaggttcaagagtgctgccatcgtctggaaatcatgatggtgggttggcaagtaataacctgagcagtcaaggccctacagttttcactgaaggagaggttgtcgatgaggaggaggatgcggttgaaattgaaatcgaagagaacgaagttcagaaggccggtcaatggacgatcctagcgaggttctactcgctcaagtttcctaatcagtcggctctgtttgaggatatgagaagagcatggcgtttgcgggcggagatgagttacaagtccctaaaggataacctcttcattgtgtcttttaatgcagaaggggactataatttcgtgctgcaaggaggtccatggttgcacagaggagatgctttattggtggcggagtttaatggcttgttaaacccttccatggtgaacttggatacagtccctatttgggtcaggatctatgaccttcccctagttatgatgaacagagcaagaggtgaactctatggcagtaagatgggcaaagttcgcgaagtggatgtccaggaggatggatgcaataagcatgatttcttccgtatacgggtggatctcccagtcaatcgccccctaagaagaatgctagctattaagataaaggtgcaaggcaaagaggagactcgcagatttcaccttcgatatgaaagagtcccacacttttgtttcttctgtgggtttatcggacactcagataaagaatgcgaaaagagactgacaaatgagaatgagcctttagtattttctgctgaactccgttgttcgcccttaaaaccctttgagagaaaagtgggtaaagtaaaagcagttcattctcaaggtgttcagagaaaattgtctttcaggggcccaggaagtgtgagttcttcgtcagcgggtattagacaggatgctaagagatatgaagatcaacccacaagggtggatgcttttgatggttttgatattagagaaggaaaaggtgaagactcaatagatagtcaacttgctgaccagacaaatatgctgcacgtctcggaggtgtcaagccttggacagaagaagggcaaggatttggttagtaaggaaaccagctcaataccttcaatggagatgatcccagcaattagagacctgaatgtacagcaagtttcctttggagatggctctactgaagaatttggaagcccaacaaagaggaaagctttgccgacaacaaagagctcaggcattgtccagcaggctgttttggagtatggccagagaggagcggaggaaacggcaagctcaacacgggcaatgaagaggctcaagaagggagtggaggcaaacattggcgtggaagacatggaagcaaccagcccaggggctgctggtaaactggcgggacctatgagagggtctcgccaggagaaa

SEQ ID NO: 47902 - DNA, 154 bp, Oryza sativa
catatgccaaatcatggacttctgatgtccttgacaaagcttttcagcaggattgtatgtcattcacaatagcaaggcatatggcttcgttttccagtgcagcggttctatcaaagtgcgaaataagctggttaaatcgcttatcccggtgcta

SEQ ID NO: 47903 - DNA, 1501 bp, Oryza sativa
catgcatggctgaaaatgtatggctataaacgattgcgtttctctcttctccaccatacaagcaccaatcatacacatgcatatataacttgttgaatcgatcacatctgatcgagataagcgagtggggagagggtcagatggacttcgattctattgtatagagagtatcgaacagattagatatatagctgctgggatgttgatgacacggagacatctcccccctgcaggagatccagcttatttgctagctctccctctgttgacgccagtggcctgagctgatcagctgaaagctgcgtgtgtggaagccatgcgtgctgtaattccaacacctacatctgcaacagtgtgcatgcgtgctgcatatatgctactgaatttttttcgttttcctttcacacgctgcagttcgagtcgccatcgcttctttttgaccgggcctaactccatatcatccatgcgtgcataataatggaggactatagtttttccactggaatcatctggaccaatgtattcagggttcgcgatgatcctttttcagttcggacatgcgctaacggacagtaagctgcatcatcatatgcatgcatggtcgatctactaatctggcgataaagtgattacattcgattccgtgttctggatgctcctaagagcaagactaataatacagccgacttgttgggtataaggttctttgtagccttctttcagctcacccatataatttagttagctctttgcaattaatatatgactcacttgtctctctcacacagtttcttggttcttgtgtctaagccgactgtaagtttacagcccacttcttctctctctcatctcttttttcttccacttcagcatttagtcagtttatagcctactattatatttgctctcagaggtttcaaattaatttggcttgcgtgttatctgagaacttcgagtggtcgttcatggctcatgtggcggcagaaaacggagggtttcgctgtcctacactagtaggggtagctggaacctaagcttccatatcctgatcgatccatcggcttctctgtgctatcttttctggccatttgttcctatcttttcgatgggacgtcgctgtaaaggaagactcggatctggttcgaagtttactacagtaaccagcttcaggcaggcatggggattggggagagctagtagatgtatggccgccatcccatccaggtgacgtgtctgcaactgcatctaggagtaggcctcatcttctttaggccctgcgctgcatgcatttcgtgtcattatatttatgaccgcacaccatgccacaaaaggtgccagtaggagactactctagctaagggtaggtacaatagctgactataatccaactataaacatattttaaaaagataaaagatgagagagaagagcagcgggctacagatttgtagcccagctgcagcacagactacaagacacagtgtgagcatgacatgtgaga

SEQ ID NO: 47904 - DNA, 535 bp, Oryza sativa
tcctattcaaaataaggagcaatcttttgaagaaaatccatttcgactgcctcaactattcgtatccttttaactgtaaaatcagccatagagaggctccctcaatcactaaaaccagctcactttgcgttctgagtgtattaggttgtgtttagatgctagggtgaaaagtttttgacgtgtcacatcggatatacggacatatatttgaagtattaaccatagactaataacaaaataaattacagattccgcctttgaactgcgagacaaatttattaaacctaattaatccgacattagcaaatgtttactgtagcaccacattgtcagatcatggagtaattagtcttaaaagattcatctcgcaatttacacgcaagctatataattagttttttcctatatttaatactccatgcatgtgttcaaacattcgatgtgacagcaattaagcatatgacaacatccacacactggtcctgtatttttagaaaataagaaataaaacttgtattttacactagctctgtga

SEQ ID NO: 47905 - DNA, 1501 bp, Oryza sativa
taaatttagaagtttgagctctactaaacaggccttaactatccactggcaagtggcaaccgcagggagacatacgggcatacatacggccttgaggcttcaaccacgggccaatagtgctcgctcgtggattcttctgttagtgtgggcctttggcgcgacatctgtgggctttgattgttacagcctgagaaggcctctactatatggcccataacaacgtggcaaaatctgggcttacgttgagcccgagcctgcatgtcacatgggctacacactgacgtgggctatgattgtggcgctgggctgcaaaaatccccttcctcttcagcagccgacgcacgcagagatcgatctcgtgagcagcgccagcgcatgaagagcaagaagacatctcccaaagaaaagatcatcgaacgaagaggaactcaagcaggcagaggcaggcgcagagaatcgaagcagcggcagcagcaggccggctcgtcggccagtcgggcggcagcgtcagcagcagcagcatgcatgcgccacgagttaaaaggggaatctcccacacccactactcctcactccctgcctgcctgcagcgtgctgcgctgcatatatggcgagaacgaaaagcgcgtgtactggtccaggctccccaagagctagcatatgctgctactactaccactgcattgctgtggctactgttgcagcgtgtcgcagactagcagtagcacagtgccccgccataatgccccgtgccgatctccgtgacgcgtgcgcgcccgtgccgatgccgatctgcaatgtgtagataaagatttgtcgattcgtcgtcgtcctgagatcaggtaacaatgtaacatgcatgctgccgagtactacaaatatctctcgcaagtcgcaatacaattctcatgcagctggccggtgaaatgtcgcgtcggccgccatcgttgcagacgtcctaactccgtccgcacaggtatggtacggtgtactgtacgagagatacgtacccacaggcgtacagtgccccgcccgcggctgcttattttcgtggcacagtagtatagttggctagtcgctactggagtactacacatttcgcatgagtgatccagagatttttcagaataaatttattgtaaggacgttgttgaaagcttaagtctaacagttgtgctggtgacaccaccagatattaccaaaaaagaataattattatattgagttttgatggaatttaaaggcatgcatgcatagtcgtcgaagattctatatgcgcatgccggccgtttctttgcatcctgatatctcctgtgtagttgtcaaaaaagcaaaagataaatagctgcatgatgtgaacggtatacagtactgttcaggtcaggaaacatctccacacaaggaacgcgcgcgatgacggtaagagcaagtttaatagcatagccaactactacctccaaattatatatagtcaatctaataactaattcgtacaatagtt

SEQ ID NO: 47906 - DNA, 358 bp, Oryza sativa
tcacttgtaattagcagttttacctaggtaatctgtgactaatgcaatgctgacaccacagttgagctagatcagtggataaagtagatattatctgaacattatttgtgcctaatgtaatgctgacactatagttgagctacaccagcagaactaaattaaaatgataaattctatctgattcctggacaacagtgtatggtttacggagtagtttctttgaattgatcggttgttgtttaccatgtgtttcttgtcttctggtattttttaccatgtttatttggttgttcatttcttgtccgttcttgattttgtatggaagataccgggtgttcttcctggacgccgttggtca

SEQ ID NO: 47907 - DNA, 1216 bp, Oryza sativa
tactacgtccattccaaaatataaccatttttatctataaatctagacatataatttttatctataaatctggacatacagttatatagattcatagttaaaaatatttacattttgggacaaagggagtagctagctagctacttcaactacaactgcatgtattataggccctgtttagattttaacttttttcttcaaactttcaacttttcaactttttcgtcagatcgaactttcctatacataaatttttcaactttttcatgctgcatacgtaggtggtgtgatgatgcacggcgtccgatatttgacgtcctacgcggagtcttttccgaagaaacgcattgtcgttcgcgcgttccgctgttccgcacgcgtgacctgatgcgacgcggacaccgacaccgagacggtttgggactggatcagagtatccgtctatatatttcattcgtcgccacgcgtcatcagatcgatcttcctagtagtgctgatccagagacgatcgatccatggagcaggtcgcgccgccgccggtgcgatactgcggcgtcacggaagactacgagcagcagttggacgaggagccaccctcaccgctgtccccgagccgggtctcttccccgctgccgctgccggagcagaaactgtccaccgcatatcttgtggagctccggccgcggcgcaagaacgccctcataaacaacggcccacgctacaggtgtggagatcatgggtatcccatatctacacggcgatggtattcgagctgggcacaggatacctaatgtagatagaatttcttatttgtatcttgggtttgtttcttaacttgtgtatcaaggaaacaccctgaaacttagtcggttacgactgtatcttacctatattttcatattccgttagggatatagattatcttttgtaacccggactccttcccatatataaggggggtccgggcgcctctaggggcatatgttgatttttctcgaatcatacaatcaataatacactcggcggattcatccccggacaggagtagggtattacttcttttataagaaggcctgaacctgtataaatcctttgtctcaaaacccatacacttttccagcttgatagccacccccttttattattgccgaaatctagtttcgacagttggcgcgccaggtaggggtagcgtcaagcttttcgccgatcagtgcaa

SEQ ID NO: 47908 - DNA, 1501 bp, Oryza sativa
ggattcaagggcattgtttcctgtggaggacggccatgaggagcaggtttcgtcacaggctttgaagatggacacgggctcaggagataatactttgaggccagagaagtttactgaaggagagatgaatgaggaggaggaagatgtagttgaagtgattcttgaagaaggggaagtacaggaggcaggacagtggacaatccttgctagattctactctctgcgggtgccaaatcaggcggctttgtttgatgatatgaggagagcatggagattgcgggctgacatgagttataaatccttatgggataatatgttcatcataactttcagtgctgaaggagattatgagtttgtcttgaaaggtggtccatggatacatagaggtgatgctctattggttgctaggtttgatggtctgtcgaggccatctgaagttccactggagacagtccctatttgggttagaatctatgacctacctttagtactgatgatgaaagcaagaggtgaattatacggcagcaaattgggacaagttcgggaggtggatgtgggtgacgatgggcggaacaaacatgatttctttaggattcgtgtggacttatctgtcaagcgtccgttaaagtcgaagttggctataaagatgttagcacagggcaaagaggtcacaaagcgttttgatctttggtatgaaagggtgccgcatttttgtttcatatgtggatatctgggacactctgacaaggagtgcaataggaaaggagtcaacaatgaccagcccttcaagttttcggcagagttaagatgctcccctctaaaaccctttgagaggaaggtgagtaaggtgaaagtaccatcatcttcaggggtggtgcgtaacctgttcttcaggggggcagggagtgcaagttcattgtcctcacgacagaaacaaggagatcagggggaggacttggttccaccaagagtggacgctcatgatggttttgagtctgcaaagaaggaaggggacacacagattgatgaacagttggcgggctatgcagagaaaatgaaggtgggggagacagaagtacagaaggtttctctcccaggaagagagggagcaagccataaacgtggacctgagattcggttggatggtgtggaagatacaacttcattaccttcttgtgagatgataccggctattaagactataagtcagcaagcttcctacggtgatgaattgtctgaagattgcagtggagaggacaggagggaacctcaaacacagggtgcaacaaagaagtcagggagagtcatgcaagctctgctggaatatcaacaaatggtggaagaaagcagcaaatctgtgtttgaatcgggcgtttcttcacgggcactgaagagagccaggaagactgaaggggtagtaaccgggaaggagaaggaggcaaccagccctggggccgctggtcaactgacgggaccgatggtcgggtcccgtcaggagcaa

SEQ ID NO: 47909 - DNA, 1043 bp, Oryza sativa
atttaacttctacatctcgcaacgaaaaaacaaacgaatttatttttttttgcgagatgtagaagttgcatgtttgtggagtgatatatcacatgttaatacatcttctcaatttctttcaaattttttcataaccatttgagtgatgtgcaaacaacaagaggatatcccctcgaggggtgaaaatccactccccagtttaccactgcgctaaaaattatggggctcttttgttctctaccttacttcctccgtcccataaaaaaccaacctagtaccggatgtaacatatcatatccagattcgtagtactagaatatgtcacatccggtcctagattcgtttttatgagacggagagagtatctaccaaattcttggcatgttttggtattaccaatttttttttgtaaggtagagatttattatacatgtttggattgctactaatatgttgccaaatgttgatgatacagagaagaagactctagattagtgccaaattgatcataggaatagccaaacaatttggcttcaatccaaacctatactattactattgaaggtaccaataaattggcagggcacattttggcatcaatccaaaatggtcatatatcagatttactccttcagtaaaaaaaagtctaacctaaaatatcaaattcgttgtaataggatatatcatatcctatcttaggttggattttttttaaggagaaagtatctacttactactactgtttttgttttatattataagttgatgttgaacttctttggatttaaccaaaattttaaaaatatagtaatatttttaattaaaataaacatagacatattatcaaaatgtatatttaatgttagatttgatgaagttaatatgatgttttagatgttactttttttttacaaacttgattagaaaaatcaaaacaacttgtaatatgaaaatgaatagggtaaattaagtcgattaatttcttgaccatcatttagaaacttcaaaatattaatagtaaccaatttttttgtttcaaaagc

SEQ ID NO: 47910 - DNA, 1501 bp, Oryza sativa
aacctttacattggctgaaccttgtcgcttattatcatacgtatgaggtacccctgaaaaacccaagtctaccagctgacaagtctgtaacacatctctaaacgcctgcatttgggcattactccttttcctaacagaagtatgctcaaattgccatagagcttcattaaaatcccctacgacaagccacggcagagaggaagtctgtttaagagcatttagatgagcctacatcctgcatcgattttccactcgtggttcaccgtacacaaaagtcacatgccacaaaggaccatccgaggacagacgcacatacgcatcaataaatctttcattaatagaaattatttccatgtggatagattcatgccaaaacaaagcaagacccccgctcatcccctcatagttaacccccacaaaacccttgaggcccaatcttgatcgcagacgtttaactctatcgaccttttgtcttgtctcactgagaaacacgatatgggaacccgcctccttaaccaaggcgcaaaggtcatgaactgacgcagcgttcccgataccgcgacagttccaagccatgcaattcattgctcctgacgggacccgaccatcggtcccgtcagttgaccagcggccccagggctggttgcctccttctccttcccggttactaccccttcagtcttcctggctctcttcagtgcccgtgaagaaacgcccgattcaaacacagatttgctgctttcttccaccatttgttgatattccagcagagcttgcatgactctccctgacttctttgttgcaccctgtgtttgaggttccctcctgtcctctccactgcaatcttcagacaattcatcaccgtaggaagcttgctgacttatagtcttaatagccggtatcatctcacaagaaggtaatgaagttgtatcttccacaccatccaaccgaatctcaggtccacgtttatggcttgctccctctcttcctgggagagaaaccttctgtacttctgtctcccccaccttcattttctctgcatagcccgccaactgttcatcaatctgtgtgtccccttccttctttgcagactcaaaaccatcatgagcgtccactcttggtggaaccaagtcctccccctgatctccttgtttctgtcgtgaggacaatgaacttgcactccctgcccccctgaagaacaggttacgcaccacccctgaagatgatggtactttcaccttactcaccttcctctcaaagggttttagaggggagcatcttaactctgccgaaaacttgaagggctggtcattgttgactcctttcctattgcactccttgtcagagtgtcccagatatccacatatgaaacaaaaatgcggcaccctttcataccaaagatcaaaacgctttgtgacctctttgccctgtgctaacatctttatagccaacttcgactttaacggacgcttgacagataagtccacacgaatcctaaaga

SEQ ID NO: 47911 - DNA, 1501 bp, Oryza sativa; identical to SEQ ID NO: 29201

SEQ ID NO: 47912 - DNA, 1501 bp, Oryza sativa
ggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagatcctcctccgttacgtcggacgacgcccattggccttcgaagctttctctctcttccgccatcggtttcactcaaatgtgctgatttgattcgagggatggcttgggagaggtgagggattgaggcggtggatcacgagaaggattttgatgcacttttcggaggtggatttggccggagttgtgaaccctagttcgccggcgcagctttgcactgtagcagggagtggggaaaatggcgagagttccggcggggaagacgaagcgccgcttggatatcggatttttcagttaagggtatcggaggtgctaatgggcctaggcctgaacaatacttcagcccaatacttttaacagcgtggcccattgtgttccttagggacttaggcatattttgctttggcaatattatgcacacaacagtgttgcccaatgctgatgaaatcctttttatgcggtcatataattctttggaattattgcaatgcaagttaaaaaggtgtccgacagaaaggcgttatgctgtttttgcaagcttttttaggctacaaaagctgtttgggttaactaggaatgacttgtttttattatagtcatttccttggcgtgttatatgccagttttcatggtaaatagtcatggcctaggctatttgacttatttattaccataatctttatggtacttgatgggtaatctttagagtttttttattcggatgcctgtcaagtgagttcattcgtgaaccttttagagtgtaaaccactcggatttcttttattgtggctaaaaagcagtcggctagcatgcctatttaggcgccgcgtacgcttttgtcatgtaatgcacaatagtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagagggttacgatggtcgactgcaaaggactcgggggctactgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatattccgttaggaatatagattatcttttgtaatccggactcc

SEQ ID NO: 47913 - DNA, 1501 bp, Oryza sativa
cgcgatttgtttctgcttagttaggtagccagccggtgagaattctccacgacttgatgcaccaaacacgcgttgccgcaaacggagcgctttgtttgggttcgaaatctcaatccgccttccacgtccaattcctcaaaatcacaagttgggggtattattgatttgatgttattttttgctgcgtttcttctctcgccgccgtgttcagaaattcagagaagccgtcaaactgagcatcactgtgaagctttaattgagctgcctttcgctgtcaaggcttccatggggacttcatctgaagctgctctctcgtatttcagtctccgctttgattaactcaaatcaaactagattggcagtggtctgaggatgcagaatttcacaaaccgtggggaatctgcactgcatctttgcatgaattctttaagcggatcaggggaaagagagggacacaccaatacatacagcaagtgaaaaccaacagcttacacacacaaaaattcatcaagtccgtgtaggatgcagcagagtcaatcttggcggcccttggtttatcatattgtaagcactattgtcctataggaggaggattccgtccttttgctcagataagtgaagaactgccgtgcttatttaacgttcacgttgctgtcagcctgagtctacttcttggactggtcaagccagcgacccaaccatgagcttctgcttttgttccttcctgctgaccacttttccatgccaaccatggagtttgggaaattacatccttcacttttcttcttgcaaagacatgagtgatctgcttagcttctacttggaagaaaacactaaatgtgcaggagctaataagtgagacaaagtacagactgtataactggaaagaagctgactttgtttatgtactctcagcatgttactagtgttataattcaggcacccagtgattcggcagtcatcctggagatggaaaaagatatagacagatggttactaaagtatcgggttaagaaatacaccaatgcgcagcctactttgatctggccaatgcgcatcaggggtgatcgtctatatatcatcagaaaaatgaaaggaggccatctcccccaaagtgaaaggactacggaatagccttagaggagtgacctccccattttgtttcatttcacccgtttcattcattgagtctatgttttcatcgaaaagcttgcacttcaaattggcttgtttcataattttgcaataagattgacaggaaaagcactgctagttcaaataaatataccttctttcttaggttctttgttacgacgaaacatctgatattattcttcttagaggggataatacgtttctctcgctcttccttttgctttgtttgtgctataactagttgtctttctattggaaattgaaggcagcaaaagcggagactatatcattagaagataagagtagtcttttcctttcatattaactctgacatactaagttgtga

SEQ ID NO: 47914 - DNA, 1501 bp, Oryza sativa
taatgcaggcttcaaggaaaggttgttgtttttgcaattgattttatttaaactcttttctgaaacaactaagtgagtgcttctcaaacgacacggatgggacagtgtgtctcgtctggccggagtatgtacaaggtatcagtcttttgaattgatcaaggttggcatccggccaacagctttcaaacggccacccgggcctggctgatcccagcagccgcagattttccaaacatcgaacccaaaccacatcagcaaattccacaaagcagtagtcaaacaaaactacgctaggaatcacctcacatccacccatgactgtgggcacggctgttcgaacagtttgataacctctgcagagagggtacactttacccacacgacattactaacccgaatcacccagcccgtgtagaacggccacgtctggtgacctaagggctttcatgacaaggcatttcgaaagccgacacaggttcaccatatgccaacgagaggggtcccagaccaacaccagattaggtcccagaccatactgtgccaggaaacccgggggttctccccaacaccaccccgttgaatccacatgtctcttggcatcatggctcccccgattagctagttactcagccaggggtgtcccattccacccatgtggtcgtacttgtcttatgttcggatgaaattccaaggaaacggtccttaagtgcaagagcgggagactgtatacccggtacgttccccagtccgcgattttggaaattcatttagttcgcaagcaccgacccaggtgtcgggttttccaagtcttttgtaatacccaagttttacccatggttggatattttatattttgagggggggtgttctgatgcgcgtacccgaaggcccgtgcatcgaagcacaacagttaacaaggaggtttaagtgttcaataattcaaggagggtaattgcagcaattaggattggggccggcaggccgtttcgcaagccgcggccgaattacttgtgtaaatcctattcatgcaatatttgcggaaaagaaatacttagatttaaattataggtgcaagatgatcaaaggtgacttgctttgctcgagatcttgagcttgatcctcgaaatcctcgcactgcggatcttcgggctccgaaactacacgcgaaacgggacaacacagcaaacggcgaaaataaggccctattattgacctctaagcatgccattaggtagatcttaggatttgaggaattttggaagttgaacggagtaaaacgtacttacggttgggaagatattaaatttctaagattattggatttttggtctaaaggaaaaaggatttatttaaatccttttcgaaaagaaaagaaaagaaaagaaaagaaggagggaggggaattagacttccctcgggcggctagggcgcggcccgagagaaagggggcggctcggccgaacttaacgggccggccggcccgagaaggcggcccaaggca

SEQ ID NO: 47915 - DNA, 920 bp, Oryza sativa
agagagagagagagagatggggagggagggagagatgggccgagaggaattcggcccatcgaacctgagggaggcaaaatagacttttgcggaggaatttgatttgggacggattttggattcgggattaagcttgacgatagatcggggatttgagatctgagatggcacggacactagacaacaagcaaagaaacagatttcgcaattaaggtttttaagagatagttttcccgctaggcgccacgacggaacgggcgctacaagatctaacctaatcggctgccctctactaacagatgttagccgattgtaggttaggtagcgatattgttagagattatgtatgatatatgataacacgacgaattacgtaaacaagattagagtatcataaaaatggaagcactaatcccgagaacacaagccgtcataacaagttttacctcttgttgaagatcgaaaccgatgcagctcaactcgaaagcaggaactcgttgaaataaaactaaagcaaaaaggtggcgatgcgccgaaattgtattgaacgtgtgttgttgttttttacatagggctcggggtctatttatacccaagaattacaagatatgtccataccggacacgaccattatctctaacaaactctaatataccataagtctttgcggcagacttttgcccaaacatatctctaaggaaattacataaaacatcctaattaatagatacaattgccttctcaggactctatccatgtgcggcaatcatcttgaagcacctcaattcaacccgatgtcatacaccaagtcgtactgtcgtaatcggctgcatcggcttacctagtccgacttagacccagccgatcctaatcgtaaccgatctggactccagccgattcttgctctgttctcggataga

SEQ ID NO: 47916 - DNA, 435 bp, Oryza sativa
caagcaatacatgcatagcattagcaacatcagacttttgagatttgtttatttatgcacttagtttgtggattggggagaagtttgttaggttgaataggaatcatattagtactatataatttatggattgaccaatcattgttacttgatgatagttacaaccgcttggcatacagtccctttaggctcgagctatacattaaacaatacatagtcaggtatcctaaaattcttcacccataaagttcagttcatatgcacaaaaagattcccaagatatgctggtgccatgttttcaagaagtgctcccttacctaactgtatcattatcaggcatgatgctatcatctcaatccaatcctatcatgtcttcatgcactattggaattctgaatttttacactaaatttgattcttctttgacattacagg

SEQ ID NO: 47917 - DNA, 361 bp, Oryza sativa
gtggtgtctagtggagtccgtttatcggccactcgcctcggttgacacacggggtccgcttccgtggcccgtggaccgtctctgtgtacccggtctaccgtggtcctttaggttgacatgtggggtccgcatgtcaacggcgcagccttcctgtcttttacaggctagcgtttacacatgttttataattgcaaagtttaattataataatttgcaaatctccatataacagcattaaacttcggatgatcatatgttggtcatacgaactctgaatcgacccgttcaagtctcctaatgtttgttataacctaaagaaccctgtgctttctttttatgtgtgttattgcttctttatagg

SEQ ID NO: 47918 - DNA, 1501 bp, Oryza sativa
atctccttatctattggtgtggagaagctccatctctacgccacccatgccattggcggtaatggaacgtgctcttgacacaacaccacaacgatgccgcctacacactatgtcgagcagatccaatgtagagacgtggtgccacttagttggagggagacatcggccaccgtggtgttaagagctaatgacgcgatcaaggcaactctgctgatagcagggagtagggggatcatatgttagtgtcaacccatcttcgtgctcgatggtgccagtgtcgttctccaccaccatcacctccctccgtccaatccgctctaggacacgggcacctagtaaaaaaacgagatttggagaaagagatgtgcctccaaatatttcttgataagaaattatgagcgcattgaaaattgaacacgagacctcgacattgaaaccacacatcccttgtcactgcactatcaagtgcatctcctcgtgggcagccagtaataagagctcgataggcgagaagtgccctatagtaggacattaacttgtttggagatttttgatgatttcttttcaattcattatgcatattgtcgcacattgttgttttagtctattcgatcagatatgctacacatgatgcacactccttcgccatcttaatgcgcccggcaacaatgtagtatttttttttatgttgcagtgcagtcggtatgcactttgcgtggacttaaacatgcgtcaacacgtgtgtatatacagcatagttgtgtacatgttggctgtagctacagaaaaatagtggttctataacttttggtagcggccttaattagttccagatctcccaagtgctccactacatattcgtgcatgagtttgggcgacacgcaagcatgtatgtgtggatatcacccttcagccaccgtgttgcaaaatattactaagagacactccatacgcaggtactcctcctactaattagtagtgctgtgcataagctcagactcagggagaagcctaggaaggcaaagagaggaaaaaatttcggcacgtacactgtcccggtcgagattggcgcatgaatcctcgtgatgcaggtctccggtacccgactgcggtgcgcccgttcgcacaccatcatgctctgttgcacggttgaacctgtcgtcgaccacgctgagccgcgtgccgtatgcctcgcttgccggccgcgcggcgcgggccacgactccatccgcacgagacgggctacccacccatgggccgcgtgctctcctgcgttggcgtccggcacccaagacaccagcaccccgcgcggcccagcaagttaagggataagtcgccgccgcgcgaggacgcgggcgcggactcggctctggtccctccccttatcctgaggcgaccctcctggtgcgcgcgccaccaccgcaagtcgttgttgcaaccgcgagcctcgctcgtctcctcttcctcctcctcctcctcgacatggtcagcgagcaaacgg

SEQ ID NO: 47919 - DNA, 893 bp, Oryza sativa
tttgtacattttatcctctttttagttgttttctttcaccttttcttttgagaaaaagaccaacttgaataaaccaaaattattgaaggttatataagttatccaatcgtcgatagtattatttgcgaaaatttcatatttcaactttctattttctaaaattcaaatgcataacccatggatgaaattacatttgattttaaaaattaataatttacctaaaaatattttaaaaaatcagcatttgggtatattaaacccaaataaatcatgcttattccaaaataaatattattgcaagcataaaaggtgattttaaccatattatggaactaccttacacaacctactaaaaatgatatattaaacatttttttcatgtactagttttaaaatttcaaaagtcttttcaaccttaaatcataaggacatgtcatacaaaactattttaaattggccaaaggatgaaatgtgaatggtttgtaaagcttaggacggttgatgtccagttttagaatttaaggatgctaaaagataggaaaagtccactgttttccgtgcatgcttcccaatttgctaaaatatgttttttttaaaaaaatatgtctaatagtttcttgaaaattgtaataatctacttctaagtttgaaataattaatatttgcactaatagtttatctcgttttacatatcttttcaaaaaaaatttacatttctcttctatccagcacaccctagagagagtattgtagacttctgtataagttcaaggaagtaaagagaggttttgtccgattatattttgggaccttttttttttgccttgagaaaatgattggccacgacagtagcttatgatcggccagtgtgattgctgctcctcctaattaga

SEQ ID NO: 47920 - DNA, 1501 bp, Oryza sativa
ttttaatcttattattattatactgtttagctaggatgaaatttaacgcgagaattcttttgcatatttttttttagaaaatcatgaactgcaattaggagttggactttcatctcaagttaacatgcaagcttttttatagagatttcttatatgacttcttttgtatttctaaaagcaaacgaacttaaaatcggactcaaacatggatctctattttcaaaagtgaacgaacttaaaaaatgcccaaatacggataacgtaccaaaataccgacaaaaacattttaatttttcgggaaggctaaatggttgtcgaatgatttttgataactaaatcattcatgttttaatatattcagaactgttgtttaatacgttatagcaaaatgttttatgagatgatttggttgtgtttcgattttttaaaagattgaaaccttctcaatttacttggtgaaacattttcaatatgggttagtatatgaaacgccgggattcgtctgaacccgtccattttacccctacccctgatccaccgctccggcgagtccactagagaggacgaaaaggcattaatcctgaaaaaaccacattgttcttcgaaccccactgaaccctaaccattcctatggcccttggggaaaaaggaagagaaaacacgtccaagttcgttttgacaatacgctcctttcagaaaatcgaacaaaatccatcccctgaagcagatatgctacacgaatactacacgatggacgagcacacgggacaaggacagtgagccccaaaatgggcgagaaaagctgtcacttctcctggagaagaatctctgcctttccaccccccaaatttacgacgttcgtcagcggctcgcagtacagtggagtgatggctagccttgctcctcgaccttctcctctgacaaaagtggctcaagtgagcaatagtgtgtgtgtgtgtgagtactgatagagatatttatgggcgccccgacaggggatcctctgcccgggaatcctgtatgattgttgctctgcctttaaggcgttaccagctcggatccagtgtcgtgtgcctaacacaggacattgctcttgacatttccaatcgaccattcagagcaagtagagcaggcatattataaaccagtataaacatattttaaagagataaaagaatatagataagagtagcgggctacagatctatagccagctgtagcacggacttcaagacgtaatatgtgtatgatagatgtgaccaagtattaatagtatagtaaataactattgtatgaattgactattacattgactatagatgatttgaagttagtagtgggctatactattaaacttgatcgtatagtagtaagctagccagctaaatactgaggttgagagagaggagaagcgggctgtaaacttacagccggcttgagcacaagaatcaagaaactatgtgagagaaacaggtgggccctgtattaaattgtaaagagc

SEQ ID NO: 47921 - DNA, 1056 bp, Oryza sativa
cactgcttccttcgcttcgctagcggatcctgcagtcttccggagcttcggcaaacaactgacgacatcttcttcttcgcaaagctgaccacctagtactagttgaaatttgaagaaggaagaaaagggtaaaccctttgcaaatagcattgggggaaggagaaaaaagaggaatttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagggggaaaagattgagcaagaatgagtacaaccacagtactcagcaagccacaccggcagatgcatgattaatgcaagggagtacaaggggataataataggggttaagttttgcagtaaacagcatttaaaagtcacttagttgcccaaagctattttataaagacgatcctagagctacacagtattattaaacaaggccgtggacccacacgaacctgccttaacccaaggcctacgatgattcggaccgaactggcaacccgacctgggtcccagctcgtcccaagccaacccaggccaacctttccacattttagttgttaagcaaattttaagaattaaaccactaacttgggtacattgctaggcttgcccatatccgagggctcggctattcaaatagatttactctgatcagaagtgtacatctttacccacaaaacacatctttactccgcattccatggccttgaaacccatcgtaaacatgtgacataacccttcacccatcctagccgtg

SEQ ID NO: 47922 - DNA, 1501 bp, Oryza sativa
acattagtcactacaacagcttcaatccatctgaaaatgtttttgaatgaaaaacccaactccacgacatccctcacttgtagaaaacgaggagcaccgagctacaccgatcgcatagtccgcgagaacatcgatcgacaagtggaggagacaaaggaacaatgagcatccagtgcagggaacatctgatccagcacaatcgtagtcaatgttagagcttgatcattttgatgccattttcaaccttaccaaattttaataaaattgataaaaaatggctgcatttagtttgctgccaaattttagtaactatataagaaattctgtcaaaattttgataactataccaaaattttagcaatgccaaaatttagtaaggtttttttttaacatcagagtgaacaggtcgttagtatcagagtgaacaggtcgttagcaccaacaaaggttcatcgcgagctgatactgagaacctgataccgcgaacgtcctggctgcagaaagatgagaaaattcggcggcccagtagtcaacgacaaaaaagataaacctggcccactcgaaaagcccaccttttctcacagcccaagcaaagtgcaaggccttttttctccacggacggcctctgttggaccacgtgcgcgcgagcccgattccccgcggtagcagcatcccacacgacacctgtcgcgtcaacgcggcagtagtggttcctttcccgggaacaacaccttctaccacacgaaacacatccgcagaagaattcgcaatagttggatggggaagttcttaggcactgtcacatagtatgtttatactaattagaattattaaacgtagactaattagaattattaaacgtagactaatgataaaacccattttaaaactcttgactaattcacgagatgaatatattgagcctaattaattcatgattagcctacataatactacagtaagcattctctaataatagattaattagacttaaaaaatttgtctcgcgaattacctatcatttatatgtaactagttttgtaaatagtctaagtttaatactttatactagttcaacattcgatttgacatggcttaatccctgtatccaaaccccacctataaacgaccccattgcgggcccggcccatataacctgaaacgtacttgtgccgtataaaaagggagaagatacagcccatagtctcactgacactaggggctccacggagagtgggcccatcgtgtcagtgtcgtacaagcgtatctccctttgaccgggggatattcgaaacgtattccgtttcgagtgactgacgtgtgggctcggtggtagataaactcggagacgaattcaccgccacaaatatccccaacccaccaccgggggcccccctaatccaaactgtttctcggcttccgctacacgcctcgccgaccaccatgacgatggctgcggcgccggcgaggtcggcgggggcggcggcggagaagaggatgg

SEQ ID NO: 47923 - DNA, 1501 bp, Oryza sativa
catatacctcacacttcagatgcctcaaatgcataaacatgttgcgtggttgtcgaaactagatttcgacaataataaaagggggtggctatcaagcttggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatcttggaaggagtccggattacaaaagataatctatattcctaacggaatatgaagataaaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcgtaaccctctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacactattgtgcattacatgacaaaagcgtacgcggcgcctaaataggcatgctagccgactgctttttagccacaataaaagaaatccgagtggtttacactctaaaaggttcacgaatgaactcacttgacaggcatccgaataaaaaaactctaaagattacccatcaagtaccataaagattatggtaataaataagtcaaatagcctaggccatgactatttaccatgaaaactggcatataacacgccaaggaaatgactataataaaaacaagtcattcctagttaacccaaacagcttttgtagcctaaaaaagcttgcaaaaacagcataacgcctttctgtcggacacctttttaacttgcattgcaataattccaaagaattatatgaccgcataaaaaggatttcatcagcattgggcaacactgttgtgtgcataatattgccaaagcaaaatatgcctaagtccctaaggaacacaatgggccacgctgttaaaagtattgggctgaagtattgttcaggcctaggcccattagcacctccgatacccttaactgaaaaatccgatatccaagcggcgcttcgtcttccccgccggaactctcgccattttccccactccctgctacagtgcaaagctgcgccggcgaactagggttcacaactccggccaaatccacctccgaaaagtgcatcaaaatccttctcgtgatccaccgcctcaatccctcacctctcccaagccatccctcgaatcaaatcagcacatttgagtgaaaccga

SEQ ID NO: 47924 - DNA, 1501 bp, Oryza sativa
acagagtgtaacaacaacttaacaagggatagggtttatcatattttgaacccgactcgaatcgatcgggaaggatagagattcgatcggcaatcaagaaatccatctagtagcatctttgttacctgcggagaggcttcaatgcgctaccagcgagaagaaaccggcgcatgtccgccatgaatgatggcaagctagtagagtagatagatgggacggacaggtcggaaggagatggagctgacaagtgggtcccacatgtcggtgacccgagcatagaggtaggccgctcaggttcgcgatggctcgataggcatcctgtcttactataaagttatcccccactaactccttaagcttaacatgcaaagatgccacatcatcatccactgacaagatgccacatcatcattcactaattaacaagatgccacatcatcatccactaacaatcatcacatttaaacatcatgcaaacatgctatatcttcatagtttttataatttaaaagcttttcaaatataaacatattaaattatcatccaacataattcacataatgttttaatgtatatctttattatattttatgatatcctatatacttatataagtcatcctcacttagttagtgcttaaatgattaatctatggtccaaattatctctctcctttttttctctaattaagtcatatcacatcaattatttttagcctttagatgattaatctgcggtccaaactatctccctacttttcttcttccataaagtcataccaccttactttttacgaatgaattaccattctatatactatttaaatttaaattatcataaaccacattaatttacttaatctgatgttatctagctatcttacacgttattttttttattgttatcatactgaattctcgcagcaatgcgcggggtttcacctagtattttgaagggttgaaccctagtttgaagctgtcagaaaacaaagtgcccaaaacacacacgcataaaaggaagtaggcttcaggcaatatctaagggcaagtacaacggttcagcgagacccgtcgacatgcactgtttttttgcgaaaacccccccgcacggcgctcgcttcggcccatccgtcgtctcgttcgtcgacgaggccagcgcgtgcttccaggcgaagcgacggcgatgaagcccattgtacaacccaatccgggtaggctcgagaggcgcgggatcagctgcacgggatcagctctctcgcgcgcggaacaggttcgcgccttcctcgcccgcaaaatctctctcgcgcgtgttgaaatagccccccctgcgttccccatccaaccctatttcgatttggccaccatgtcgcggcaggcacggaaggaggcggcggcggcggcgcaagatatgctgaagttggatgcggctcagatgcgcaagccagctgcatcgcaatctcgaaagggtgcggcggcgccgatgcggaaggcccagggaggag

SEQ ID NO: 47925 - DNA, 439 bp, Oryza sativa
caaagaatatgaactagtctctgttttgctatgttttggaatccaggagcacatcaattgctaattggaagtagtctctgttttgctatgttctgtttctgggattgttttttttttggctattgtgaactgttttttgtgaactgaaacgtgtcaatggaatgtgaactgatgggtcattgcaatgtgaactgatatgatgtgaaatggaatgtgaaatgataaggcaatgccgtgtatgcatttgtatataaaatcaactgctctgtgacttgtatgcatcacaattgtggcgatggaggcctctggtgcctctggtggcgagcatcctggtggcgacgatgaggggtctggtggcgagttcttcgcctctggtggagatggaggcgatgaagatactgtccttgaagaaatcgatccagcggaagtatatacactt

SEQ ID NO: 47926 - DNA, 471 bp, Oryza sativa
tagtttggaccgcagattaatcatctaaaaggctaaaaataattgatgtgatatgacttaattagagaaaaaaaggagagagataatttggcccatagattattcatttaagcactaactaagtgaggatgacttatataagtatataggatatcataaaatataataaagatatacattaaaacattatgtgaattatgttggatgataatttaatatgtttatatttgaaaagcttttaaattataaaaactatgaagatatagcatgtttgcatgatgtttaaatgtgatgattgttagtggatgatgatgtggcatcttgttaattagtgaatgatgatgtggcatcttgtcagtggatgatgatgtggcatctttgcatgttaagcttaaggagttagtgggggataactttatagtaagacaggatgcctatcgagccatcgcgaacctgagcggcctacctcta

SEQ ID NO: 47927 - DNA, 336 bp, Oryza sativa
ctttgtgcgatctctggtggtgattctagtctgatttttgttttagatctcgcttgttgggttcgcggccacttcgatctgttgtaatggtagggtttattgcgatttcgagatttagctagttctagatccgtaatctgctattgcgcaccgtaattttgtccgcaatagggctcattatatgcggggtttaaatagggtttagtcctgagagtaataatacatctgtatcaagtcagttcagtgtaaatctagtgctgattgttgttgatctagcgcccccaacttactgatcttagtgatttttaaaggcttctcaagtctaattcacacaca

SEQ ID NO: 47928 - DNA, 1501 bp, Oryza sativa
gaactactgctttctttctttctttctttcctccactgatctgattattgaatgattaatcatgcaggtaagtctagtttagtgggcggtagcattatgctgtcgaccgtgtgtggatgccctgacatgtcatgaagctggactttgtgctcttcactgataattgattccatagtgaagtggagtagtagtagattctaattacttttagtttgttgttttctcttcgctttatctctgtattagtccactttattgttgatactactggtagtaaactcaagtgtcaacgccaacaaaattgtaatgttggcagacaggttaggcagcatcaggtgccagccaacagagactagctactagtcgatatgtgcctattttgtcattaagactcgtcgctgttactgccgatgccatagaccaaaacgccttgaacaacaagagagctgaacaagctattgctttttttgtaacaggaattttgaaggattggattttcaataatataagatttaatcttttgaaaaaaaattctttacgtctaggatctctcttttgatttatgttttcctaaaattctaattctaatgttttctcgcgttctatccaaacagtcgttcatgtaggtttttcggtattttctatccatcggatttaaaaatgtcaagacgctcgaggtctacgtttcgtttcatgttttgaaaatactgggttgcaaaaatataaaaatttacaactgcacttagggtgtgtttagttcttaaaaaaaagttgaaactttataaaaagttatgagtttgaaaaaaaaattaaaagtttatgtgtgtaggaaagtttttgatgtaatatgatgtggtggaaagttgagaatacggaaaaactaaacacggccttatattggaataggggagatatatagtacttcacttgacttgtccaaaagcattcaaatgcccaagcaaatcttccagcagagatcgagcaccctgacgagtgatgagcagagtgtactggagaggcttttgtgtgagcttcttgctttggctttacgcgaagacttgagcatcaatcagttgatgggcagatgatagacgaccagaggcaggcgagtagcagcagccgtagcacagcacagcacagcacagctgctgcctgttagctgtagcagtagcacacatgaacactggctgcagctgcagatggtgctgtactactactagttcatgctaaaattaaaagtttggttaaaattgaaataatgtgataaaaaaattaaaaatttatatgtgtagaaaaattttaatatgatagaaaaattaaaagtttgaagaaaaaatttagaactaaaccaggccttgctcggaaagaagacgacttgattagccttgcttcccttccctttctgctgatgcttggagtaggctacagttccagtgccagtggcaaagcaaaccatgcattgagttcagatataagggccctttgaatggcacgattgaaa

SEQ ID NO: 47929 - DNA, 1501 bp, Oryza sativa
gaaatatcacatgcaataagtgatggatcacgtagttaaatcggttataaattcagttgtatatatgtttacatttacagtagtcaatttacatttaaaaaaacatctgaagaaattaatgatcactagaaaaaataaattccataagaatatagaaaataataattataaagttctgagacttaattaccgtgtatataatttttttagaaaaaaatatatctttgagagatcacatccactattgtcccataaaagaaagcatggccaattcatatatccacagtgccaagcactaagttttccatttacatcagagccagccagttatggtgagggggccaccgtcctaatgcttcttgtgggccccatcacatttattttaattatcaattttcttttccaaaatggatcactacaaattaaatgtcacagcagtatcatggtgtgattgatgcctaacaagagaatcaggagggtgcacaagtcattcataaccatagtgtgtagatatactatactagaataaatacatgggtgttgacaacttggactatgcaattgtttttaattttggttgtgcttatgttggagtaatcaattttctacggcacctaaatcaacatgaaatacatctaatttattactagttcacatttaatatgtatataaaatatcgagttttaaattcagcccaccaaaaaactgacaaattgtttgctttttatttagcaccataaatgtgcactagaaaatcatatcccttacaatccagaatagcacatttttaataggatctgccgggaatctattgttggtctctccatgactccacttttaaatggatctgccgggaatttatcgttggtctctccatgactccgtttatacgagcgtgtgttatagtaaggtacttttacagggggacatttaactttttacctattttaagacgtgacaattaattatttaacactcgctttctataatatatgggtccaatgataaattttttatcaccactcgtatgaatgtcagataattaattattccatttataggtgtgtgaggtgtggtgtgcatgtgtatttgttgacgtctctttctcccatgccatcacataaaaaaaggaatagcgcaattttattttgtagccattccatggttagactgcagcatgtattgttgttttttaaaaaatgaaaagaaaaagaaaaaaaaaagagagctccggccctttttgtgtggggggtaaatggaggccggcccggcccatttcaaactaaatgtggcccattaaccaaaacattatccacctcgcccacttcacttccccctcccatctcccatggcaaccacggcggcggcgtcgccgccggcgatcgcgaccgcgctctccgccctgctgcggcgacagaggaggagaagcagccgttgcgtgggggcatcgcacgccagatgcctcgccgccgacgcgaatgctgaggcggtggcgccgagc

SEQ ID NO: 47930 - DNA, 1151 bp, Oryza sativa
cgtcgacccgagccgcgccgccgcctctctccgcttcggtcgccgtttccgtcgtcgccgtcgacccggggtgagccgtgaaccgccgcttcatttccccctttccctcccctctctcggccaccgctccgccgtgcctatggccgccgccggcgaccataagggcgcgggcgcgccgcctcccgtcggctgtgccggcgtggccgccttcgggcgcgccccgcggctgccgtgtggggcccggctgtcagccgcccgcgcccttaggtgcggctgacacgagggacccacggcgccggccggcgtaagccgcgtgctcccggtccaccgtggatcgagaggctgccgtgtgggccccactcccgtggacccggtccgcgcgctcctctctcccggctgacgcaataaatccgattttaaattaaaatttaaatgaagaaattcgcaaatatccatttaaagcgcatataaacctcaaatggccataacttggccatttgaactcggaattggaccgttcaagtctctaatttttccttaagaagtcaagaacccatttttgtgctttgtttctgcttgttatatggagtttattagagtaaaagccgtttcttttccgttggtcgtgtagacgctgcagcttcggaagatccgctcttcgtggaagttgaagccgacgtttgggaaagtgagcaaggcaagtcacatcatccttgagcatattgaatcccagtttataaaattattttaatttaaattaatgcattaccgctttatttaaattcccgcgttatcactgttttatttagccatgcctatttacctttgttaagacattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcacttggacactatgaaatagttggcttttgttggaattggacacacacctccccctctattcaaaacccccaaaatggttttaggctgggctcgaggtgcgtggttaggtttggttagtcgtacctcggttactataaggattaa

SEQ ID NO: 47931 - DNA, 411 bp, Oryza sativa
ttgtgacaccatttgcattcagctttccacgcaccatttattttcttcttaacaaaatcttgccatgctgcagatttcagtctcttattatcatgttctacttctgtaccttgtgaatcatttatttcgacgcttggagcattggttggagtgggagtggaagtggaagatggtgtcaatgcaacttgtgactcaacggtggcagcagggttcgacattctgtccacaaataacataattcaataatagatcacaatctgctgctatgtgctatgtactaccaaatctaccaaatatacactgaaatatacactgaaatagatcacaatcttctgtttcataatttcattcacaaatcacaaggcacatttggagtattggagatggagcaatacctctcactctttgtga

SEQ ID NO: 47932 - DNA, 463 bp, Oryza sativa
ctgtgtaactccaggatcgtctttataaaatggctttgggcaactaagtgacttttaaatgctgtttactgcaaaacttaacccctatattattatccccttgtacccccttgcattaatcatgcatctgccggtgtggcttgctgagtactgtggtcgtactcattcttgctcaatctttccccccttcagtaagagaagcttcggagaagatttcctaggtggagtcctggcttataccccagttgagcgcctgtgaagatggagccgtaggcccgctagtccgctgctgtttatttttgattgtcaggcttgaagcgcctttgtaataatgtaaatattatcgatataataaagatgtgtcttttatatcatgtttgtttggtgtaccccggcttttcctgggacggggattaatacactagcgttggggaaaaggcaattttctcggtcgcgacagcca

SEQ ID NO: 47933 - DNA, 337 bp, Oryza sativa
ttggttagttcctaaatagcatacaggattattgttcactataaccaactaaaatatagtgattgctttagtgagttataaaaacaaagtagatattaattgcttagacgtggtgtttaggtagttgttatccagtaattactgcgtatcccacagtacgtttgagtggtgtagaggtggtgacagccctcgagatcacttaagtcctccctatccgggtacgtagtagagcgatatctgggaacaacgggtttccagtgcctgaagtattgcgttacgattaaaattaagctttccctagatgtttctcactactaaatcctctctatcctagcct

SEQ ID NO: 47934 - DNA, 1501 bp, Oryza sativa
cgttcctcctcgccggctcgtcatctcgcggcgccgcctccgtcgtcggcattgcagcggcgtggaacacgccgtcctcgtctccgtgcagccgctgccggctgccctcatcgcctcctcgccggctccggtcgtcgtcgtcgtcgtcctctcgtcattcccggtttcgctcgttggggcgttcgtccctccgtcaagccgttcttgtccgtcgtccgcatccatcaagtgtgccgctgcagccccatcgtcgtcttcgtcctcgcctccgcgtcgtcaagcctcgtgccagccgcgtctcaccttcgtccaaggatcgccgccgaagtcgttccctcgccgtctgtccgccgcgcccgttcgtcgttgtcgttcccacgcctcgtcgcgtggtggtaaggtctcccctcttgctgccccgtcctcgtcctttcgttgtcgcccgtgctcgttgtgcagttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggactccgtttgtcggccactcgcctcggttgacacacaggatccgcttccatcgacccgtggaccgtctctgtgtactcggtcttccgcggtcctttttgttgacatgtggggtccgcatgtcaacggcgcagccttcctgtcttttccaggctagcgcttacacatgttttatagttgcaaagcttaattataataatccacaaatctccatatgacagcattaaacttcggatgaccttgtcttggtcatacgagctccgaatcgacccgttcaagtctcttaatgtttgttataacctaaagaaccctgtgctttctttttatgtattgttattgcttctttataggcttgtagctttgcttgtgtgcttcgcgtagtcttcgtcgttctggaggttcccgaagcgtggttcgtggtcgtcgccgaaggttcggaagtccgttctctctgagcaaggcaagtcacatcatccttgagcatattgaatcccagtttataaaattattttgatttaaattaatgcattatcgctttatttaaattcctgtgttatcactgttttatttagccatgtctatttacctttgttatgaccttattattattgctattgttattattaccttgttcaccctagaataaacaaaaccccaactagcggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaa

SEQ ID NO: 47935 - DNA, 842 bp, Oryza sativa
gttgatggaaaagaaaaccaattaaactgtgttgggttaaaaagccaatgagacagtagttggggaataggagtttggatacgccttttacagatcaagataaggattgttggatgaaacccataagggtacccgccatgcctctacattgataagttcggatatacctgcaaacagttaagaagatccaggagacatcaatatttgagaacataatagtcgatggttggtaattagtcgatcaggtatcagaaaagggtcaaaggtgatatggcagaagaacaatatggatgtccccatcccaaggaagcactaaaccctagtggcatagatacagatagcaagcaatgtatttccctgaaggtagtcagtgcagctttttgacgaaccacatcaaggtttcaccgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgtctgcatcgctcaaggaagacccctgatagtaattgcctcccccacaacagtcacctttcattaagtaagcaagatgacctaggtaaaagtgtttctatgaaggcaaggagtgaaatcttcaactcggtatcagatgctacacggagtgaaaagtgcaagcgcaggttaacaggcgacgccatgtcttgggagatgatccaatgggaaagaacacatcaaggctgaaggtgcacaggaatacgttgaatgctaaatgatgacaaca

SEQ ID NO: 47936 - DNA, 505 bp, Oryza sativa
cgggggtctccgcgggaaacggagggcaagccggggaaagagaggccactgcgatgctggaggaggcgacggcgcgaccggatggcgctccggtgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccgtcggccatggaaagcggccggagaaaacgcgggcgttcccggcgattgggggcacgatccaagggggaaattgggggggaattgaagaggaatcaatgggatttaaaaccccccaattaattttggaatctatggtttgatttgcgcggatttggaggaggaacggctctaggttttcccggagagggagaggaggctgagcgggaggaggaagaaga

SEQ ID NO: 47937 - DNA, 1501 bp, Oryza sativa
aaatgtctctttggttaatcgcttgattttcttttccatcatcaggttggttattaactcgaggttagaacatagttcctctgaaatgagaccctaggtctcctttgacagtaaacaattatacacataatcccatatcagcatcttccgaaataatcctcatagaacttgtttttattacacatgtctcccttattacatgaatacaaggccttgccttaaacaaaaagggaaggtgcttaacatcggtacattgcatcctcaacatgaatcatccataagcatagcaagctcactgtttatagacatgaatatatttatgtattacatgattgctgcaaactttcgattacacaatgataagtagcgaactgaaaaccacaaacatggctgctcattttgattctggagagatatagctggcattgttctagtgactgcatccttgattggttctgtgatgatgtgataggactgcatattgctatcattcacaggagaagcttccttctgattgctggttgaagcgaataacggtcttctgcttggtatcatcctcctgaggttgattgcccttcgctcggcctggagtaggtcggggagagacacaacttcttccatcgacgacaattctttgctgaggccgtcggtgcagagaatggttggtgctgaaggtattattgctatgatttattgcagagtcaggtgcagcaagaggagcattggtgctgtggatgatatcgtcgatgttgctgttggagctgactaactgacgagacaatcgtagggttgttcgttggatttctgcggtcttggtcaacaacacactgagttggcaatccttgggcacatggtttgtaccttcgcacagaaaacatgtgaccttgcgggtgggacattcacctggtggatggtcttcctcacaatgagggcagagtgtgaaacacatgctagcaacgtgtccaatttctccacaacgggggcatgcttttgattccatctcttcctcgccgagatgtcggagagactcatcttcataatccgaggagacttgatctgacccttcactatcagatactctgccgccatggcttaggaggtgctgggtcaactgtcgtgcacctcggaaggtatttcctctttgacgtctaggaatagttatccctgcgggaggccattcggtgctgctaatagccatcttacatacttctccttcagttcgcatcggcgcttttctcttctgattcttactcttcttgcctttggcttgcttagtacgtgaccccacgtggtacgaaaggctaggaggaaagcatttcccgggattcaatggattctctccattgggctctctactttgcacaataggctgcaagcttgacttggtgcgaggaggctggtttagcgatgtctgccctgttaaaccaaaggaaggggcttctttggcatatacccatggacaattcagggcatagtgtccttgttctctacaatcatgaca

SEQ ID NO: 47938 - DNA, 490 bp, Oryza sativa
tctcactttcttcaaatagggtagggttagctgtagtgggttgggctgggcaagcgggaggtattatggactttgtaacttcggaaattccgagagagttttcggaaagttttcgaccgattccgagttccgtcggaaactgctcttatcattttcgattccgtttccgagaaaatatttccgtattcgtttccgtttccgaaaaattccaaaaaaattccaaccgaccgattccgttttcgaaaacctgcccggaatccggaaatattctgtaccgttttcaccccttaatggcatcgatcaaagccacttctgtccatgctatacatgcacgtgcgtgatctacctacctagacagatacatgcacacagcaaccttttttatggaatccacacaacatacatcaggatatataacatattggctgagatcatcgggagatatcgtctctgattcaatcaagcatgccatactccgctgatgacacat

SEQ ID NO: 47939 - DNA, 1501 bp, Oryza sativa
tttttttgtgttttgtcatttaacaagcagtgttaggagatgttctagctactccagcccctacaagtgtcaatcagtgtgtgcaagatcgatccacaggacaagaaagctagagctgcagccagtacacgaaaaggctcgatatctcaccacgagcgaaccttcagttgctttaaaattctttttatcatgcatggtgccggcctggttaaattagtggaggaatagaatcacactaagttagatgtttaatcgcaagaaaatggcgtccatccatgcccgacctgacctgacctgggggtggtgaatggaatggaaagaaagcctagctactagtactagtgattccatgggtgacacagaatcgatgcgagtcttgtctgaatccttcgctttgctctgcatttcattgttaggcaggatgcagaggaagaagaagaagagggctccttgtcaatgtcaactcctccctcttcttttaactttttttttgctttgcatcttgtcgccaactcaattcgccatggccgatgacgacgatgaccaagatgaggtgaggcccattcacttagcgggccgaaacacgggccggcccagcacgagaatcaaagcagagacagaccgagctgtgccctagcacaaagccggccgccgccgccgcgcgctcgtctcgttcgcctctcctctgcgtcgccgccgccgtcccgacgattcaaggtatcctactctccctattactctggttcggtagaattaatcttggtggtcagcacttggttggttggtcgaatatgaattagcgtatgagcagctaacctttttgattcatgtggtgcccaattgtttcttgtgaaatcgcaagaaaaaaatatttgtttcttgtgatgtatagggttcgttcctctggttgatttgatttggttatggcaaacggcagcttctgcaaagaattttactactcttgtcctgtttgtgcaagcttaaggcttctgtgtaactgtatagaatgcaacaacagtgtgttcttttgggaagatttggtcgtaatgtgagaggtcaatgggtcatagctctgcatcactctagatcaagtttggtgaatctttatcggacattttacctgtcaagaagtgtgtaagaagaacaactaagaaaggcaatcaccttctttgcactagaactgataggcaagatagaactcatttaactgtagctgcaaaacatcagaactttaactcgtgtgtttttaaattccatggacaatggtctgcttgtactaggatcttaaatagaaacgtctgattctacatatcttcacaaaatgcttagtacttgctgctctcaagcacttaattatgttcaacccttcttttgccactgctgctggtttcacaccttccaattgttgcgatgatttccctatctatattacacatacaaattccagcaaaacctgttctcacattcagctgcgaattatgttggcaggttcaagagtcga

SEQ ID NO: 47940 - DNA, 1501 bp, Oryza sativa
tgtagatcacattaagctgcattttgtgcagagagatttgtgttaggtttaacaagccaacaaaaaaaaattagcaaaatgtaaggctgtgagcacgtatatatgacagatgaagcagaagagatgttcagagatcccgtttgtgcagatatttgttgcacaatctacctagggagcttcccccccccccccccccctaaaagtggtactgagaatacatgagcaggttaattagattgtaaagaatgcacaaattgctttggaaaacatcatctgaactattcttttttgtacgaaataatcatctgaactttcaagacagcaaggtttgacaagttgtatcatctcataaaagaggcagttagctttgaccctttgttttaaaataaacacaaacaggttatatgaattaagcaagtactagttcatataaataaattaagcaacacacactgatgactggtacagacaaggaagttcagtagttgaggtaagcaagcaagcaagcgtgcagctatgaggttgctctcctactccaaagctactactaatctactatacctgtcggcatgatgaagaagaaatgtgtgtgttcgttcttaccacatagcagatgctggagatcccggatcggcgggatcgccagacgcggatggaggagtcgacgacctcgatggagacgagggcgccggtgatggcgccgatgccggtgccgcggaagaggccgctctcggtggccagcccgatcagcccgccagtcaccgctccaagaaacagtccagctgcacacacacaaacacatccatgttaattaacattcatagctaccaccacagctttccggttcaagattcaggcttcaagattgaacaaaaaaaaaacgagacaaatgtcacactctgaaaagcattgttcagagaaaagaagttgtggttttaagctgtgcaagaacccattctgcacgtatatgaccaaacaatattagtatctattactttgcacttgctcagaaggaaataaaacagtatgcaaattaacagtgccgacaaaaaaaatctgtattttcgttgggagaaccaattaagcaagtatcagtatatgctgccttgaaaaaggaaatacagacagtgctctgaagattgagcactgtaaaatccatccatacaaagtgctgatttttttaagataatggaagctttattaagactcaaatacaccaagatgatacaaagcgctgattgagcagcttgagctccatcagccgatgcatggatgtcatgtcctctctcttcacacagattcatccacaaagaaagagagaacccatcatagaagggaattgaaaagggaaaatgtgaaaatgagttgagtattggtgatgaaacatgcataaaaaatgtcccccttaatttttcttcttggaccaagaaatggaaatgaagcaggacaagaaaaggagggcaagaaaaagaaaaaggggaaaatatatatctgaagtagc

SEQ ID NO: 47941 - DNA, 337 bp, Oryza sativa
tttcataattatttaattgacatgcgataaaaatccctctccactaccatactacttttagtgtcttgtctattgggctttaggcactgttcttttagcttttcttttttagatttttgacatggattatttgctttgcatttaaagaaacgttgtttttttaaaaaaacactatattatttagaccactttcttaaaactaattttgaagtttatttatcaaaacattaatttattaaattaatcaagtaaacaatccgcgtaaaaatctgtttgaatgcaaagcttaccttttactgctaaacagcatcaggaaggaaaaaaacagtgtaagcga

SEQ ID NO: 47942 - DNA, 1501 bp, Oryza sativa
ttagtcaagtacagaacaaatgtttcttattttttgtacggttaaattgatttcagcatgaaaacatagaacaacgacgtagaaaattgtaacccaattcaacaagaatcaagagagcacaatttgggtatggtgagtgaattttggatgaattactttatccaataaacttcaagcatcttggttaatattcatgcacaatgaggtgtgttttaatacttttttttttgaggttcaaagagcaatataatgctgcatgccatcaattcagtgcctgttatcatggattatatatttgattgtagagattttctatacttgattatagagatagatcaaatattttcaggaataaacttaaaaaatactacatacgtaatctgtagcaatatagtacttcagaacacaattttttttgaacgtttagaagtgctataccttcatagtataagctgaaaaagacatggcctaagtacatagttgcgcccatatttcatatatctgaaaaaatcgaacaaaactctaaaacatttctctttctctttagagaatgataatgatttacatctctaaccttttccattaagcatacaactaatccaatactctctttagggagattctagcaattgcaacatcttccagaatctacaactcttctaaacagtccaaattcttacttagggtgtgtttagttcacgccaaaattaaaagtttagttgaaattgaaacgatgtgacggaaaaattgaaagtttgaagaaaaagtttgaaactaaacttggccttgagtagattttaagaacagtcatagaatatagagaataaattagaaaccagaaatttaaaagcgcaacctttttctaattgttatcaggcggttactctgctcattaaatgtttattagaatattaatctcccctaaaaaggattatttccctttacacaaaagtatgttgtgcattcctatcctaattaatccctcacccccacaggttagcaaaaaaagatatactccagggacctaggcgtaaaaagccccctgcctgcctgccgtcccacacgggcacgccgcggcggccacgttctcttcccgctccgacgaattctgctctccattctcctcgccgttgacgaaaaccaaactaagccaagactttgactcgctcgtcacctcgacctcaccatgcgcgtcgctctcctcctcctcctcttaaaatcgatgtcgatggcgcgcaccaaccttcatcttgctgcccccgcgcgcacgccacctcgccccgtccccaccccaccatgcctcactcctcctacctcgccctcgccctcgccgttgcggcggttcttgctatggccgccgtcgaggtgtccggcctcggcttcgacctccaccaccggtactcccccatcgtccagcggtgggcggaggagcgtggccacgctggcgtgtcctggcctgccggcgccgaggtgatcggctcgcccgagtactactccgcgc

SEQ ID NO: 47943 - DNA, 1501 bp, Oryza sativa
agattgtttcccctctttcaatttcatcggatcgggaaaggagcggccggatttggaaggaaacggcggcggctcgacgctagggtttcgggcggcggcggccgaaggttgacgacgactccgacaggcgggccccacctgtcagcgacagcgcgctcgcgcgggcggctgcggctgcggactgggccgacttgggccggggagagagaaagagggttttgggccgactttcggcccaaagccaaaaaagactttttaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaatcatttctaaaaattccaattaaacaaaaatttataaattttgaatttttagggtgtgacacatacaagctatgctagagacaaataaaccttcaaagtattgctggcatgcacaagaaaataccatatgcataaacgaagctctcttttctcaatttttttcattgtcatattattgcttgataaaaccatgagctataaactccccctcaaaccatgccaaaaggatgaattaaattttgagtttcccttctttccttttttcccattacatggccctaggggactatttatagccccattacaggttcttactactagggtttaggttatacaggggaatttacatgattacccttatgaaagggacatttacaggggtacatgatgatataggggctcatgggcccctgattggccgtctggcgattgccggccctattgcccctaggcttgatgggccagaaaggtttcttcggccctcgcgggggcgaacttaccaaggcgaagtcgtcttccttcggtagatagtcttcgccttgcacccttcgcctgagacgcctctggcctggcaaggcacttgtacgactcttcgcctcacgccgttcttgctccatagccttcgccatgggtttcggcagatttggtcgaagggcctcatgccatccgccaacaagcccctcacgggcaagggtgagattggagcttcggccgagaccgtgcaaactgtgtggtatggtatgcggcaccccctttcgaccgatgctcctgccgaaacctacattatttctgcgaatgaagtttgttatttgtgcggctggtattattttgccgcgcttcgcctcctgcgtttggtggcatattcatatatatatatatattatatacattttttatatattttcttttcccgagccgaaaggaacagtattgggctttcccttcgtgggcttttcaatgtgccgctcgaatggtgggaagttaccgtttcacctacccttgcgacacgtggcgctttattgctggtgggtaggcgaacggtcgcccgggc

SEQ ID NO: 47944 - DNA, 1501 bp, Oryza sativa
actgggataaaaacacttctgtagatgcattgggggctaatgtgtatttgttgttccaatcctctcattattcaagacccatcactagatcagaacatagatcaagacacaaactagttcttagagcctctgagatgttcagtttctcaatgaaaacaactgaaaattgcaaactatataattccattagttgtctggagagcagagtgtcacatgagttagattgttatttctataggtcatgttagtttcagatttttagtagcttaatagggacaaagacaaagacaaagacaatcttgagtcaatttgttgaacgctaattacagcagaaccgaaagtgtgtagaactctagattctactagaaatggtcaggcatatcggaaaactgaaagatacagtctgaacagaaacatttgaacaaaaatagtttgaacaacagtcttgcctttgtagtttgcacaatgtgaagtagcacataggaattgctcactttggcacatttggaattgcttgggtctccagataggcatcatcggccatggccccctaggctcctcttgctctgaactcctgcagagaaaaacaatagaaatatgtagctaaattttataaaagttgacaaagacaaagacaaaaccaacccagtgccaagaccaacctattgacttaaaaaatgcagggacaaagacaaagtcaaagacaaataagacaaaatacaagatgcttacaaatgctcaccgcaaaaacatagaacaaaatagtagtttgcacaatgatcaggtatatctgaacataagaattgaaacaattcctgcctttgcactttgcacaatatgaagtagcagcaaaaacaaaaagcagaaagttgagccatgaaagcggcagtagcagcacaacagtgtgaatatgcttgtctattcagttagtactcattaccaagtttgcatgatgtccatgacactttacatataatctgtagagaagaaatagatacctcttgatctaacaatgcccactgatgtatcatgtcaataactgtcttggagcaaatgaaaatataaaaatctaacaaagacaaatacaaatacaaagacaacaaaaaaaaacaaacttagagagtgtgcacaaagctgacacgatataacttcacaaattacaacaaatcacaaatattacatgttgtgtttttcaggttgggtgaaagactcacataaagaagattatgcaatgatatctgttcaaatggtggatatgtatgatcagcaatccttaatgggccagtagatacatacattaatcacacagaggcaatatcataaaacagtacagtccagcatcatttacatatgcatttgctgaattgcagtacaaattgcaatcatagctacacgaggtttctaatggagcgtcttatatcgtggagtgccaagtggaatttgacctttccttaatggctttcaaggttattccaacttatagatattgtttacacccaaa

SEQ ID NO: 47945 - DNA, 1501 bp, Oryza sativa
tagatgctttatttgcagtagccttgatcctgctcttgatctagcagtagattaatttcctgcttttgatctatatatatatgcatctattttatttgatgaaaactgaagaaaaccgtgtgagagaaatcattaaaattgatgggaaaccctggattggagaagtgcctaattcggctgggccgaattggccgactcgcccacctccctcgcatctctctatttctctctttctctgatgatgccatgccgggaacgcggtgacatattctcagtctgtgtagtcggacttagagacatattggccatcattcgccgtcgctgttgggtacgccgtcggccttgcgtcgatgccatcgcaggaaaccgccgtcttggagaaagccctaaacccatatcgccgttgccgctggagttaatgccgaagcgaggcgccaccgccgttgacctcccatcgacgctgccgtcgagccgtggtgggaggatgatgggtcgtcggctgtccactaccggattaacctccgccgagacgatatggccagatgcaatttggttgccattgttagggtctcagttgccgtcgttgagttcgcctcgccgccgtcatgaggatgcgcgggtcgacgcggagctccgtcgtgtgccaccgagccgccaccgcaccaaattgccacacgggagtgatgtcgtcaccgccgtcctgccaatcagggtagtggatgggtcgtcgatgacctcctcgccgtgcaccgccctaaatcccttcaaagtcaacagtcgacggcctccaacgctgccgccgtgcccgaggggccggtgcaccgggcggtggacgccgttgcggacaatgaatgggaaaggagaaactctaattccccccttacctctctcggtcacttaggcgaaccggctgggctggtctgcctccgcccgaccgaataaagcccaacagtaacgagacagcccaaacaaattaataaaaataataaacctggaaatcctcatgggcctagagttttggaaattcggcccattaggcattttgggctacactgtgcttgctagcccaaataagatcgtggcctgaacggtaattcggcccgattaatttcggtttattgacaacttgtgtttaagcccccggagtgttgggtttttatgctatagttcactgtttaatgcaattttacagtttgaaccttataattaacaagaattatattaattttctttgtgtggctatgtctcgttgcttaggccctgtatagtttggttttgcgtgtgggtctccggactcgtaaataactatgtaatggtgttttttaagcattgctttgcttttaaaattgatgcaattccaactaaataatctagagatggttttctaggttatgatgcttccataaattgtgttcacatagtgtagaatccccccttggaagcattatgatgggtttattttcctgcatttatgtgtgatggttttctgtgtggcataaat

SEQ ID NO: 47946 - DNA, 1501 bp, Oryza sativa
gggcgaagatcctttcgacaagccaactggtggtgccccaagccgctccatcgcagccggcagcggccccgactgcgctcgccgctgtgcaggcccaagtcagccctgaccccgaaacacaagccgaagccgacatggaagccatgcgacagaacatgacacggttccaagacatgcttcgccaaatgcaagaacaacaacaagcatacgaggcggcaaggcggaccaaggtcacgtcggctccaatccttcagtattcggcaggttatgtcccaccacaagtccatccgcaagtgacgacccagccctttccgcctcaagtcgcacaagcgccaatgtacttcgccgggcagcaatcggccgcagtcgctgcccaagtacaccatcaaccacccggccaagcgccacaaacagtggcggaaggggcttcggctctgcaggcgcaactccaagctttccttcagcaacttaaccaaccccacggcatttcaactacaaccccatcggcccacccagaggggactacaagtcaaggtgcgcctaattggttgccaccgattcagccgggcctgggagtttcgctgtgcaatcaaggaccgcaattcgacttcgtcaacgctgctcaggcgccaaccgttcggcagcaagctccaactccaggcttcggaacaaaccaagcaccaatccaagctgccatgacgtggtcacaaccaatttttgacccatccatggcggctcagcaagtacctccagttggagccgggcagccgaatgccatggcccaacctcgcgcacaagctgcgatttcgcccttcgccacaccgtacctgcagcagggtgcggtaaacagggcgggaggcgaaaaggggctaccgttgagtgggggaatcaagactcgtccaatcccaccccagttcaagttcccacccgtcccgcgctattcaggcaaaactgacccgaaggagttcctctccatctacgagtcagcgatcgaagcggctcatggtgacgaaaataccaaagcgaaggtaatacatctcgctctagacggcatcgcccattcttggtatttcaatttaccagccaatagcatttactcatgggagcaattgcgcgatgtttttgtccttaactttcgaggcacctacgaggagccgaagacgcaacaacacctactcggcattcgccaaaggcagggggagtcaataagggagtacatgcgtcgcttcttgcaagcccggtgccaagttcaagacataaccgaggcgtcggttataaacgccgcttcggccggtctgctcgagggcgaactcacaagaaaaatcgccaacaaggagcctcagatgctcgagcacctacttcgcatcattgacgggtttgcaaggggcgaggaggattccaagcgacggcaagctatacaagctgagtacgacaaagcctccgtcgccgctgctgaagctcaagcacacgttcaagttgccgaaccacctcccctcttcgt

SEQ ID NO: 47947 - DNA, 227 bp, Oryza sativa
atcggacaaaagatagctgatgcagccgatatcacgaagatggttatataatcgtatacgggattgatcgacgtgctgtgcaaggattgccatgatagagataagctcacggataggcaattgtatctattaattagggtattttaaatagtttctttaaagatatgtttcggcaagagtctgcttaaaagacttgtttgtatcttaacgattgtacccattttaga

SEQ ID NO: 47948 - DNA, 657 bp, Oryza sativa
gattaatattgtttattacttaactgttttatcaaattctcaaatgtttgctaaatgctgcttttgcaaatgaaaccctactatgccatactttgttatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcgccgtttatctttttttccgctgcttagatctttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaccgacttccgtcgatttcgagggtaacttttatttccgctaaaagtttttggtttttgggtataccaaccattcaccccccctctggttggcttagttcttgtgattcgatcctacatggtcagttgtttttattttatttttaggaaagattgtttacagtctgatcaggacttatatcttttactttatctttagg

SEQ ID NO: 47949 - DNA, 446 bp, Oryza sativa
tgctgcacgtgatttcttcgtatttgggctttttaatcccatcatgggctgcgggctgtgggctgtgggccatgtgaactagtgggcttttttgtttgtatttttttgcacaaattgtgacgggctttttgtttcttcaaagaaaagaggatgtgggctgtggcctaacaaaaaaacagaaatggactgtggcctaaaaaaaaattagtaaacagagtcacgctactttttttctgcgcgcatcaattgtctgtgcgcggatcgcacggccagcggaaaaaaaaggctgacaaaccaaaaaatttcagccccatgttacatacacaatccctattatactagaaaaaaaatacacgtacgttacaacggataaaatatttttagatcgttatatatgttactctttcattttataccaaaagcttattccttccttcattttcagt

SEQ ID NO: 47950 - DNA, 216 bp, Oryza sativa
caattccatttattaaaaatacttccttagctcaaataaatcccagaaaaatctaggaattatagaattaagcaaagtatttaatgaaattttatctggccccattttatattggaatttattaattaaaagttagatcttctcttctaggcttttaaaataaattctaaaaattccatttaaacaacaatttatatattttgaattttcagggtg

SEQ ID NO: 47951 - DNA, 341 bp, Oryza sativa
aaatattactatatttatctacaaacctagttaaacttgaagtagcttgattttaaccaaagttgaaatgacttataatctaaaacgatggagtacctgtatattaattattactatcatgcgtgcatcacaaagagtttgtgttatcgttgactgtcaaaataaagcaaaaatttcagatagaggtcccaggacaatgcctacaaatgtagaaacttataatttcagtaatcggagtactaaattgagtaattaacaagatatataggtgtctctttcaatctatgcattttgttgccatgtgagagatgatgtgctttgcctaattttctggtgatgtg

SEQ ID NO: 47952 - DNA, 1501 bp, Oryza sativa
ctagtcttccgctgtttctcgtttgtctttgtgtgtgctgggccttcgctgcccatgtaataaattatctatttacgcttccgcttgataaactctgaaatgtatcaactcttggtgtaccttgcctcctgggacaaggaataacacacgcacgtaaggaacgcccgttgggttaattccggtcgtgacaagttggtatcagagcccccttgaccctagtacgagccttagatcccaagccttagcaatattttcaaaaataaaaatcctttcttatttgtgaaaatcctctagtctctctctgtcctgctgcttcatttatcgccaaaatctgacttttaaatgttgcttctctttttgtttttgtttgtagatggccggcagcatcagccgtcgtggtccagatttaaatgttgcttctctttttgtttttgtttgtagatggccggcagcatcagccgtcgtggtctggacctgactggtttcgtcttggagctgcggggcatgtgcgttgtcctggggtatccgcatggagtggactaccagggcaggccgctcccagagcaggagggtgacgatgcagagccccacgctgcttgggaggttactgcagtgatcctcaccggctcacccgagaggacttcgttggcagtcaccgcgggtggagattctttttccgccgcttgccagaacgccgctctcctcgctatcggcactcttcaccagcgttacccggacgagttgcagcactcgccctaccgctaccaccctcgtcgcggaggagcccgcgactacgccaccttccgggatgctagctcggaggatgacgctaccatcatgcacctggcgcgcatggtggagccatacgacgcggctcgtatcgacttccatcagatggtgcgccgtgggatggtcgagaacaacatgaagatcctggagctgcgtcaagagaatctgcagctgaaaaaggacctagacgcagtggaggcgcaactgcatcagctcaagatcgcctagggagaggtctgtcgccccaagcgccgccgcgtctgccgcagccagaagatcaccgcccgcaagagcacctccaggcccgagcttgttcgtcagtccctggcgtgtacttgcttcgttgagacccctcgtgccaagcccgcgcccgtggttcctcaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttatttgcttaagcaacttaaactttaatgaaccaatttaatagcagtaataaattcaagaattatggtagtcgtgggtggttagttttaatagtcagctctctctgtttgctggttctgtgtggggttttcaga

SEQ ID NO: 47953 - DNA, 1501 bp, Oryza sativa
ccacctcattatctcaataatgacccataagaatccgaacaacgttcgcgattttcaattggcgattcaattccgcctcaattgcatttccatttgacccgatttgagcaccgcatgctcatgccatggacttgttccggatccgggttctctctaagagaatcattagcaagaggcaacatagtgtcgacacatttattcccacttacacatttaagcagatcttcgttatttcccaaaacgatcgatcaatggttgttccgtattcctagcaccatatatgcgcgcattgctaggaatgtcgtctccacgacgaacatcattatgaggtatatcaccttccaaaggtgaattctccaccaggagaatcagaggagtatgctcacatccagtgagaactcttatgctctgactaaggcctacgaatcgtgttagcaggcgtccccgcacaacatgatcaaatgccataagtcttatgtggatacgatattattcccgggtctatccacatttaccacaattgggagcattactctttttaacaaatatctagttgttcctcatatgattttgttggcaaaaactccgtgcaccaagcaaccaggagtatgaactaaacatgcaagttcagctcatttagtgcgttcactcaaagaaatctccaggcattccaaaatgggcgattctctccccttaatgccgagatatcttacaatagcatactaccaatccccatatcgtggcacaagattaaggcatttcacctcaaacacatgtgttctcccacgattgtatgctacggtggtgatatatttgggaaatattacgcactttaataggagagatttttccattatatgcagtgagcctggacatataccaatacagtggcatgaatactgtattcttccttctcccgaagggttatccttaacctcccagttaggatatacaggtttgcaaaaaccaccattgctatcaaatgtatatgcaaccaacatgcaaatactttagccaaatgcactctccatggattaatgctcacctagtgccattcaaactcacaatcgattccgggtcgacgtgcattagacatcgcatgtcatatgcttaagaaggcaacctatgatggcataacgcattccgatgcgctcaacaaggagtatgatagaaaaatgcgcggccactagcctgcgctgccaagcagatttttgtggtgcagagttgttttaaagtccatctcgtttaatgcccaagtttgaccccaattactcataccaaactctagaattgggtcatagttaagcagcatgtattaggtacgatccacgagcgaattatcaaaccacatttgctaatgtcccctggacatagccatcgagagataatccatacctccgacaatggtaatattcacaataaaaccattatattcagacatatccacaaaaatagtggaatgtgtcggtgcaaccgtcattggcataacgagctcaatgca

SEQ ID NO: 47954 - DNA, 1501 bp, Oryza sativa
ggcggaggctcgtccctcggaattcgtttgctcgtccctaagactcagtgagctagtacacaaacggattatacaggttcgggccgcaatagagcttaacaccctactcctgtgtttgggattatggatgaagttacaagggttccttttcttcggagagcactcttgcctcctctcttccgaagtttgggttttctctggttccacacccttgcactgtgggcagggtcctccttttatagttttaaggggataccacatgcgccgattctacctactctcaccggggaaaggggggggggggaaagaccccacttcacctttttggccttcaagacgtgccttctctcggaagctaagccataaccgatccttgagtggaacccggcgccgtcccccgcctgacacggtggtcagcccggtcattccctcataaatgatcgaagacatgcaacagcccttcctcgagcatcacccggatgtgacgggtcacacctacccccactccgccggggtcaagggtgacgtgatgatatgattaccctatccatcggatgtgacggaaacgggccggttacagaccagtcacatccgactagcaggggttagccagacgcgccgcacgtctgccctgcgagggacagttggggcgctgtgcatttacggctgttcagcctatgctcccctctgccgcgtggcggccaggcgagggcctcggggcgaaggtgcggtagggctccagggggcgatgccataccccgagggggcgacatcgtaccccgaggccccccctgctgcttttatgatacgcgtggcgtgtgagtggggctatccggccaagccacgtggtcggaggaagagtaattctcctttacctcacatacccccgggcccatatctccgacagtagcccctggcgccgtatcaggtgttgatcttcccaggattgtcctgacatggcgcttcatgattcttcaaattggggttgtgggcccgccagggattttgaaagaaattttggggtggctaggttagcgcacttaccacggcagtaatttgaccgccttagactgcgctcatgacaaagatgcttggggcgcgataaccgggggatcactcaaaccgcgccttgattctctcgcccgctacacccgcgacggaagtggtgacagtttgtccaattgcgcttatggccgttgcacactccacctcgagcgcgtcactgacaggcgcacaaaaggcggaggtggacgcaacgggcgacgcaatgattgggcgcgagatgcggagaggcagacgcgggcgcgaagatcgtgagggcagttatgggggcacgaaacgaggaggcgaacgcggatgaggcgaggatagaagggggcggagaaggaaactctgccttcttcctttcgccaattgctcactcatcctttcgcctctcgagccctaacactcccgcctcctcacattgtcttagacccctcatcctgtgccatctctccgc

SEQ ID NO: 47955 - DNA, 333 bp, Oryza sativa
tcgcttgtacagaggagtggttcctggagcaagatctatccggaactcaatctctcgcttgggtggcataccgggtagttcttccggaaacacgtctccgaattctctgacgatggggatttctgacagtcctatctgatgaagttctgagctactgacagaggttgggggtgcaaagaaaacaaccggttgttccggccctcggtacagagtgacagtgcgtctcacgcaatccactactccttggaattgagccaaccaattcatcccaaggatcacatccaagttcttggtgtctagaagaatcagatccgagggaaaaaggaatcccct

SEQ ID NO: 47956 - DNA, 853 bp, Oryza sativa
taaaggagtcgcatgcggcatgatggcgaccgcagtgttcagatcctctgcctcgaaatctcttagcttactcaaggttgagtagcccagtcccatagagcttcttttctgacctgaccagcttctgcttctgcgtctcggattaactgaagagctccttagagcaggtacaataagcagactataagccagctgtaaatatattttaaaaagttaaaataggagagagaagagcagtaggcaacagatatgtagtcagctgcagcacggactctaagacgtaatgtgtgtatgacaggtgggaccatgtattaatagtatagtaaacaactattgtatgagttggctattaaattggctataaatggtttggagctagtagttggctatactgttaaccttgctcttagctacattatggcattaacatcagatgaaagattgtcttggttatacacacacactctctctctctctctcaaattgtttcttaacttttggtaactgctgatctccttggtcgtaaatatttggcgttcacaaatgattcggttaaacttttcaagcctttgaccatcagtagcctctcaaatgctaatttttcataaaacaaaaacatcatgcatatatttgcctggaaagttattatctttatcaaagaatcttttataaaagggcagaaagttaatgcatttcactatagagttcataaggaaaattaggaaaaaaaacttactagtagcatgattaattaacgaaaacctccaccaacaaatgaaaacaccaactccatcaaaagatgtcacgggtttctcccgcacatcaccaaataccctaagcaagcgaatcggga

SEQ ID NO: 47957 - DNA, 571 bp, Oryza sativa
tttgtaaacatgtttgaccgttcgtcttattcaaaaacttttatgaaatgtgtaaaactatatgtatacataaaagtatatttaacaataaatcaaatgataggaaaagaattaataattactaaatttttttaataagacgaacggtcaaacatttttaaaaaagtcaacggcgtcaaatattttgggatggagggagtataaaatagttcctactgaacattgtcggctacttgttgattctttttaggtggtgtttgttcctgtgcacaaataggtctacacatgcacatgcgatttctcttacagttattttggtgctttaaaatgctttacgtattggtaatattagagcctagaggtcaaaaactattttgtatagagaaaattatcccacatagccatctgttgtttattcaagaaaatattctatgtatcttcagggaaccatatgtgatacacaaattcaattttatgtccattgttagagaatccatttgcttgaatcaaaattagagaatcatatatctgatggaaaattgtctttttaccaatatgtttgccttgcaga

SEQ ID NO: 47958 - DNA, 1501 bp, Oryza sativa
caccgctggtggagactccttccccgccgcttgccagagcgccgctctcctcgccatcggcactcttcaccagcgctacccggacgagttgcagcactcgccctaccgctaccaccctcgtcgcggaggagcccgcgaccacgccaccttccgggatgctagctcggaggatgacgctaccatcgtgcacttggcgcgtatggtggaggcgtacgacgcggctcgtatcgacttccatcagatggtgcgccgtgggatggtcgagaacaacctgaagatcctggagctgcgtcaagagaacctgcagctcaagaaggacctggacgcagtggaggcgcagctgcatcagctcaagatcgcccagggagagatctgccgccccaagcgccgccgtgtctgccgcagtctgaagatcactgcccgcaagagcacctccaggcccgagcttgttcgtcagtccctggcgtggacttgcttcgtggaggcccctcgtgccgagcctgcgcccgtggttccccaggagggggaagcctccggcgttggtagcacggaggatgcgctgttgctcaccttccgtcctggcccgtcgcagcagtagacgagcagttagtaggcttgcgcgtgtgttctttctcgtttgtcttcttgttgggttgtgtagggcacagttatgctggtgtgtggtgtaactgtgtcggagcctgtctttatttattcgcctaagcaacttgaaccttaatgaaccaatttaatagcagtaataaatttaagaattatggtagtcgtgggtggttagctttaattgtcagctctctctgtttgttggttctgtgtggggttttcagatggtgacgaccaggagaaatgctgccaccggtgatggcaaccaacctgaaggcagcaaccacaaccatcagggcaacccacctccactgtcacgcccggaaattcactagtaatttccgaacttatttgtgcataaaatcctcgtccaggaatcagccgaggtacacaaactgacaattttaatatacaaatccatcttaataataacgttacatacttacaaagaaaagaaaacagcggcggaattaacggtctagcgatggcttcagctccactcccacaggcagctcaactggggtataagccaaacgtcttctccttctggatcctttatcttcaactgaggtttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacactcatgctgcacaggcccaaccatcctgaacaaccatacccggctgtacagatctaactccaaaccaggagctaagcaaattattaccaggtataacatccataattattgtgagagg

SEQ ID NO: 47959 - DNA, 1501 bp, Oryza sativa
ggataaggaagagaagcagggacctacgcgcagataagtccggagatgaggccggctcggctcgcccagttcggctcggtttggtatgggtgccggttttttaattaaccggcacctattatatattataggtgtcggttctttttaaaaaccggtacatatagtattggtgccggtttttctaatgaaccggcacctataatccttaaaggtgtcggttgtatatttttcaatgtgcggatgtgggaaaagtttcataggtgccggttataaatgaaccggcacctataaggccagtccctataagggtttttgtagtagtgatgtaaatagcaaggggacatcctcttaagggatcaaaatagtttccccttaaaaaatatatgtatggtgataggagatacgtgtatccaacttttcttttcacgccacttggttacggccttcacggagccatacatctatcgtctatgcatccatctactctttttgtaccactctgtttttggttaatgtcatataatacgtgcaagcaaacagtatcttgaatcactacgggatgaaagtgttagaatttagagaagaaccgctaatatgatggtcaaataatagaattagatgcaccggtcatatgatggtgaaattataggtgcatcgttctatccactatagggtgcccacgaatatcggcccatgtggatgtactctcaacaggattttaggagacatggatgtgccaatagcctttctctataagcacgtaattaagtattagctcttttctaaaaaaatattacctccgttttttaatagatgacgccgttgactttttcttacatgtttgaccattcgtcttattcaaaaattttatgcaaatgtataatatataaatcacacttaaagtactataagtgataaaacaactcataaaaaaacaaattataattacgtaaattttttgaataagacgaatggtcaaacatatgagaaaaagtcaacggcgttatctattaaaaaacagagggagtagattaatatatttttttaaagtaaatttcgtatataatttttttttaaaaaaatacatcgtttagccgtttgaaaaatgtgcgcgcggaaaaaaaagagaggtgagttggaaaaggagggagaagaacgcaaccatagtaatggcatttatctaaaatgacatatttgtaatggtatgaatccaattaacctaaaaaatattagtatttgatatatgcaaatttagtactagccccacacatatttagctcaagagagatattttgctatattggttaacatcagtgattcctgtgtcaattagcactagccacacacatatttagctcaagctccgtcactgtaaaagtatcctgtatccaatgatcactgaccacctaccgctccaatataaagggacccatatgaatatgatctggcttttgtcagtacagctgcacgctcacttgcaaactagcaccaatggagctga

SEQ ID NO: 47960 - DNA, 661 bp, Oryza sativa
aagagcatataaacttcaaatggccataacttggccatttgaactcggaattggaccgttcaagtctctaatttttccttaagaagtcaagaacccatttttgtgctttgtttctgctggttatatggagtttagtagagtaaaagccttttcttttccgttggtcgtgtagacgctgcagcttcggaagatccgctcttcgtggaagttgaagccggtgtttgggaaagcaagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttattgttattattaccttgttcaccctagaataaacaaaaccccaactagtgggcactctactcatggtaccactagtacgattataggtagatgcttcgcttttaattaggtaacattaggcggttttacaactctagactttgggaatgttcatatcacctggacactgtggagttgttggagtattgtggaattggattcacaccgccccctctattcaaaatccccaaaaatggttttgatagtagcacctcggccatataaggaccggt

SEQ ID NO: 47961 - DNA, 1501 bp, Oryza sativa
ttcagcttttggtccaaattttaagaagctgtagttataaaatccagaaaataaattagaagacagaagctgggaaacccagcttttccatattctcataagctgattctcagaaggtggctaccaaccaactgcatctcacatctcataatcttaagctcctcaaataggctctaagcctcatctctagtgcaagagaccacggttgccttggatgtttttttttttgaaatgaggttgccttggaggttagagtatcttcaaaagagtagttaaatagctctctaagctaaattttaataagtacaaaaaaaaatcctttaacagcccctccaaccggttggccaagccattcggctggccaaatctgacaattgcacactcgctgagtaacaggtggccccatacatcttcgttcctaattccttctctctctcctccagaatccttcattgttgttgacctttagcatcgaccaacatacctctagcgccattcatcaactacacctcactctctggcgcgtctgcctcaccttcccattgacgcggtgcccatattcaaatgcggagcaaaggacgataacggagtagcagttggcgcaaggtgccaaatcggcaaccctagggggggggaggcgaggatctaactgtttgatgaggatggcccatccaccaacggtggtgacccccattagtcggctcgccggtgttgcaatcgccccacctcttggctagtaccctagtgtctgtcgtcgtcgctgtgcctgcccaaacgtggagagaggtggatgggatgggtagggagagaaggaggaagaagcacatagatgttgttaaattgaaaagtgtaatagaaaggttgttgacgtgaaaggtaaatttaactctctattttttagcaagctagttaaatagatatttgaagaagtcagatggagatgctcaaacatagttgattggcactggcacacggcatgtgttcgctcgaacctacacttgatgagtcgccacaaggaaaacgcaacagcagcactagtgctaacttgttactactacgacaaaagcagatagagccggaaatggagtagaagcaaagaaaacaccacccgatctcttagccttagctcagctcgtcacgttcacgtcccaaccccaagtcattactacaccacacctcatcaacatgtacactcctatgtaggtcagcagcttggctcgctcgcgtcggacgccagatcgatccatccatcgataaaccgagcacaagagcagcccacgacgcgacccattccgcgtgcggtcaaccgaccgcagccatggccagctgcctccttccctcctcccatgcccccctacaataaatgctttcccgccactacaaataccaccacctcgatcgtcgccgccgcgcgccaccccgacgcggcacgccaagttctccgcgacaatggcggcaatgtctgcttcgggccggagggtcttcttgctcggtgcccttc

SEQ ID NO: 47962 - DNA, 1272 bp, Oryza sativa
ttagaagtagagtatagagtctatatatgaatttaaaactaactaaaattcggaataaacataataaaattaaaagtaaagtttagagttcgtataaaaatacaatttacaaataactaaaatttgaaataaaaaaaatacatggaaagaagtgtctaaagtcaatataggaatacaatttagaagtaactgaaattcaaaattaaaaattaaagaatattgaaagatgagtttggagtctacatagaaatccaattagaaataataaaaattcagaattaaaaataaataatattggaagaagagcctagagtctatatagaaatacaatttacagctaacgaaaatttggaattaaaaaaagaacatataggaatataggaatataatttacaaataactaaaatttgatattaaaaataattaataaccaacacgtatataaaatacaatatgaatattacacattagtagtttcgtaaagttagtacaaaatttaaaattatgttgtcatttaatatattggaataatacgttgagaaaacatatatgttattatataagagaaaatataatgatgttagcgcgggccactatactggttactataatttaaaatgcttaaaacttaacaatagtattatacgtcaaagaggtaacctcacaatcaaatgaaaaagtaactacacatatgattcagaaccaaccaaataataccttatatacataggagcatttacactataccactgtggctgtatacacggtgtagaagccgggttttatatatttctattatctaaaaaaaatttacactataccagccaacggacgtctcatgctattcagtctggtcttggttgatctaggtacggacagccaaacagacccaattgtatcgagctagccagggcaaacccaaactgagaatcagagaggtatgagcagatcgggcagtcgaccaagcaaagcccatgagcagattcgaaaactttcaagtctagatttgaaaaaattgaaaattttcgacttagattcgaaaattttcactcgagatttaaaaatttgctagatttgaaaattttcaagtcaatattttaaaactttcaactcaatacatataaaaaacacgtgtgctaaaagattaaagaaagtataatatgaaaaaagcgcaaaaaaaagaaaagaaaacacgaaaagaaaaaacagaagagaaaacggaaaaaccggcgccagcggaaaaaaaattctagcgcgcgtgcgtgggcctta

SEQ ID NO: 47963 - DNA, 719 bp, Oryza sativa
attttcaaaatggaaaattatttttgtaaaacttttaataaaaaaaattataaataaaaaaaattccttgacgagaagggcaccatcgtgatcaatcatctgtctggtgggcccaccacaatagactcgggaggcccaagttgatcccaagccgcacgatcaaagccgatgcgcgtcatgattggatttttgccctttgcccctgccccctcgctcctcgtggtggggtgcacatgacacgactgcttccgcgtttcttctcggcgacgcaccccacacacgcacacacacacctccattcgctccccgccacacaacacgagaaaccccccacccttcgctcgccgccgccgccgccgccttccgccgcctcgaaccggaccaaccaacgacggctcgcttccctccgaggcggtaggccacctcctcccggcggctcccccatctggccgcccggcgccgagctggggatccatccgcccgcgattcctctcgccggtaacgactccctatcttcgctgcttggatttgcgaacgacagaatcgaatccagatatatctctctcggttgaatccccgtcgcgttttagtcatcatcattcgtatcgtaggtagggaggatttaggaggagtaggggttccgagtcaacaatttttggtgtgtaatcgtggtgactttgtgaccaggtttgctctccattgccagctgccggtggcca

SEQ ID NO: 47964 - DNA, 682 bp, Oryza sativa
aacttacccctagggggttcttgataaggaaagacaaccaaaagttttctgtgtaacaaccaatgactaccgggaatgtatccaaattggttttcccaagttcaacttggacaaggggataccaatgggtataaatcaaggccccctagagaaaaggggacggacaatcaacacccaacccatttgacatagaagccccaccatagaagcttacataagccaagacacgccgccgaatatcgacttcaggaataagctgggttagtaccctccggtgtctttggatactgtcagaagagatgaaagcgctatctctgatctcgccgggcacggattcgaggagaaaggctacctatggtcgactacgagtcagatcttcagactgccatgtcgacaacagttagataggctaccccaaacattgtactggtgtgattatcatgaataagagcaatactggcttcggccaacaggatgtagggttattacctaacaattcaggggcccgaacctgtataaaaatcctcatctccatctcttttatctcagtctcgcgtataccctagtaccaacgatccccatgccatgcaaataccgtagtcgagacatcaaacgtcgacagtggcacgccaggtagggggattttggtgcttcaaggtttcgacgagatgggtttgagaga

SEQ ID NO: 47965 - DNA, 1501 bp, Oryza sativa
cgacgcggcgctccacggtttcgctgttcaaacctgtagatcgagaatcggaattcgataagtcaggaggaacacacacataaggaagtcaatttaaatacaagaaaaataccccgaggagaaatccgggtcgcgtcctccagcccaaaatagtcaaaggctgggtgggctcgagcctagagcggctggatccgcctaccaatgaagtcggcagcgatttcataccccgacaaacctcgtactcggaggtcatcgatggcatcgatgaaggactgaagagaaggggtcaaggcgggttttgcggtccaagacgaaatcttgtctggttgttcctcaggaacaacgaagactggatccgaattttctatctgaagatagaaccacctcgcccgccatttgctacgagaagaagggcactggaaggggatatagcgcgacttcaggccatcccaaggtcggaaaccgacgcatccggataccctgttggattccatcaaacgcaactcgtagtagaaacgaaagaggtcaaggaacagctctaccccaatgtaggcctcacaaagatgtgaaaaaatactgaggaaggcgatggaattagggttcaaatggaccaaagaaaggccgtagaaattcaagaccaagagaagaaattcagaaggcggaggaagaaaaccacagagaatatagtcctcgatcgcaaccatgcgacctaggaaaggctagggttcaatacctcctgcttctctctccatggtcccgcgaccgggaagggcgccatcctcctgtagtttcttcaacgacgcgctggtggaggtatacttgtcgaggtccattgccgccggagatcgccggagaaaggaccgagatgagctagctagggtttttgcgggagcggagaagacgagtaacgcttgggggctggagagttttttcacaacaggcggacttcaaaatggatccccgaaactcccttaaatagtcgcacttccgacggtgcgaattccaaggaaaggagagagataaccgccgggaatttctaggtccgttacgcgtggcagtttttcggacttcaatttaaattcactcatgaccgttgagcttcacttggtgttgtcgattactccttgtctctcggtcctcacaccaagaacaacaacaacctcgacatcaaaagtcacgatcggttacacgagttcatttaaacagaagtcgggggctactgtcagggttacaggtaaggtataccctctacccttcgatatacgtcacatatcgatatggtatacttgcgtgtatacggacgttttcggcatacgttaaggaaatcgagggcgaagaacctcacttagtgcccccggccgaaccggcaaaggggggcctgcgcggtctcccgatgaggagctccacgctccgtcatctggcgcgccaggtagggggcgcgtgtgtctttctaagccctcgtcctctttcgtgtgcgccaagcttctcccgctcagcccca

SEQ ID NO: 47966 - DNA, 1501 bp, Oryza sativa
atgtcatgcgtacatcgatcggcaaatatcaataagcaaatcagaactaaatctacttgatcggctgtagatattaatgatatataatccttatatcgatatatacttaaatcaagtgattgggatagatcggtcgccttgccgagacagtataaatcacttagatcgaaatatatattaatagtgggattatatacatttatagcatagccgatcaaatggatctagcatgtatcggctaatactccgataccactctatattaagatgttaaagcaggtagaatataccaaacagtagcttaatatacttagatgcaattaaaatcttaacataaagggcagatttaacatgtcaatcaagcatatagaataaaagtagttaaatcagataagatcggctgaaactccgatactaccctaatcggcaaccagaaagcaggctagagattgcaattctaagcacgacttaataaatcaaactcaactgatgcagcattaagtatgaaaagaagaacaatatctagacaatcaagacgctggaagtttcatagagtggtagatatatcacataatctaagttaacatcattgtctaacctaatcggctgccttccattaacagatgttagccggttacagattagatgaagatattatcgaagattatatgagatatatgataactcgatgaattatatagacaagattagagtgtcataaagatggaagcactaatcctaagaacataagtcgtcatgacaagctttacctcttgttgaagttcgaaaccgatgcagctcaacccgagagcacgaactcgtcgaaataaaagtaaagcataaagggtggcgatgcgccgagattgtattggatgtgttgttctttttacataggactcgggtctatttatacccgagaattacaagatacgttcataacagacacgactattatctctaacaaactctaagataccataagtctttacggcaggcttttgcccaaacatatctctaaggaaattaaatagaatatcctaattaatagatacaattgccttcccaggactctatccatgcatggcaatcatcttgaagcacatcaacttgaacccgatgacgtacaccgagtcatattatcggaatcggctgtatcggctagccccgtccgactcgaactctgccgacctgaccttagccgatttggactgcagctgattcttactctgtttccgcaacgatcttcatcttggattccacctcgatctgatcttcaccttcgatgccaatagtgatagaatttaccaaatttggtcgttaagagggggatttggtgctcaaggttctactaccatgtcatccagcttcgtcgacaacagcgtcaacaccaacctcaaccaaggagttcctacttcaacaatgctggtgtggactcaagtcggcgaaatcatcttcccggtttacaccacggtgccgatctcggctggtccatcaatgaccg

SEQ ID NO: 47967 - DNA, 1501 bp, Oryza sativa
atggggaagaaattcgccatgaccctgtcgtcacccccggcggcctcgatcccagtcgtgtagatctggaggaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgttggcagcacggcgatcattgcgccggcgctcgatattgaagcgggcatctggccccctacgcacatcttcttgggttggaggcgttgacgagggaatggcggacgaacggcgggtaacggccgccgctcgccgcgccctccgcctcgacgacacggagccagcagtagcaacgccagtggccttggtggcggaggaccgccagtcggcgcctaggcgctgctgcgccgtcatgagcaaattggccacgtcatctagccaacgtcgggttgaagtctctggatcagggatgacgggcgggtgacgcaggagcgcgcccgcagcctggagcgcgccctggggcgtgctgccatcaccgtagacgaggagacgacgctccccgtctcgacgtccttctccatcgcccgcgtgcggcgaagtcgcggatctttcgacctcctcgagcgcctcctcccgcccaagacttcggcgagagggggacagtggagtacgagctcgacggcgcaggttctgctccccgtcgtcaccgctagcgctcggagagagattgtgcgccactgcccgttcggccatggggctgagcgggagaagcttggcgcacacgaaagaggacgagggcttagaaagacacacgcgccccctacctggcgcgccagatgacggagcgtggagctcctcatcgggagaccgcgcaggcccccctttgccggttcggccgggggcactaagtgaggttcttcgccctcgatttccttaacgtatgccgaaaacgtccgtatacacgcaagtataccatatcgatatgtgacgtatatcgaagggtagagggtataccttacctgtaaccctgacagtagcccccgacttctgtttaaatgaactcgtgtaaccgatcgtgacttttgatgtcgaggttgttgttgttcttggtgtgaggaccgagagacaaggagtaatcgacaacaccaagtgaagctcaacggtcatgagtgaatttaaattgaagtccgaaaaactgccacgcgtaacggacctagaaattcccggcggttatctctctcctttccttggaattcgcaccgtcggaagtgcgactatttaagggagtttcggggatccattttgaagtccgcctgttgtgaaaaaactctccagcccccaagcgttactcgtcttctccgctcccgcaaaaaccctagctagctcatctcggtcctttctccggcgatctccggcggcaa

SEQ ID NO: 47968 - DNA, 1501 bp, Oryza sativa
gacgatgatgacgacgggtcacttggttctggtgtacgattacgagggcgtcggccaggttctcgagaatcctgtcgtcgtctcctgttgttgtcccggcgccgatctccatcatcgtcgtcattatggcggcgtcctcgaccagtatcgcccagcacctgccgttcgcgatcatcgtgatcgtggcggttgtggcggttatcacggtctcggtcttcgctcgaacggcctcctcgttcttcgttatcgggacgtcgtgaagagacacgatgtcgggaactgttctcgttgtctcgtgcgcgtcgcgcctctcagcggccattcaggtgatcgcggagatcgccggtgccgcgaggtggaggggtggctcgatgaggcgattcctgctgttcagggttttcgccattagcaccgccagttggtggctgttccgagtgcgctgcagcagcggcctcttcgaacgcattgctgaggttggtcactgattcccgtagtcgttctgtccaccgtgcgacatcgtcgttcagaacgggatcgttgggggtttccctcagtattgcgttgacggccctgatgtgctgggccaatgtagtcacttgattttccgcttccgaattagcgcgcgctgacgtgctggtccagccgatagtcaatacctcgcatggcgtactcgttgacgatgagccatagtcttcgagcaggtgcaagactgatggttcatggggatcgatgtcgattaccccaacgaatcgatctgtgatcagcgtcgctccttgttccttgtcctcatccctgagggggatacgtgactgttggaccttaggaggtgacgtcttcatggcgctgagaaagaccttgcagcttgagaggtcgtgattctttgtcttgtgaataggacaatagacatcaagagttggagaagtacgctgaattccacgctctttgcaagcacgaatttcagcgtgtacgttgagaaaaacccaacaggcttgcaaggtgtgttttctggttttgtggataggacaccaggaccttgtcacctcggaagtcatcctcgtcgactcatgattcttgtcggaaagacaagatttggccgcattgggatccttctcgggatcggatgtcgtcgacgttccgttctccacttcggcgggaggatctttcgacatggagtcgtcctgggttgtagccactgcgttctcccttccggtcattgatggaccagccgagatcggcaccgtggtgtaaaccgggaagatgatttcgccgacttgagtccacaccagcattgttgaagtaggaactccttggttgaggttggtgttgacgctgttgtcgacgaagctggatgacatggtagtagaaccttgagcaccaaatccccctcttaacgaccaaatttggtaaattctatcactattggcatcgaaggtgaagatcagatcgaggtggaatccaagatgaagatcgttgcggaaacagagtaagaatcagctgcagt

SEQ ID NO: 47969 - DNA, 1501 bp, Oryza sativa
tcggtgtacgtcatcgggttcaagttgatgtgcttcaagatgattgccatgcatggatagagtcctgggaaggcaattgtatctattaattaggatattctatttaatttccttagagatatgtttgggcaaaagcctgccgtaaagacttatggtatcttagagtttgttagagataatagtcgtgtctgttatgaacgtatcttgtaattctcgggtataaatagacccgagtcctatgtaaaaagaacaacacatccaatacaatctcggcgcatcgccaccctttatgctttacttttatttcgacgagttcgtgctctcgggttgagctgcatcggtttcgaacttcaacaagaggtaaagcttgtcatgacgacttatgttcttaggattagtgcttccatctttatgacactctaatcttgtctatataattcatcgagttatcatatatctcatataatcttcgataatatcttcatctaatctgtaaccggctaacatctgttaatggaaggcagccgattaggttagacaatgatgttaacttagattatgtgatatatctaccactctatgaaacttccagcgtcttgattgtctagatattgttcttcttttcatacttaatgctgcatcagttgagtttgatttattaagtcgtgcttagaattgcaatctctagcctgctttctggttgccgattagggtagtatcggagtttcagccgatcttatctgatttaactacttttattctatatgcttgattgacatgttaaatctgccctttatgttaagattttaattgcatctaagtatattaagctactgtttggtatattctacctgctttaacatcttaatatagagtggtatcggagtattagccgatacatgctagatccatttgatcggctatgctataaatgtatataatcccactattaatatatatttcgatctaagtgatttatactgtctcggcaaggcgaccgatctatcccaatcacttgatttaagtatatatcgatataaggattatatatcattaatatctacagccgatcaagtagatttagttctgatttgcttattgatatttgccgatcgatgtacgcatgacatcggcttgaaataaatgatatgtcatcggcacctagccgatcggctatcatttataggattaactgtggtttctttgttctatttcttgttgattgtaggatcaaatcaactggcacgctcatacacccgaaggagagttttggacctgcactggagttaagcagatctcccaggcctcgtgttttctgtcaacaccccctacctggcgcgccactgtcgacgggggatacccgtagaccggatatagagggtactggggtacgctggtacgaggatctacgtaatacggcatgcgcgcgggccaccttcctagttttatctaacgatgtataatattggatccaccaatttaactgaaaataaaggggtat

SEQ ID NO: 47970 - DNA, 1501 bp, Oryza sativa
attaagatggatttgtatattaaaattgtcagtttgtgtacctcggctgattcctggacgaggattttatgcacaaataagttcggaaattactagtgaatttccgggcgtgacagtggaggtgggttgccctgatggttgtggttgctgccttcaggttggttgccatcaccggtggcagcatttctcctggtcgtcaccatctgaaaaccccacacagaaccaacaaacagagagagctgacaattaaagctaaccacccacgactaccataattcttaaatttattactgctattaaattggttcattaaggttcaagttgcttaggcgaataaataaagacaggctccgacacagttacaccacacaccagcataactgtgccctacacaacccaacaagaagacaaacgagaaagaacacacgcgcaagcctactaactgctcgtctactgctgcgacgggccaggacggaaggtgagcaacagcgcatcctccgtgctaccaacgccggaggcttccccctcctggggaaccacgggcgcaggctcggcacgaggggcctccacgaagcaagtccacgccagggactgacgaacaagctcgggcctggaggtgctcttgcgggcagtgatcttcagactgcggcagacacggcggcgcttggggcggcagatctctccctgggcgatcttgagctgatgcagctgcgcctccactgcgtccaggtccttcttgagctgcaggttctcttgacgcagctccaggatcttcaggttgttctcgaccatcccacggcgcaccatctgatggaagtcgatacgagccgcgtcgtacgcctccaccatacgcgccaagtgcacgatggtagcgtcatcctccgagctagcatcccggaaggtggcgtggtcgcgggctcctccgcgacgagggtggtagcggtagggcgagtgctgcaactcgtccgggtagcgctggtgaagagtgccgatggcgaggagagcggcgctctggcaagcggcggggaaggagtctccaccagcggtgactgtcagcgaagtccgctcgggagagccagcgaggatcactgcagtgacctcccaagcagcgtggggctccgcatcgtcaccctcctgctccggaagcggcctggcctggtagtccactccgtgtggataccccagggccacgcacatgccccgcagctccaagaagaaaccagtcatgtccaaaccacgacgggtgacgctgccggccatctacaaacaaaaacaaaaagaaaagcaacattttaaaggtcagattttggcgataaatgaagcagcaagacagagagagactagaggattttcacaaatacaaaggatttttatttcgaaaatattgctaaggcttgggatctacggctcgtcctagggtcaagggggctctgataccaacttgtcacgaccggaaataacccaacgggcattccttacgtgcgtgcattaatccttgtcc

SEQ ID NO: 47971 - DNA, 1501 bp, Oryza sativa
tatgtccgttgtgtatgctcacatgcgcattatcaatcaagaacaacccatgcattgatccactgggccaccaaaatgaagtatatgcatatactatctccctttttactacaaattgatctttcatcttattagaaaatatacatatttattattttattttattgtgacttgttttattattaaagatattttaagcataacttatactttatatattttcactaaatttttaaataagatgaatagacaaacgtcatgtctaaaagtcaatagcgttatatatttaaaaatggagaaagtattccctgtagtttttaaaaaatgatttttagaaacttgtataattttgttctcaaaattatctcattttgtaatgctctattcaaaacttgtttgcaataattgcattgttaggttgctatcaatgcttgttcatgatggcggcactgaacagttagttgtatgacctaatagcatcatcaagaaaatgagaataatccattcccaaaattttttattagattttctaaaatgaaaataggaattgaaaaaactcatccctctaagagaaaccctaaatttaattctcaaaaactaaaagtgagcccttctgttaaactaccaacagaaatctcccgttttccatcatccccgcaagaaaaaagatcgcgcgacccatcccatgcactcctcactaccctgacgctgtgtcgatctccctctcaagtgctacctggccccgaggccgatctccctcccacgtactccctgcccaatgccgatctccctcccacgcactccctagccaacaccaatctcccccggggatttttctcaactacaggtacttgtataggtcacaaggcaaatgttcagacattacaagtagatgatcaaatgaactcacaacattgactctttagcagtttgcctcatcatggtccaagtggcaagcaaagatggatgaagaaatataacattatatgtttcagttttaggactatattttttttactaagatttgtgctatttaatcaagttattgtgtagtaatacgttttagatggatgactctgtaacaatatacttgctacgtgcaatgacatgtgattcataataaagatttttcaataatgatttgtgacagcaacaagaaattatttcttaaactgtgtttgatgatgatactatcactgcggttactataatgaaaagtagtgttacagcttatcagaactcatgtgttaccagtgcaaaattatgtgttcctaggctatgcggcaacacatgttcttgtgttacaggagctaaaaatggtgttactagctaaaaagatggtaacaccttttcttagcagttgcaacatgaattatgtgctacaagggtcatactgtagtaacatggccaataggaatacatatcagtttgtgttactggagtcctcagtaacacgtttttgggcatgcagtagcgcaaagatgtgttaccagaaccctgt

SEQ ID NO: 47972 - DNA, 192 bp, Oryza sativa
caaagggacatctataggtataaatacaaggccccctagaagaagaggggacacacccaacagactcggacaacatagacgccacaaagccacaagccaatacaagcctacataggccaagacaagctgctagatatcgacatcagagataagcctaggaaaacccgatatggtacctacgggacccaaaga

SEQ ID NO: 47973 - DNA, 1501 bp, Oryza sativa
ccgccgcaactgtagcctctcctcccacccttgccgagcacctaccgggccgatgccgtcgccgccgcccttcctcccgccggatctggcggagggaggcgcctccgggccgccgccgctccttccgccgcgcaccgccgaagccgccgacgccgcccctccagccgccgtgagcgagaattataggggagagagagcggagagaacgggagtgctggctcctcgacactatctcctcgatcttatctcgatgctagtggtggggcccgccgtctcagctcatcccggctcggctcaattagctggtgccgcatctataacaagtcataggtgccggtttttaatattaaaggtgtcggtttttaatattaaaggtgccggtttttttaaaaaaaccaacccaaatgtaataggtaccggtttttatttagaaccgacacctataattactaaaaggtgtccgtttttacgatttcagcccgcactattggaacctatagtggcgacacatatttgatattttgtagtagtgcttctataatccaaaaataagtccaccatctgcctggcacactatggggtataggtatggcatacaggtcagcccccgtttgatttttggttcctataggtatgtccgttacgcgtggtgacagtttggccacatgccaatcgtcaccaatttgagaaaataacttttcataaaaatataattgtggcctctcacatgcaatcacatgtcatccccttatatcttcttcttcctcactctccctcctcttctctctcatgccaccgcctcatcatgcaacctgctcgcctgtgcttgttgtggaagaaaaggaacctccacgagtgcgcctggccaccgtcgagctcttcacgcgaccatcctccacgagctagccagctccactcatcactcgtgtcctttatgaactcgatggcagcagcccactcgctagcacaagccaatatatcaagctcctaacctgatgaggaacacgcatgcccacgtgcattgagcaggctagaaagaaacaaacggtccagagcacatatttgttgaatagtatagggagataggatactatgaatattggagatgttgtatctgttgtttttataagcacataatgatttaatttattccataaataaatcataacattgcagatgtaaactagcatcaacacatcattagatttacatatgtaaactaatcagtaaaatatgaacaaatcaaatatgcgcaacatgttgaacacgtaccgagggttccggatgaccgctgccatgccatgcgaggcaaggcgagcacgtgtgtgttccccctcttctctccacctcacatgcttaaagtggtaaggagggcatcctcccttttaaggaggtcccctgtctagaatgagtaaggaggttctaaactcaccatgcatgccatcccatgaggtgggcttttgtgattttctaaagaattaatcttcgagtgggctaaggc

SEQ ID NO: 47974 - DNA, 1501 bp, Oryza sativa
tttggcgccaattgatagcaagggacaaatagagctctcttccttgcggtgagacgaatcctggccttctgcggcggtgcttctcccttcaacgtagctagctccttctccaaacgatccaccttgtcttctagcttgtaaatcttaccacgattccggtcttcacgatcttgagccgctaacacagtctccgcacgggtttcatccatagcccacagcatctcaaccaaatgccttgtggtagcatcattctcaattccttcagtctcaaggtagctgccacggtcacttccctggggttgacgaggatgatagcgatactccgtgtcggccaactgatcactatagcgatcgcggagctctcctatggcgatccttgccacctcctgacatgcatggatgtagtttcttcctccagcttcgaacatcactgaggggatatcttcactattactgttcaaggtgactttgactcggcacttctcttcatgacgatcatgagaaatctgggcataaaaaggggcagtcccaaatccaatgacaaaggacattgtacgcaactcttggacaaatccctcaacaccaaacaagtactcaggcttgaagcgcggcatctaaagacaaatgaaagtagggtttcatttgcaaaagcagcatttagcaaacatttgagaatttaataaaacagttaagtaattaaacaatattaatccaacgctatacaacataccctgttgtataggcccaaccattctgaacaaccatcccggctgcatagttctatctccaaaccaggaatataccattccaaactaggagctaatcaaattattaccaattaaagcaccttttattatgatgagaagggtgagactaatcacgaaagacattgttagacccgcccataaccgcgggcatggctattcgaatagttttactctgatcagaggtgtaccactgtacccacaagacacaaccccacatcatgtcaccacgtgcctcaataccaccacggtacctccgaaagaagttgtgacaataccccttgcataacacaatccactgcagcgcaccttcctgtatcatatcaccccccttaaaaccaaggcatggactccccagcgacccccgtgggcttatctccgccacttctcagtctggtgccccgcaatgaaccatgctatacaaaagataaagccgttgcccacgctggcttgtggttggcacggttaatgtttcacaactgaaactcgtgaaccggtccttaattgtcatgagcacgaccatcaaaaccatgtgctcacaacccatcatttcaggttttagttggcaaataattaattaacaaatcacgattggccatcgtgaactatcattaagccatcattaaattatagtgattcataagttatcccaatagtgtgctaatgtttctaagcagggctaagcaattatatctaatacatctagttgaaccaacatatagagctcaactagtcaa

SEQ ID NO: 47975 - DNA, 333 bp, Oryza sativa
agtggttgggttaattacaagaaaaatccaatatctgggggttgataaaataatgttgttaagttggatcaaacaactcaaaaccccagcccataggttacatgcaaattagttagttaactacaacaatttgctgaattattaacctcttaatttattcactaattgtccatgcatgcaacaaccaagccactatataggtcagtggaagagagaaggttatagcaaagcagcagcaactcaagtactcccaggtcaacaaggccaaaagggccagtgagtggctagcttaattagctaagctcatagtcatagcaatggctggagccgtgc

SEQ ID NO: 47976 - DNA, 540 bp, Oryza sativa
attaaagttctcctctcctttttcttttacaagtttatagattagtttttttattactacctttattccttcttctttctgtccgacaatatcgatatttatcctgattaagtcgatattgaagagagtcgatgatgaattattgtcgtggaattattaatttatatcaccttttctctgagttatctcccggcgattgtcggtcggggaatattgtttgtgtttactgatcacaccacacgtgaatcttgtccatttgtaggacgggaaagctgcaggttttggagaaaagattagtcagagtaaaacaaatttgtctgtctgttattgacttgttgggcgaagaatcgactccgcgaatcaagcctgattcacaacctctatataattaatttatcgatatatgcatatatcctattgttaaacagaggatgaaagaggagattccatgttcactatgttaagtgctaaaaattaaaggatctatatgcatgtttatgttcatgctacatctacattataacatgtagattaataagt

SEQ ID NO: 47977 - DNA, 1501 bp, Oryza sativa
tggtgacgtcatcgccgacgtcatcagggccggtcgtggaccgttcgatctcggccgtccgttttggatcaagtcgatctcggccgtccgttcgcgtgagccgtcgcccgtgcgcccggtccaccgaaaccctagcccgctgacgcaataatcttccttttccttttcaaaaataattcattattgcgtcataattcaattaaaatcaatttaagtgttttaatccgatttaatcttcaaaaattcataactaattcatcttagctccgatttagttggttcaagtctctaattttttctaaaattgagatctacatgttaaaaatatccacatgtactgttcaagcttatttatgtgctgttttggtgattttgcttctttatgtttacattctgtcgtttccggagagtccgttttcgccggagaagagtttgaagagttccaaagcaagcaaggcaagtcacacagatcctaaacaaccctttgagcatgttgatcctatttaaagctattgtttctattcaaatattgcatttattttcgaatgtcattgggtggaattaacctattgggtggaataagttattccttgataccttgggttattataatttgactagttgagctctatatgttggttcaactagatgtattagatataattgcttagccctgcttagaaacattagcacactattgggataacttatgaatcactataatttaatgatggcttaatgatagttcacgatggccaatcgtgatttgttaattaattatttgccaactaaaacctgaaatgatgggttgtgagcacatggttttgatggtcgtgctcatgacaattaaggaccggttcacgagtttcagttgtgaaacattaaccgtgccaaccacaagccagcgtgggcaacggctttatcttttgtatagcatggttcattgcggggcaccagactgagaagtggcggagataagcccacgggggtcgctggggagtccatgccttggttttaaggggggtgatatgatacaggaaggtgcgctgcagtggattgtgttatgcaaggggtattgtcacaacttctttcggaggtaccgtggtggtattgaggcacgtggtgacatgatgtggggttgtgtcttgtgggtacagtggtacacctctgatcagagtaaaactattcgaatagccatgcccgcggttatgggcgggtctaacaatgtctttcgtgattagtctcacccttctcatcataataaaaggtgctttaattggtaataatttgattagctcctagtttggaatggtatattcctggtttggagatagaactatgcagccgggatggttgttcagaatggttgggcctatacaacagggtatgttgtatagcgttggattaatattgtttaattacttaactgttttattaaattctcaaatgtttgctaaatgctgcttttgcaaatgaaaccctactttcatttgtctttaga

SEQ ID NO: 47978 - DNA, 1501 bp, Oryza sativa
  unsure (1)..(1501): unsure at all n locations
aacttatcaaactatggtaaaatatggttaacaaacaaacactcacaaaggtcgttctgaagtgtggcaaactctgccacacttttcatattgttgtcggcatcacggactcatgtacgtatattgtacagaatgcatgaatgtaatggaataagtctatttggcctccctcatgtcttgttgttggtcaaatcgtatccctcaaccgtaaaacagggtacaaattaatttctttggtagttttaaaagtggtttttgctgacgtaacacgttgacttggtccaagtatgtgtgggtgtgtgcgcgcactcgacaatgacatccaggtgaccagtttatcgctgccgtgggacatgtcgtcattggtgcatcctggtgagagagaggggagagagagtggggagggaggcgaggtgaggaagataagatttggatgatacgtggatcccacccgctgacttagctagtcaattgcggtcaatatatcacgtcagctaaaatcaccttctaaaacacctaaggagatgatttgcaccgatgtttaaacacggggaggtgttatacccggttttgtgttagacggaggcgattcagtcatgaccaagactgaggagaaattatagacttaatctgaatgttattgactgctatctccgtccagcccatcgaagaccctgttagttccaattgttatatgggccaaaatgggcccaagaaaatcctcctcctttttcagcgtaaccataaccctccgcgaaagcagccagctaacccaatgtgacgcgcgtagcgcaactgtagagcgtgtgcgcaaccatctcgcacgcacttgactgacagccactctccgccgaaccccaccaccatgccgctgccaccccatggtgggctccctcccgcacccatcatcgccaccgccaccgccacgcgcgccgaattcgccgcccacttccaccacaccaccatgcgatgcaacaaccggtgggcgcgccgcgcgcagctctcgcggttaaattctcccaacacctgcgcacggcgcacaacccaacgccggcccgccaagactacggacgaacgttcgtccatccaccacggccctcggagggcacacgacgctgacgctggatccgacggagtcgggtgatatagattgattggttactgtttcacaagttcacaacttgtttcgatgcttaaaagttcgtaaagcgaaataattgcacctaatagataaactaattagcaacatgtggttngggcaaaaaacattagtacaaaggatagggaatcttttgccaaaaaaccaaacaatattgtcaaaatttttgccaggaacaggagccccttggcagcaaccggaacacaccggcttttgagcctctatcaacggtatcgattaatcacccttatcgtctttggttccttctgcttgcttctcttgctggttcgtcggtcggtggagtttgagcctgcgccatggctgtcggcgggagagggagac

SEQ ID NO: 47979 - DNA, 1501 bp, Oryza sativa
caaggggtattgtcacaacttctttcggaggtaccgtggtggtattgaggcacgtggtgacatgatgtggggttgtgtcttgtgggtacagtggtacacctctgatcagagtaaaactattcgaatagccatgcccgcggttatgggcgggtctaacaatgtctttcgtgattagtctcacccttctcatcataataaaaggtgctttaattggtaataatttgattagctcctagtttggaatggtatattcctggtttggagatagaactatgcagccgggatggttgttcagaatggttgggcctatacaacagggtatgttgtatagcgttggattaatattgtttaattacttaactgttttattaaattctcaaatgtttgctaaatgctgcttttgcaaatgaaaccctactttcatttgtctttagatgccgcgcttcaagcctgagtacttgtttggtgttgagggatttgtccaagagttgcgtacaatgtcctttgtcattggatttgggactgcccctttttatgcccagatttctcatgatcgtcatgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctatagtgatcagttggccgacacggagtatcgctatcatcctcgtcaaccccagggaagtgaccgtggcagctaccttgagactgaaggaattgagaatgatgctaccacaaggcatttggttgagatgctgtgggctatggatgaaacccgtgcggagactgtgttagcggctcaagatcgtgaagaccggaatcgtggtaagatttacaagctagaagacaaggtggatcgtttggagaaggagctagctacgttgaagggagaagcaccgccgcagaaggccaggattcgtctcaccgcaaggaagagagctctatttgtcccttgctatcaattggcgccaaaggttcgtgtggtggagaaagaagttgccccaaccctagcagatccttcggtcatcatcataagtgacgatgaaaaagaagaatccaagcgcaaccattccaagattgagtgggtagcaactcaagatgatgaagacgagccgaacgagccttcaatcgacctccgatgctcggaagaactagagtgccatgtctaaccgttgtcttagatcgttgtgttagtttgcttgttttaagtttgcttgtgggtgtctcgcatgtgatttacatcagtggtgggatgtaagtgcatgtgtttgtttgcttttgagtgttaggaagttggtgagtttggtggtgtgagagtcttcagtttgtaataatgaaactcagttaagatcaataaaagttaaagtaattccctgtcctaagtagtttcccccggtttctcttcttgtgccctgtctatgccaga

SEQ ID NO: 47980 - DNA, 623 bp, Oryza sativa
aaatatgataaaaaatcatggtaatcaacgagtctaatagcctaggctatggccctcatcataaccaaaatgtgcatataacatgctaagagaatgactattaataaaccagtcatctcaaatcaacccaaacaacttttgcagcctaataaagctgacaaaaatggtataacacctttctgtcgggcacctttttatttgcagcataataattccaaagaattatcgaaccgcgttaaaaaggattttagcagcatcgggccacatcattgtgagcacaaattgccaaagcaaaaagcacctaagtccctagggatcacaacgggccacgctgattataatattgggctgaagtactgtacagacccaggcccattagtactcccgataccctaacaaagcaccgaagtccaagcatcgcttcgtcttccccaccgagactctcgccatttccccactccttgctacagtagcaaaccgcaccgtcgaaactagggttcatcaatccgtcccaatccattctcaaaaaatcccacgaaacttctccgcgtgtccaccgcaccaattcctcattcccctccagctatatcttggaccaaatctaaccatgcaactcgcatcca

SEQ ID NO: 47981 - DNA, 1501 bp, Oryza sativa
attaattgaatattaagcatcacatacatacaaaaaaaatatttgatttttgagagaactaattttatgtagaaagtatttgaaataatataccgcttaataatttaaaaaccgtactcaccctatatactccgtatgagcgagttatcaatccaataagcacttttactgcttgaatcaaccacaaaatctctgattccataaagatgcccataactgcctgatacagacagctggcgtacgagattatgagccaaaacattttttttgtcaaatggcatacattaagtactactgttagggccaagattaagggactagcttggcttaaaataaaacggagagaaagaaaaggaggtatactccagctgctagccacatgatcacagcttgtgtacgtacgtacaggccgtctcccgtgtttcaaggcgagacatgcttaatttgctaatggactcgacgcgtctaagggttactcactccattactttgagacaaagattacttgctcgattagtttattaattaatgccctaatcatccaactaacaaacggctaaatacagtttcaaaagcagacgaacctaattacgaatcacaaagagagatgcctcacatatacatttgtaatcatgattggccggtcggcgaaaatgaaaaaaaaagataatgtgtatctcaatttctgtgtgaaatcatcagagatgtatcatggagagggcgaaatgagctataattgttaaactaggtgaggacacccactaagcgcgtcggtatggttcgatgtatgcacgttgcgacggggccctcactactgatcattctcacagattcaggtcttcaggacagcttaatttgtttatgataactcgaaagacaaaaatatttgagattattatcgaatacttgtcatatttgataaatgtactatgtttatattgaactcattttaagtttaacaaagtctatgcgaccggttggaaagtagacaacgcatcttgtagtgagcctattcaaatgccaaattaaggagattctgctagttccttgaaaaaatagaaaaaaaataatctatctttctaacatgggtttcttttcgatttcaatagaaaataaactgattcatgttaaaaccttcacacaaaaaaaatcacattataaaggagaaaatcccaagaaagaaaaattgaattgtcaaagtcggatgaaaccatgtgttccctccatgaaacccgtaatggaaggcaactcagttcatcttttttttcccctttggccagttgttcatcatcaccgctggttcgatcagacggacacgcaaaccaaccaaatccccgcgatcccagccgtccatttcccccacaatattctattcccgccctgcgaccatatagcccacctcccctccttccttccccgcatcaaacctctcctcctcgtcacacaccccgtctcgccgccggcgatgcgcagacgccaatgacgacgacgacgacgacga

SEQ ID NO: 47982 - DNA, 1501 bp, Oryza sativa
ggctgtccgcctcctagtattcttgggcggttgggccaatgggcctgcttcgttgtccacatcggcagcaaacaaaggcccagcaaagtagcaaacatcagcgcacaaagaaacgaaacgtttctgcccgctgctcgccccgcagcggagttaaggcagcggcacaccattgccatagacaacgatcgtaactagatctactgagtgccattgtcttcatcaccctcctggtagtaagcgtagagatcctccgaagcttcatctccgacctctgattaagtttgtatattgcaagggtgagtaccaactcagcaagccaccatagcaacaatgcacatgatagaatgtatttaaggaatagctgtggttcttttgcgtagagcaagttttgcaattcttttcagaagcctaagacctagcatagattgatcaaattttagccactggagttgactatgcgaggcaatgtaagatttaattgattctattattggttgtaaggatgagattaaaatagtatttgtttatttgtgcttgcttagattgtttcctataggataccctgatcttgaagtgttagccgttctgatgttcgtgaacttggacatgctgtacatactttgttggttgatctcattgctcaacatcagttaatgactgaaaactgccatgtcaaattgcccattattttaggaaagaaaatatgagccacctctcatacaagagacaaccttcacacaaaccctaagaaaaaagagatggaagaaagatgagattggacaaactaataaaataaaatcatttgggttagcatgctaagaggtagtatatatgtggtgtattatatatatcacatcttattttatatggataaaattagatgtgacaactacccctagtataaaacttgcccttatgttggcatgagcattgtgtaacccgtgcatcctatttagagttctttatgttgatattttttattcctaaatttattttctagattcttttctccttaatcattccaattatcatcgattgaaagagggcaaatttatataatttcaaggcaccagatagataccactctacccagttgggaagcttctagaatctgttagaggagatgttttcttttctctaattttttctcttatataatctctagatttatctcaaagtattgattgattaaatgattaattgatgattggctcatctcatcactcttgcactagttaattaatgcctgaaaaataccatgtcaaattgcccatcattttaggagtagcatgctttccatgcttcagtggttcagtgaatataacctgctgattgacagcatgattggatcctgtctcttttttggaccatcccatgttgcatcacacttgtgaaaactccagataccaccagaaatatccgtatcatctgacctggtactgataacatagttaagcaatcatatgaaaatcctgtgcattttccttttctccttgacaga

SEQ ID NO: 47983 - DNA, 711 bp, Oryza sativa
  unsure (1)..(711): unsure at all n locations
tggcattgattgcagatcgcacagnagcncatcaatatgtctagcttgaaatgtcaaaaatgtaagctagctccttgctgccaccaaatggccaaagccaatctgtcacaccctgaaaattttaaaatttataaattgttgtttaaatggaatttctagaaataattttaaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccctctctctctcctcggcccagttcggcccagtccgcagccggccgcgcgcgcgccctcgctcgctgacaggtggggcccacctgtcggacccatcgtctaccttcggccgccgccgcccgaaaccctagtttcgcgccgccgccgttcctttccaaatccggccgttcctttccttctccggccgaattgtttgaggggaaacaatctccgggatctcctctaccttttctcctttggaatctttggctaaatcgttttggaagttcgtggaatcgagttcgattcggatcgacctctttccttcaagc

SEQ ID NO: 47984 - DNA, 1501 bp, Oryza sativa
ccgacagttttcatccctatgtgtcacatcctttcaaaatcctttatattacgggacggagagaataaaagttaatgttgtccttcattaattttgggaaaatttagcgacggggatatttcgtttgtactatatagtttattgcaaatcataacatcccataaatccagatatgtttgtatcacacatactgtcaggttgctatatgtgatagacaagtttgcaagccgacattttcgaagtcttggacaacgcaacctctctgattggaataagcaaattgattcgctacatataagcaaggatgaaggatgggagccgactatggcttgatgtccgcaacatcggacagtgttaccctatattattgtaaaatatttcacattttacaccacttaatgaaaatgttatacatttcatcgatcggaggaaaatgtttcatagctttaacaaaagtgtttcaaccaaatgcaatattcgaaacataccaattgcaatgcgaagaataaatacatgcaacattcaatcgaaacaaaatgaaacaccttaatacaataaagtataacatcactacactctaacaaaatgaacccacctctatctatttctactccgaccactggaactagtgaatgatgcggcggggaaaatgtattggctagggaaggacacggacgagctacggcgtgagacgggcaaccttggccagggccagtcgcgtccgcgtttgatctccgtcagatgccaagtcgagcgtctcctccctatttcatgttgtcttgctcagctactgcagtatgactgcagtgtggccatcggcaaggcggtgaggtccaacgcctcctacaaatccctatcctgtgatgtcctacgtaccccatcaccactaccaccggcgacgatggcttcgtcatctctcccgacttctgacaacgtggtagtgctgaagctccgaggatagagatagagcaaaagagaagaagagataaaaaaaaggaatgtgtggtggaggagttggtagttggtggtttcggataaggattgagttggtagttggcggtttcggataaggatccgatattttgaattcttaggacgtttgttcgaaagcatttctacgaaggatgttctaatttagataacgatgtacaaatacgggtcaaacaattctaaggtgtctcgaaaaaaagtcaaatatgaagggagccctgattggttatctggcttgaattccaagtaggttgttttaaatttgaatttgccggaagaaaacaagtagtaagattttgatccattaaaggattttcactgaaatttcggcccatatatagatggccttggattaaggcccacactatttgggcctcgatttgttggaccaatgccgggcttttcggcccataccactcatcgtcacgccatttcaccgcttccctttcctgaccccaccaactcgccatcctccctccgccgccgtcgaccaccgccgcagccgccgcca

SEQ ID NO: 47985 - DNA, 767 bp, Oryza sativa
  unsure (1)..(767): unsure at all n locations
tgcaaacaaaattaccaaagttgaaaattgtaatccggatggttccttgcgcggaattaagattgaaattaagaaaaacatctagattagaagtcgttaatttcatcattttgatctaatctaagcacgcagctggtgatggtcaaccactagcctaataattatataagcattttaagccggcatagacttcagataagataaaatgatagcttaattccatggttaatttattacagttacgaaactaaatatttgaaatttcagggtctactggtgggtactgttagctagaatattctaccggttgaatgttttaatatttttttataaaaaaatagcatgaatttgttcaaattttaaaattttcaattccaaattttcggaacttcgatcacccctggtaggtttcatgcattccaaatagtaaacctggcttaactgaaactcgagatcttcagcttaactagtttttgaaactgtgttcggatgccccctttctcaaccactctttctcgttttccgcatacacgcttttcaaactgctaaacggtgttttttttttgcaaaaagtttctatacaaaagttgtttaaaaaaatcaaattaatttattttttaaataaaatagctaatacttaattaatcatacgctaatgaatcgttctgttttccgtgcgttaagagatagcgaacacaggagtggttccttttgccatgatcgaattaatgatggngtnctgtnccactggagagcattcatgcctg

SEQ ID NO: 47986 - DNA, 1501 bp, Oryza sativa
ccggacgtccctcatggcgatcccggcgcacggccggctcgggctgcagtcgaacctcaccgccgtcgccgtcgccgacgtcccctcgatgtccgtgtacgacacgccgctgatctcgatccccgacccctgaacacacagcagagagagaagccattacgacgtcggcatccatggcgatggcgcgacgaggtcacaggtttcagggctgcgtgcctcggttgggcagctggcgttgccggggcagtagttctggtcgacgatgatcgggttgctgacgttccgcatgacgacgccggagaaggagacgccggcgaccgcgccggcgttcgccttcgcccacgtcttgatccgcagcccgttcgtcgtcccggcgagcgccgcgcccttcacggtgatgttccgcaccgccacctgctccggcgtgtcccccaggctcccgatgctgccacacaacacagcaatggagctctctctgagcatcttcgagcagacgacatggatttcggctgtgtcgctcacctgatgccgtggccggggccgcaagtgacggcctcgatcaggacgtcggaggagccctcgaccatggagacgcagtcgtcgccggtgccgatgacggcgttgcggacggtcacgccggtggactgcttgatgtggatgccgtcggtgttggggctgcgccccggcgccgacaccaccgtgtccacgatcgccacgccggcgctcgcctgcacggtgatgtggatcccggcgctgtcccgcgacgtcagcccgcgcaccgccacgttcctcgaccggtatatcgtcagcgacctcgtggcgggcgggcagtcggggcggcgtgcgcgccggcacgcccagagcgcgcggccgcggccgtccagcgtcccgccggcgacggacacgccgtccacgtcctggaacacgatccacagctgcacgccggcgtacggcacgggcgcgaccaccgtggcgcccgtcatgttcacggccaccgcgccgctccggcacggcccggcgaacctcgccctggacaccaggtacaccccgcccgccggcacgaccaccgtcgccgccgccgccgccgcgtcgcccgcgcacgccgccgcccacgcggcctcgaacgcccgcgcgctgtccgtcaccccgccgtcgtcgcccaccgcgccatagtcgatgacattgtacgtcgccgccgccgccgccgccgccgcaacgaacgccgacaccagcaagtgcgcggcgacggcggcatgagcatgagcgcggcgcggcattgggtggtgggggaagataagcttgcgatgcgattgctggtgcgatgcaacaagagttggttgtgttaaagcgacacgttgatgtggccttcaaaactgtcttggacgtgtgtgccatgagtggtttgaggggcaattacttgtaagattaggcaatgttatgtactgctgctaatgtgtggaccagttgctacgccacttattcgtgtgcacgggtgcacagc

SEQ ID NO: 47987 - DNA, 1501 bp, Oryza sativa
ggcatagtagggtttcatttgcaaaagcagcatttagcaaacatttgagaatttaataaaacagttaagtaattaaacaatattaatccaacgctatacaacataccctgttgtataggcccaaccattctgaacaaccatcccggctgcacagttctatctccaaaccaggaatataccattccaaaccaggagctaatcaaattattaccaattaaagcaccttttattatgatgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcaaataattaattaacaaatcacgattgaccatcgtgaactatcattaagccatcattaaattatagtgattcataagttatcccaatagtgtgctaatgtttctaagcagggctaagcaattatatctaatacatctagttgaaccaacatgtagagctcaactagtcaagttataataacccaaggtatcaaggaataaggtaatcaagaacaaaagggctataacaaacaataggttaattccacccaatgacattcgaaaataaatgcaatatttgaatagaaacaatagctttaaataggatcaacatgctcaaagggttgtttgggatctgtgtgacttgccttgctggccttggaactcttcaaactcttctcctgcgaaaacggactgtccggaaacgacggaatctaaacaaaaagaaggaaaatcaccaaaacagcacataaacaagcttgaacagtacatgtggatatttttaacatgtagatctcaattttagaaaaaattagagacttgaaccaactaaatcggagctaagatgaattagttatgaatttttgaagattaaatcggattaaaacacttaaattgattttaattgaattatgacgcaataatgaattatttttgaaaaggaaaaggaggattattgtgtcagcgggctagggtttcggtggaccgggcgcacgggcgacggctcacgcgaacggacggccgagatcgacttgatccaaaacggacggccgagatcgaacggtccacgaccggctcacagcgaacagccccga

SEQ ID NO: 47988 - DNA, 1501 bp, Oryza sativa
gccggtcgccgctggcagccgctccctctcgctatgctaagtcgccatgcagttacaataggcacgcccctctatttatgagagacgatcctgggatagagtccgactcatactctagtcctaatacctattacaactccaagttctaaactgtaaccgactacttaccccatccaacgactgccttgattgggcccgcctgcaggtcaagaaaatccccaatacggccggccagtacgtgccttggacacctttattgagtggttgctgcacgaactttaattacttcactttcactggtttcgattacactttacattgtatatatgtagcgtgctcgatatatcgcatattcgcatgtgatgtgatatttttgaatcgtggtggctgtcacttagactatatatatatatatatatatatatatatatatatatatatatatatatatatatatatatatgtgtgtgtgtgtgagtggtgcagaattctaccgagcaagacagaagcaagctagacacgcatagcatacagagaaacgagcttatggatagccaccaggagacaaccgatatggagcttgcaggtaagtaattaagcacgtacgtacgatgtaatctatgtatacgtccgtcacatttacggcttgtttctgcagtgcatatatatctatgtaattaatggtcactgggatccggaaaacgtaatttgctaagagaaatgtcgactgggaagcatatattaattaatttaattttactgtaacagtttcagaatagttattacggcttgtttcttcagtgcatttgtatctatgtaattaattaatggtcactggggtcatattgattttactgtgcaacagtttcagaatagttttgaacataaacatgattctgttgtgttctgtataaattatcagtcgcctgaaactctgacgtatccggccccaaaacctagatctacgctccggccgtccaatatatagccaatatatagcatgctacaagacgcatataatttcaatttagaagagcactgttgtaatctattctcaaatgtcctctattttttttctgtatttcatgggtctttcttccttctattcttcataatgcttaaagttttattatgtccatgcaacatttctgagccattaattacttactttaaattttaaaatttgattcagggtaaagctaaaagttaaaaaatcagactaagccaacggattaggatatatataggatagacttgtttcttactcggtacggtaggaaaaccattctgttaatatgatatgggttcaattatcatttattaacgctaaaagccaattaatttttagtaatcaatcaggggatttttttaattgtttccatattgcacttgatgatccaatatgaaccaaatagtgaacgtgaaatctactatctcaatcccagaatataagaatttttaaagttagatacagttattaagaaagtaggaatatttaata

SEQ ID NO: 47989 - DNA, 1501 bp, Oryza sativa
  unsure (1)..(1501): unsure at all n locations
aagtagagtatagagtctatatagaaatataatttacagaaaatttagaattttttaaaaaaatatattaaaagacgagtgtagagtccatataggaatatatataatttacaaataactaaaatttgatattaaaaataattaataactaacacgtatataaaatataatatgaatattacacattagtagttttataaagttattgcaaaatttaaaattatgttgtcattttaatatatttgaataatataatgagaaaacatatatgctattatatgagaaaaaaatataatgataatagcagcgtaatctgtgcgggccaccatgctagttatataaaaccaaccaaatttagcgtaataacaaccattcatcacagcttacctcacccagaacaaaaaaaaaacaaacaaacaaacagctgagctcctctttttgactgaactatcacaatccaccatcagttgactaacccaaaccatcatcatccaacggccctccgccctcctctccacatcgtcatcacatcaaatccgtcgcaccagaccaaagcaccccaccccactccagtccacgctccaaaccctcacgcccccacctcaccgccgccggacggcgacccctccccggccgggatcggcggccaggcgagctcgggcgcccacggctagccccgatcttcggggatccacgcgcggctcggctgcagccggcgagcgcgaggtcgactgcgggggaggccgcggcctaggtgtacgggatcgggcggcggccgctgcgacggcgagctctctcggctgcgtgaccgccggcgtggtgcgggggactgtggtattctctttacctccaccggcctctcgcgacctagctgtttcttggtcaaagtcaaacctcctcctgattagctctgtatttagctgttcatagtgatgtcgatttccgcttttcccctgatttgctctgctgctagtatcggatcgaattcctgctgacggggatgctcctgttttgctcgttaggntgatccaggttgcatgttcctagtgctagttggttgttgaccccattggtgagagncttttttcatgttaagctgtggtttctggtcgatgaccaaaaaaaaaagaactcttgctgttgttatctttcggttccagcatttattttgtatagatccatggtgcatttaatccacttgcctctcatgccttgtatatatcttaaataagtttggctagcaagaatgatgtacttgatgcctcgatgagccacagtatcaatgtgtgtgttacgtgtgatttagctatagtctgatgtgctacaaatctaaacgttagttcttatgcattggtaaactctgtatgagtattcttgtgaatgttcacactattttctcttatgtttccatgtaggcatccaagagcttcattctcaagtttggatgttgaaggggttcaggaagtagagcacaccaggatgtctgtcaagtgttccatta

SEQ ID NO: 47990 - DNA, 1501 bp, Oryza sativa
catggccggcgatatcgcccttactagtttttcttttttttttccgttcccctgtgccgccagccatcatgcagtgtgatggatttgttaacttatgaaacaagagagaagcttgtattcctgttccagcataacacctgcaatagcgtgagacatgtaccacctttttttttctccaattatagtcgtgtaatgcggtgcttgtgaattgaaaacagtgtgttcaagctttgtatttctcgcggcgtctgtagcagtaaaccgatggaataatttatctgcagacatccagttggacctacatatgttcttcctttttctttttggcaaatgcacgtccagcactcgagcttgtgccagttttgtgcttgtgatttggttgccaaatctcgagttcttagggagccttgccaaacatcatgtcgtgtcatccatttctttggtccttattggttgctcatatttgttttcccttattagggaataaaaattaatttatagataaaaattttgtgtgttcttagcgatttaaagccaatgctgaaaaacaagctgcgttaaaagtattttaaaattaacttcaaaattaagtttgaaaatttaaattttggttttggctttgacttactagggtaacagatgaggctcttcaggtcgtgtcatccaaatcggcatgcttctgaggtagttttcattttaacgaaaataaaagagtcgatatccacacgattgatctcaagccagtgaaattaaggaaagtgtttttcaacacggtgatttcttccatgcctgaatatggaacggagagtactattttcctgattttgcaggcagtgtctcatctgccgaccgataggaaaatggtactccatggctgattatgtgtgtgtttttttctcttggcaactaatactccaacttcattgacaatgccattataatatttgtagtgtatatttcttctattgtctgttttatctcttcctcaaaattttcacaagtttttgtttctcctaggctgcagcatatattgcaatgaatttaaccaattctctaatactgatacgtattgcgatgattgagctaatgtctgcgtactgcgtactggcatgtagtttcagtttaagaggtgacatcaaattatcctacactaataatgtgctatttttggcaacattttcttcagtaatatcaacactccgtaatccgtataatacagttcaggggtatgaaactgaaactgttggatttgttacttgatgcggattttgcaattgtcacttgtcagcattgaagagcttagatcttagttctcactcttaaattgattcttgatctgctgtgcatgcataacagattgcttcctttcgagatccctagctattgtaatgctgatattagcgtggtaattttcatgcaaacaaagacatgaagactaaaagtcttttcacaagggtgataactaccaactcggtagctgaaactcaccaagaaaccaaag

SEQ ID NO: 47991 - DNA, 1501 bp, Oryza sativa
tgaagtcctactcttcaaaaagggggagaacagactcccccaaatcaccgacttcttccatcacgcccttacgcgcatcgttagccgtcccctgatccaagatcctctggaggtcgagttcagggtgcgccaaccttacgcacgcaaggacgtggcatgccccagtgtagatcccgttggacgtttcctctctgatcctggccgcatgcttggaggggatctcctccatcaccgtggccatttccgcgagtgaagtcgtcagcgagaactcatcgggattcgccgggatggtggtcgtgacgccgcactccccggctagctgatgcaagctggtgtaggtaacccgtagcgagccacggatctctgacaaattgttctcgagctccaacatgcggtgctcgagcccctgccgctgccgctcgttgccagccaccagctccttcatcttctggaggtcctcgcggacctccgccaggtcatgcgccaacttgtcggtgcgttcattagccgacgacgccgccgccgccttcgcctcttcgatcttgtgccctatgccacgagcaccggcctggaggatacgctccatctcgatctagagctccccctaggtgaggacgtcggcgtgcgggcccctagcaggcacaaggccaccggcaggaccactgggcgtcgcctcacggcccctcggtgcgaccacgacatctgtcgaagtcgctgcaagggacgtgctggagtttcctccagacccgtcctgcgccgccttcgcccgcacagccctatgaatgattgccgcagtttgccatcaagacaggctaccaaagttcgatggattaacaagacctcaagttcgtctacttacttctcgccaagtgtcaccagcctctgccgtcacggaagtggaggagacgcatccgaggcctaagtaaaatgagtacgatgtgaggacaatatctttcgactacgcgatgaatgaccaaaggggcttaccgatggggtgggtgccttacgacggttaccgagcacggaggaaaacttactccccctcttcggaacattgccgccactggtcgtagcagcagcagcaacgttggacgcctcctgggcgacgccctctttcaacgaagtcgtcgcctggtggtccacgagtggcccgatgacgtcagtcagagggagagcctgcaccatatgaagtcactatgcgattcgggaagaaaaatataaaggggtcgtcgactacactcacgttgattgcggcttcacgctcggctgtccccttctcgcaaagggggacagggacgttgctcgtcgttgtcgggccgctgatcatcacttggctgacacggcgctccacggtttcgcggttcaaacctgtagatcgagaaccagaattcgataagtcaggaatagaatccaaaatacaagaaaaataccccgaggagaaacctgggtcgcgtcctccggcccagaatagtcaaaggctgggtgggctcgagcctggagc

SEQ ID NO: 47992 - DNA, 1501 bp, Oryza sativa
gctggtcgccgtcaccgataactattatgtttgtcgagccaatattaaacctcataatcgatagttttgacccagtagaggagttaactagaacctgtcacttatgagtcatcttcgatgggcctctactataaaccgacaaagatgaaatagggttgagtacgtaaagtggaaaataatgaattcaaaacacacgaacagtgaaacataagggattccgataacaggaaaacacacggcaaatagatatagagagtgaggaagaatgagtgaaggaattgttcttttagctttggttggatgttttatttcctatgaaactggaggaatgcatgggaaccattctaaaagaatcttgtacagttcatttgaaaatcccatgatccaaacagggccttactgccttagggtttataagtaatgacaaccagaacatctaacatgcatgatgcaaaagttttaagaagttcaaaatcttattggtttttatcattagacattttcatgttattacattggcactatcccatgaccgtgcaaaagattttttggacctttgaattgtttccctatacaattattattcaacactagcatgcatccttaatatcatagaattggttttgttttcaaattttataatttattgctgacaactataattaatgtaacaatactatattcatattattttggggattttattattttaattgttgctactgttgttgctgccgctgctactatattgatcctagttccattatttatgactttatttggatttccatgcagaatgaagtgtccttgcttatgttggaagctgatccccaagatgcatcctttatgcataatgttcatatggaagcgaaggaaaaagtaactaataaatcaaggaaggatgtcaaggcactaactgagagatacacaagcaacacttcattagtagcgatccttatagcaacaattacatttgcagcagctttcaccttgcctggaggatatagtgctgtggagattatggttaccccatatctacatggcggttatattccagctggatatacggtaccaaatatagatagaatatctctatgaggactcgggttagattctaaacttgtatgttaagaaaatacctgggatcctagtcggttacgattgtattttatctgtaatcccatatcccgttaggatatggactgtactttatattacagatcccttccccaatataaggaggggtccgggttcctctcgggacgattcttttttctcccaatcatacaatcaataacacactcggcggaatcatctccggacaggagtagggtattacttcttgaataagaaggcctgaacctgtataaaaatttcttgtctccaaacccatccactttcctagcttgatagccactcccttttattattgccgaaatcttgtttcgacagttggcgcgctaggtaggggtagcgtcaagttctcgccgactaagtgcga

SEQ ID NO: 47993 - DNA, 1501 bp, Oryza sativa
attggatgcaactgaccggcggtgttcatcgccggcgaggttcagcgggatgccgggaggctgcgctagaggtcgtacgggtgcgtgaaggctgaggaggtcacgggaggtggcgatgtgcatgtgttggtgtcaaagtcgttaccatgtaacgtgaccaaagcccagctagtagggaggttcggtttttttaccgagattgcgcaggtcttgatctgggtgtgtcatggatggagtcggcctaggactcgtctctgttttggcacagaagagcagatcgaggggaaaccatgtcgggcacggaacgggaatcggaggaggacaacgattcgttctgcaatcggactctatttttcccaaaataaaagcagcagaggaccacgggattgcatcacaaagcaatcggaacaaatcacctagcagagggcgagattcgtacccaattttcgcagaggtggaggtgctttgggcagcgaggtcccaggtgcggcaggaggcccattacaaggttttcgggctaatgccacaaaattttgggcaacgacgtgattttcgttgcaatacataggggttattgctaccgaagtctaatttagttgcgatgggggggcatattaccactaattatgtagtgttgcgattctaatttttttgttgcaataactaggaagtatcgcaacgaataaatctgcgttgtaattagggtgatgatattgccacgctttatgttattgttgcaatagttatccatgtcgcaacgaatttagagcgttgttataaggttcatgtatatagcaacgcaaaactactttgttgcaaatgagtctataggtattgcaacgcaaacctaaattgttgcgaattagtctataggtattgcaatgcaaacatgaatcgttgcaatcattctttgatattgcaacaaacaccgaaaatcgttgcaactaacaaggttctctcgcaacaatatttcgtcattgctatagtttaacgaatcgttgcaataggtgagattggtggtgccacttgcagattgttcatgggcccttgtattgttaaactttaagttgtcttgcatcattattgtggcccgggccaggggtcatgaattacgtaattaagtcggccggccaactagctgggctgaatcgttgaaaaaaacaggtatgattaaccctacccttagcaatcgatagatagataaccctgatcagactagctagcgccggtgaccctagtatatcttgcacaatcgccggcgacaccgaagcactcgacgctggcgagaccacaccctgtccctgtctcccaactcgatatctcgacgccgtccgaatcgatcaatatatttatatatattcaggtacctcttcgatcacgagtgcaatgaaaactgttgattctttttttctatatatctatgtaattaaaatttggtttatttcattgcatactatcccttaggcaaatttggtaacggattttctcacttggaatatgg

SEQ ID NO: 47994 - DNA, 1501 bp, Oryza sativa
atgccatttggtttgtaagatctgtatcaattagccatgttaaaactttttctgtacattcttgccttgctgtgtactatctctaggattggcatgtcctgctgttgtaagatggatcaactgtatcagcatccgaatttagttgtagtagctcttagatttagcaatgttgaacagtactactgggttgttgatcctccacatttttttcggtgcgttcctttgtcatttttgttagttaatgtggagtgagcccctacaataatctgatgagatgtgggattactggtttctttggtttcttggtgagtttcagctaccgagttggtagttatcacccttgtgaaaagacttttagtcttcatgtctttgtttgcatgaaaattaccacgctaatatcagcattacaatagctagggatctcgaaaggaagcaatctgttatgcatgcacagcagatcaagaatcaatttaagagtgagaactaagatctaagctcttcaatgctgacaagtgacaattgcaaaatccgcatcaagtaacaaatccaacagtttcagtttcatacccctgaactgtattatacggattacggagtgttgatattactgaagaaaatgttgccaaaaatagcacattattagtgtaggataatttgatgtcacctcttaaactgaaactacatgccagtacgcagtacgcagacattagctcaatcatcgcaatacgtatcagtattagagaattggttaaattcattgcaatatatgctgcagcctaggagaaacaaaaacttgtgaaaattttgaggaagagataaaacagacaatagaagaaatatacactacaaatattataatggcattgtcaatgaagttggagtattagttgccaagagaaaaaaacacacacataatcagccatggagtaccattttcctatcggtcggcagatgagacactgcctgcaaaatcaggaaaatagtactctccgttccatattcaggcatggaagaaatcaccgtgttgaaaaacactttccttaatttcactggcttgagatcaatcgtgtggatatcgactcttttattttcgttaaaatgaaaactacctcagaagcatgccgatttggatgacacgacctgaagagcctcatctgttaccctagtaagtcaaagccaaaaccaaaatttaaattttcaaacttaattttgaagttaattttaaaatacttttaacgcagcttgtttttcagcattggctttaaatcgctaagaacacacaaaatttttatctataaattaatttttattccctaataagggaaaacaaatatgagcaaccaataaggaccaaagaaatggatgacacgacatgatgtttggcaaggctccctaagaactcgagatttggcaaccaaatcacaagcacaaaactggcacaagctcgagtgctggacgtgcatttgccaaaaagaaaaaggaagaacatatgtaggtccaa

SEQ ID NO: 47995 - DNA, 1501 bp, Oryza sativa
acttggctcctgtaggctctgactttgtaagctatggtggatgtgttggcggtgagattcgagatgccttaggtcctctcgggggtcccttttataccgctagtcagttggtctccaagtaggggagacatcggaccctacacgatatagtgacgacccagttctgtacaagtaggactccttccatctgtggactccgtgatgaatttccttaacgtatacagaaaacgtccgtatacgtgcagatataccatatctatacacgacgtatatccgagggtagagggtataccttacccgtaaccctgacagtagcccccgacttctgcttaaatgaactcatgtaactgatcgcgacttccgatgtcgaggttgttgtcgttttcgcctgatcgatcttggtatgagaaccgtggagacaaagagtaatcgacaacaccatgcgaagttcaacggtcatgagtgaatttaaattgaagtccgaaaaactgccgcgcgtaacggacccagaaatttccagcggtcatctctcctttccttggaattcgcaccatcggtagtgcgtctatttaaggaagttttggggatccattttgaagtccgcttgttgcgaaaaactctccagcctccaagcgttcctcttcttctccgctcccgcaaaaaccctagcttgctcatctcggtcctttctccggcgacctccggcggtaatggatctcgacaagtctacttctaccagtgcgtcgttgaagaagctgcaggaagacggcgcccttctcggtcacgggaccatagagagaagcaggaggtattgaacccagcatgtcctgggccgcatggtcgcggtcgaggactatattctctgtggttttcttcctccgccttctgagtttcttcttttggtcttgaatttctacggtctttctttgctccatttgaaccccaattccatcgccttcatcagtatcttttcgcatctttgtgaggcctacattggggtagagccgtttcttgacctctttcgtttctactacgaattgcgttggatggaatccaacagggtatctggatgcgttggtttctgacttcgggatggcctgaagtcgcgctatatccccttccagtgcccctcttctcatagtaaatggcgggcgaggtggttctatcttcagatagaaaacttggatccggtcttcgttgttcctgaggaacagccagacaagatttcgtcttggaccgccaaatccgccttaaccccttcccttcagtccttcatcgatatcatcaatgacctccgaatacgagggttgtcagggtatgaagtcactgccgacttcattggtaggcggatccagctgctccaggctcgagcccacccagcctttgactattctgggccggaggacgcgacccaggtttctcctcggggtatttttcttgtattttggattctattcctgacttatcgaattctggttctcgatctacaggtttgaaccgc

SEQ ID NO: 47996 - DNA, 915 bp, Oryza sativa
cgctggcttgtggttggcacggttaatgtttcacaaccgaaactcgtgaaccggtccttaattgtcatgagcacgaccatcaaaaccatgtgctcacaacccaccattatcaagttttagttggcaaattaattaattaaccaatcacgattgaccatcgtgagctatcattaagccatcattaaataatagtgattcataagttatcccaatagtgtgctaatgtttctaagcatggctaagcaatcatatctaacatctagctgaaccattatatagagctcaactagtcaagttttaataacccaaggtatcaaggaataaagtaatcaagaacaaaagggctatggcaaacaataggttaattccacccaatgacattcgaaaatagatgcaatagttgaatagaaacaatagctttaaataggatcaacatgcttaaagggttgtttgggatctgtgtgacctgccttgctggccttggaactcttcaaactcttctgctgcgaaaacggactctccggaaacgatggaatctaagcagaaagaagcaaaatcaccaaaacagcacataaacaagcatgaacagtatatgtggatatttttaacatgtagacctcaattttagaaaaatttagagacttgaaccaactaaatccgagctaagatgaattagttatgaatttttgaagatttaatcggattgaaacacttatatggattttaattgaattatgacgcaataatgaattatttttgaaaaggaaaaagggaattattgcgtcagcggctagggtttgcggtggaccgggcgcacagcgacggttcacgggaacggagggccgagatcgatccatccaaaacggacggccgagatcgatcggtccacgaccagctcacgggagacggggacga

SEQ ID NO: 47997 - DNA, 1501 bp, Oryza sativa
tatgacggaaatcccagattacaaagggaatagtggaactcgatgataccgacgagatcgtagtcgaattggttcaactggatcactcggcgacttggctcctataggctccgacttcgtaagctgtggtggatgtgttggcggtgagattcgatgcttaggtcctctcgggggtcccttttatacgctggtcagttggtctccaagtaggactcggagatatcggaccctacacgatacagtgacgacccagttctgtacgagtaggactccttccatctgtggactccgtgatgaatttccttaacgtatacagaaaacgtccgtatacgcgcagatataccatatctatacacgacgtatatctgagggtagagggtataccttacccgtaaccctgacacaaactagttgcaaatgttctgatagttgccatgtatgaaaaccacatgagcttcttagtaataaacctgtaatgaagcaaaaactggagatcctcccacttggctatgatgcatatgaatgcaacagcaaatgaggaacatattgctaaggtgtctgagatcaagaaggcctgaaatgcaacctttttttgccataacaggaagtccctcacttccagcatcagcactcgacgcaggtcattaatgaaggcagctactccatccacgtcgtcgtcgtagcgatttggtgaatggcggtgacctcgtgttgcacggcgctggttgactgtgtcgcgaaggtcgacgggacactggtgaggtggagagcgaggccgttcaactcggcgctccctgtgacgttcgggaggcgagtgaacagatcgttcgtcgtgacccctgctcctgcgactagatcctgtgccggtgatgctgaggcttggctgatgataatcatgagatcggaagtgagggactcggctaccagtcggggtgcgggtgcttgcggagttggctggaaccgagacagcgatcatggtcttcgtttggttcaagatgttgacaacatgatcagcttggttgagtgcgtcttccttgaggagggtgttgaggagagtgattgctgcaaccgcgttctgctggggggtgcgaaagaccgctgttccatcgacgtcttgttgcccaatgagttctctcgctcggcgcccagattccaaggcgcgttgccgtcgatcttcagcctcctttgcaatccgttcgcgatcttgctgctcacgctgtagtcgttctcgctcctgtcgctgtcgctcttcctccagtcggcgacgttcagcttcttgccgtgcgcgatcttggtctgcttctcgggcttggcgctgttcctccatttcgttgtcagccatgaatacgccgaagaagaggggcgtgtagttatcctcatagctgtcgtcgaagttgtcgaggtcaccgtggtcgtagtggtagccgaaatcgtcgtagtcgaggatctcggttggtcgagaactgacgccgggggagctaaggtaaccatccaactcttc

SEQ ID NO: 47998 - DNA, 253 bp, Oryza sativa
ttttttaaaaaaggggaaaagtttttttttggatttttgagcatgatgtgtacatttgtacgaagtgtgctttttaccacttttgtttttttttccaaacaccaaaacaattttgatgagtttgccaatgtgttcatgaagggggagattgtaaaatcaaaggtgtttttgttattattctgtgatgaacaattgggcattggagattatttgttttgttatttggaattttttcacgaagtggttttggaga

SEQ ID NO: 47999 - DNA, 1501 bp, Oryza sativa
agcgttgttcctggcggtaaaaacacattttcgaggcggccaaaccttccgtatgtatctaaaggctcgtaaaaatacctaaattttacaggcagaccaaagcaccacctgcgaaaatgattttcgcaggcagcaaatccaatctttccagatgctgtaggcgctacagtgcacgccgccgttgtcgctccctttcctctagccagatctaggagtggggagggagagagggggagccgccgcaccaccgtcgccctcctctcctccagtcagattttgagggagggagggaggagagagtgaggggcgtgtgtgagagagtggagaggggaaatgagttgtggggaggggtggaggagaagataagaatgacttagatttttttttatgcatgatttttgcatgcggaccatataacgttccgcatgagaaaatcaatttttttcagccggctacttaagaggtccgtctgtgccctgaaaaattgtttttcgtagacggatgatgaaaatacactccggtttacattttcgtagacggacatttggctccgagaatcatatcctactagaaaaataaaaggccaacatcactaaaaatcgtttttttaagtagtgacacagtgttcgatgcataataaaaccgttacaaaccttcctatgtaacgggtaaaatcttttctagagatttagtgctttttattagagctgcggccttgaacatattgaacttaaaacagaatataaatatgattaatatgaatgcttctaggtcgttttcatttcttgagcttaccaacctcccattccttattttccacacacatactttccagactggtaaatgaatgttttgtgaatttttttgaaaaaaatgcttttaaaaatcatattaatattttttaatacttaattaattgtgtgttaattatcgttccatttttcatgtacgaggaataattagtttcgaatccacaccaaagaacacatatatatatatatccttgcaaaaatacgctgacagttgacatatttcaaaaggatgtcccagaatgttgtaatttaactattacacgatattttcttctttcttttgttgcaaaatacgtacacaatcattttctgtcgaacactcgcgttatttctcttcttctctgacaaagtagtttagcccagctgggcatgtcgatcaacacgttaggcccgggttttattttcgctaaaaactagtaacattatagtcctattaatttcttgacatgatccaatatgttttttttgcctaattaacagagaaggcttccagagtgttaagtcatccagttggagtactccgtactttgtccaaaatattgaacggaaaacagataatctgtgcacacaatattctaaaattggaggtaaaattccatggaggaaacatcaggcaccgacactaacctatcagagaatgtagtagaaacgatcgacagatatagatggccaagaggcccgaggcccga

SEQ ID NO: 48000 - DNA, 1501 bp, Oryza sativa
tggtgcacgactgatgtgtgactttgctggtgtgtaggagccctaggattttggtgaagagacgaagtggactgattgtttgaaggaatcccatttcctccttgagttctaacaacagaagattgaccatgattaactgtcgatgctgcaaatcctgatgaattcaacgatgttcctccactccttggagattgtctaacaggaccatcagcatgttgaaacctgtcacgtgcaccataatcccttctaactgctgggccagattgtacctttgcattgtcatccatcttcatagaagatggaaagactttattggaaccccctgcttgcatattgtcccttctttgagctggcacagagaaatctgggttggaggcaccagagggataaaatggtggtgacgctgaatttaagcttgaattcacaacattctttttaggaggggccatttctgactgcgcatttaaagtttggccactctctctgacggctgaagcacttgcagcagactctcgtgatcttgcaggtctgaacaagtaataataagataattatgtaaggcgaaaatcacaagcaaagctgtgcagccatgaaacctatttacagtcaagtgtccccagtggtgtgtgcagtattgtgtttttgttgggtagttgggaaggattcaaaataataatcacttactgtttccgctggaatccaacaacatctcggttgttctttgcaacagcttcataacgtcgaggtcctctccctctaacaaccttttggggtcggttttggtggttgttgttgatatcttcattataaccgcgatactttccacctctggcaaacccatgaccagtgccccgagttctacccccaccaccacggcctctaaagcgaccccttgacattcgcttatcctgcaatgcagaaatcctacctcaatactaacattgaagaaaaagctatcatttgcacattaaaggaattggacagatacctcatagtgctcctcatgcaaattcatttcctcaaatctgtcatgcacccacgcttgatcatctttagcgtcccataacttcctcccaccaaacattctcctgctttcagaagaaagtaaaaaacaaaatcagcacagttgaagagcaagatctcatttagcagccactactatccaatgacagactgcagcagggtcaaaatataacgataaccaacatgagccgatgctcaatagattagctgtagctactatatatttagcagacgcttgccaaccagagcatccatttgcagaggagatgcaaaatataattgacccaggaagctaaaacatatggtggaagaagaatgatgaacatgctctattgctgattgcacattgaaaatcgttagcatacaaacaaaaggtaagctcgcagctcactcttcccatgttggtcccaacaatgtggcacagtttttcatcatcatggaatcaaatagagggggtgacaaaccctctaatgaatgc

SEQ ID NO: 48001 - DNA, 1501 bp, Oryza sativa
attcggtggttacatacatacgctatgtgtgggtgcatgttgagagcgtcgtggaagaagtggacggaaggaagatgagttggcttttaagctagtagagatgtaggtaaaatatttcagtcactttgcattttactgggccatgtacgagcggcacctacggcctacaaggtagtatggcgcacaaaccaacagcctatgttggccgagctagcggcaattcaaggaataagttcacttttcatccctcaactttacgtcaagtttgtttgacatccctggtacaaaaccgtgtaacttgtatcccatggcagtattgacctcattttcccatgtttttgctcatgtgtcagttgtccggccccacttggtcaggttgcagtgacagtgaaagatttgtgcaatgacgacgatgcggagaggagtgtaggcgcaacaatggtgatgacgaggttggacggccaccacatcgccgctggctccaccatataccgccaaaatatttccacccacctgaacctaagcacctaatcatccacaagctcgatcgctttacatgatataagcaacaacatgaaacaatcatgagtcgatcaaatgatccatggtcgaagatgataaaaaaaaagagtcacttttgatctgtcatggatggtagaaactagcaagaaaggtgtgtggaatgtgagcataggacgacgaagaaggagatgtgtttgccatagaagacgaggatggcggtgatgacataggtagcgtacaccgtgctggcaccaaagttggcaaagaaggagatgaacacgtgctccttcacattgagcggctccgggttgagggtgaactctaacggccgcgcgcgcgcagaagaaggcatgctcctacagtaccaccgccatgaggcagccaagcggcacaacggcaatctgcaaggagatagcagtgatggtgtgcggcttcgggtagtaccagaagaattggttgagaaaggagagcaccgcgcacgacgttatccctagactgcacatccggaacatcagcaccaacaactcgtgggtgaagcccacgcatatcaaccgcaattgatgcatgttcttaaataataaaccatacctgtgtcggagacaccaccagggctgagggagcttaggcttcgggaggtcgttgacctcctcaattgttgccgcctcccgcgataggctcaccgggtatgtcagccgccttaagcccccttgcgatcttctccatgccggcaagctgctagggaaaagaggggagagatggagagatgggcaagaaaggggataggtggggagaggtggaagtctacttacgcgtgggctctatatgttttcttttttctttttgctaactaggatgtcacatcagacaatacttaacttaacttggcacatcatattgccttagacaaacttgagtagttttgcaaagataaggggtggagatttttggtattgcgatttcagggacgtaaattaaactc

SEQ ID NO: 48002 - DNA, 587 bp, Oryza sativa
aattaccttgattctgcttcagttatttctatttgtgtggacaccacataatttcggcatccaagaagggtggtaataaagaccatacacagtcagctgcgtgggttttctcctctagtctccatcatataggaacaccatatttgctgtaatatttaattaagaaaatgggccgtaatcagttacttgatatttctccatccctcagctgatttttgaatggccaagatctcatcaagattcatgcaaatcacataaccctatctcctctcctctcctcctgcccattggcccatcgccaatccgtgccgccttcgctgcctgaccaactgaccagcatcaccattggctgggtgagaatcccgccacacacactctctgtgtccctcccttctcctgctcctcctacatgttgatcacatcgccctcttcagtaactctggcaagcttcccctgccccacctcccctaccctatgtctggtgagctgcaccactggatccgctgtcgccgcccccacctgagccgcctcctagacacatgacgtcctttgcctccaatgccgaatctgcccactgcccttctcca

SEQ ID NO: 48003 - DNA, 540 bp, Oryza sativa
agtcttagcatatcaatttagctatatcggctgcttctcaatttagctctaaatcgcgttgctagattagattagcttagacatctaccaccctgaaaactcagtcaacggcttgattgtctagatattgtgtttcttttcatacttagtgctgcatcagttaagtttgatccactaagtcgtgcttagaaccataatctctagcctgcttcttgactgccaataagggtttcatcggggtttcagccgatgagttatctaggcgttgcatcggcttacaaggattgcatacatattggatttagccgatcgcaacatagattttactgtttatctaatcctgtggatttaatgacatcggacctccagccgatgtatgctttaaccttcggatcagtgcttattatatcttgtttctagccgattggtttatactagattatattgttattttattacatcatcatcagccgattgactttatatcattatctacattggacatatagccgattgcttaaaccctatcgctatcggctg

SEQ ID NO: 48004 - DNA, 1420 bp, Oryza sativa
agattattataagtaatatataagttattagtatagttttctctattataatcttcccacaggattaaataaatacgatacccttgtaatactctcgggtgaaatgctacaatggtatatccatatgcttgcagatgaaatgtgtaaccataatataccacaagtgcttttgcgccattgctgggaattatatttctagtaatgtccttaagaaatagcaacaagcatttctggcgccgttgccgggaaagatttataaaagagattactataagctaatactttatatttacccttgtatagtccctgtcctttgcaggctaaccttggttgttttcactgttgttgtgaaaacagggtagtgtatgactggtttcaacttaccggaaaatttcaaagaaaatccaaaagttttctttcggagcgttaagccgcaagtcgtttctccgcagaaaactctcccgacaaagaaacccgctatcctagcgtcaccaagcttcaagacaatggctgaaaggactctccgcgagttcgctgccccctcagctgagaatgtgctcgttgggccgcaagttagcttaggagacacagactttgatctgaaatcgagccttattactatggcgcaggctaacgatggatgagtcgatccccaaagcttgggaacgactccaggagtatgtggccgcctgtcctcatcatgggatggaagagtgggtgatactccagagctgctacaacgggctcactcccatgtcctgcgaccacctggacgtggcagctggaggagctttcttctctaagacggtcagaggagccgtcgacctcatagagaagatagtctccaacatgggttggagcgaagaatgactccagacccgtcagcaagtaatgcacaccatcaaggatacggagatgctcgctgcgtaactagacctcctcaataaacgactggacgaccatgagaagaagccccaaggcaccgtctaggccttgcactcgcacatcacgtgctaggtctgcggtagcacaggtcattttgggaacgactgctcggaaacccgtgaggaggcaatgtacatgggcaacaaaaacaacaatgggttccgtccacaaggaggtcaagggtggaaccaacccagcccgtattaccaagggggcaataatggtaacttctctaaccagccctccttaaaagatctcatcttttcacaagctaaaactactgatgctcttagcaaaaagctggctgccaatgaaaagatcttaaaaaatataaatgtcaagctagacggcatttcttccgcattccaaaatcagctaagctttaataagatgatagagacccagctggcgcagctagctgcctttattcccgctaatgaatcagggaggattacgggccacctggtacactctg

SEQ ID NO: 48005 - DNA, 180 bp, Oryza sativa
acgcaataatgaattatttttgaaaaggaaaaggagggttattgcgtcagcgggctagggtttcggtggaccgggcgcacgggcgacggctcacgcgaacggacggccgagatcgacttgatccaaaacggacggccgagatcgatcggtccacgaccggctcacagcgaacggccccga

SEQ ID NO: 48006 - DNA, 1501 bp, Oryza sativa
aggcccggccctggaggagggcgatcagtgcggctgtctaagcccccaaaacccagtgtaagttggacgtgtggcaaagtcttaacacatgcgccgtgcggcaaatcctaaatgttcgccacgatatttccaattggaataatttcaaaatgactcctttaaatgtgaccctgaaccataaaaccagatatcttgagcccctaaatatttaaatcatgtacaatccaactccctcggtggttttgtacagcggtttcgctgacatggctgtgttgacctagttttcgtcacacgtggcgtttgacatgacgcttatgtggcattagaattaaaaattatatatgggacccatttagaaacaaattgtggggccctcgagcccctccgccgagcagcgcccctgctattgcccaccgctgccctcacctccatctcccgccgcaacgccgcctaccgctgagcaatgccctgtgcctgcccgccgctgccctctcctccacttcccacagcagcgctgcctgccatcgctgcccaactgcgtaagagagaatagagaagagaaggtgaaggaggagaggatgacaagtgggcctcacgtatatattttaattctaatgctacataagtgccacgtcaatacggccacgcaggtgccacgttagtgaaactgtcctccaaaaccgccgagagagttaaattgcaccagtttaacaatttaggaatcacgatatcaggttttgctgttgagggtcatggatagattagattcgagtcacttttccgggagtcaaagtgaacttatttcttttcaattccaccacgcaagtcatgaggcaagtagcgactcggtgtaacacctcgaaaaaaataaaaaaaacatatgttggtttggttattggttttgagttgcattcccagcccattgattctcccctaaaacctagagagagaggaggggaaccggaaacccaacctttccctcacccgtcgccgccattctccctcccctcctcctgtctgtatgtgatatcacatcccccactcctctacagcaacttgccttcatagatctccaccccatgaacttcgaacaagaaacgaagtggaaaaacgaaacaaggaggaggagaggagaaaggagaaaggtagatcagtgctccccattgtttttcccttggaatcttgaaggaaactctaagtgaggtttatccccttgtactatcagttgttctagggtgtttttagtgctttaattcgtggataaggaaggttagagaaggagttttatttgttgtgattcaatttggctgttctccacgttggcagatttacattgtttcggttttcgaagtttcggaggtctaaatgatattttatgcaaaagtgtataactagaaagttgtagataatatttggatctatcttctgaccaaagggcgcgaatttatctcaagtggtttaggcgatatggattttttagtacaactgttgtttctatgtc

SEQ ID NO: 48007 - DNA, 727 bp, Oryza sativa
ttatgattttcactaagaaactatattgatacatatatatgacaactttacttaaaaaatgacatggtttgaaataacatcaatataaacaacccctaagtttagaggcggtaattgtgagtgctcacttttacttctctcttggtacagtaaatctggaccatattcgatgtactacctaatataatactcccttcgttttacattataagttatttaaatttttttttctgagtcaaagatttttaaggcttgaccaagttcatagaaaaagttagcaatatttataacactaaattagttttactaaatttaacattgaatatattttgataatatatttgttttgtattgaaaatgttagtgtatttttctataaatttgatcaaacttaaaaaagttttgactaagagaaaattcaaatgacttatatcatgaaatggagtgagtacaataaatatgtactagattatgtctcatcttattctaagatactctctctgttctaaaataaatcaatctcatactaatatatgacatatcataatacaataaatattgttatattttatatgcagatttattataataggatgcatcaaattctagtgcgaggtgaggttaatttatttttggttgacggagagagtactgtacagtccgtactaaatcaaaatatagccgatgcatcaagccagttttttctttctcctgtgcgtctcaaagg

SEQ ID NO: 48008 - DNA, 1501 bp, Oryza sativa
attactgaaaaatactaataatagaacaaattaagagtaagacttttatacctgtattgttagcatcttaaaactcaatattaaaaaaggggactacgataaaaatactctaaaatcagctttaaaaatatttattataaacgagatgaggacttacaatacgtagtgtgtccgctcgggactactgtcgagagggcatggaattgaaacgccttagcaatgcttcgcggcgacggcaataaacgaagagagtttgagcatagcacagatgacccgatggatggcacgagcgagtatatatatgtacaaatcgttcatgaactgagggcacgaatgccgcgaagacttcgtataacaaatcgggggtggtggtcagctcagatgatgacatgtgaacaacaaggcgaagacttgagacgacgtcaatgggcctcatcgtttggaacagtactaacctaacaagttgttgggtttgctgtcccgtgtaccatgcatctgtttctgaatgtaaaatctctttttagcacaaattttatcacttctatagtattgttatttatttcattaatatcctcttattttaatctatctataagttacggacaatcaccattacatttctacgtttagggcaaccatattgtggctcaaaagcagacagtaagcaatgaatacacttttattatcaggttataagcattgtaaaaagaggtaacaacaactacttgattgtagtgttactaccgggtagcaagcataggaagttagcaaccaaatagcagataaggaacgtagcaattctacaggataggaaataattttttttcttggtggacccaatcttattctctatggcaggcaacaaacattgtgccctctatcataaactattacctcctgctgcttgggcccacactaatatcaagttgggttggatagactggacctgttctgctgcccgggctgcggccgcagccggcaagaacagtgctgcactcactatgcacgactgtagccatcacagtcggcctgccgaacatgcccactgagaatatccttaagagggagtggtggtggtgaatttgccacacctttaccaccgtctacttttatttttgcaaacaaaaaaaaaaggtcctacatgtcaagctccccacggtcaactttttacttttctgtgagaataaaatatataatgctgttagtaacaaattaaataaagaggatatatattgaaaataatggtaataacgagttaatgatatttttagttaaaacttctgttgcacagataagatgctaaacaacccaaatatatggccttattaatttcgcttatgcctatacttatattacttatattataagctaaaatttaaattataaaacttaatattttatttttctatcgatgtttatttcacaacatttatttttatttttgttactaaggacacgtatataaaatttacttataaattatttttatttgctaataaga

SEQ ID NO: 48009 - DNA, 1501 bp, Oryza sativa
tagttatacacttttgcataaaatatcatttagacctccgaaacttcgaaaaccgaaacaatgtaaatctgccaacgtggagaacagccaaattgaatcacaacaaataaaactccttctctaaccttccttatccacgaattaaagcactaaaaacaccctagaacaactgatagtacaaggggataaacctcacttagagtttccttcaagattccaagggaaaaacaatggggagcactgatctacctttctcctttctcctctcctcctccttgtttcgtttttccacttcgtttcttgttcgaagttcatggggtggagatctatgaaggcaagttgctgtagaggagtgggggatgtgatatcacatacagacaggaggaggggagggagaatggcggcgacgggtgagggaaaggttgggtttccggttcccctcctctctctctaggttttaggggagaatcaatgggctgggaatgcaactcaaaaccaataaccaaaccaacatatgttttttttatttttttcgaggtgttacaccgagtcgctacttgcctcatgacttgcgtggtggaattgaaaagaaataagttcactttgactcccggaaaagtgactcgaatctaatctatccatgaccctcaacagcaaaacctgatatcgtgattcctaaattgttaaactggtgcaatttaactctctcggcggttttggaggacagtttcactaacgtggcacctgcgtggccgtattgacgtggcacttatgtagcattagaattaaaatatatacgtgaggcccacttgtcatcctctcctccttcaccttctcttctctattctctcttacgcagttgggcagcgatggcaggcagcgctgctgtgggaagtggaggagagggcagcggcgggcaggcacagggcattgctcagcggtaggcggcgttgcggcgggagatggaggtgagggcagcggtgggcaatagcaggggcgctgctcggcggaggggctcgagggccccacaatttgtttctaaatgggtcccatatataatttttaattctaatgccacataagcgtcatgtcaaacgccacgtgtgacgaaaactaggtcaacacagccatgtcagcgaaaccgctgtacaaaaccaccgagggagttggattgtacatgatttaaatatttaggggctcaagatatctggttttatggttcagggtcacatttaaaggagtcattttgaaattattccaattggaaatatcgtggcgaacatttaggatttgccgcacggcgcatgtgttaagactttgccacacgtccaacttacactgggttttgggggcttagacagccgcactgatcgccctcctccagggccgggcctgtgtcctgtgcaacaatctgatgcattgcgagtagtcctgtccttctggatctctcgcgtatgtgtgcctgggccaatacagacacccggccagactcagtcaccat

SEQ ID NO: 48010 - DNA, 794 bp, Oryza sativa
caggcatgcaagctttcaaatcagagttccttgatatggtctgatattatcgatatatcttgtaaatgatagcatattatatcgttattgttcaaatatatgtgtcacgtgttgtttgatcaataatagcatacattgttaaatctttaacttcatgtatataatctaaataatgtactctgaacattattcatgtggagcttatgtaatgacttgtatcttttttttcaagttcttgtttattgttattgatttgttaactgcaaattatatgcgagttttcatcacagttttagccttttagggatgttcaatgataatttgtgaacaatggaaaaattaatgcaaactaatgtgtcacatacttgattgtaaaattattacaaggatggggatatgaagttgtaaatttctaattcattggtaggggtaaaaaaaagttttgttaattaatagtaaattaataaattagtcttgagctcatcttaccttcatctccatagccactattttttgtccatcacttccggttattaaaaaaaataacaacataccaagcgatgtacagctcagttgaatattgggaacagaatatatcattctgggtaaaatgatcatgggagagcctgagatagcatgattttgcatgtctgggcaaaacctcaccatgaaaaattcagatcttgaacaaaagttgactgaatttgaagcagtttaatcaaacttcaaccaaattcatatatataattgcgtgagactagtccaatctaaggtgcacccatctggggtgtaca

SEQ ID NO: 48011 - DNA, 1501 bp, Oryza sativa
tgtcattagtgatccatgcaaatgaaggcgtatacaatactggcacgcatttccaacttatgcaccgtctcacctgatgttccctcgatttagactgctaatcgactgataaacaaggaaatgactcgttctggagtgcgtccatcaggttgcgcgccatccgtggcttgcatcaatgacttcggtgctccgatttgcttgttggcgttttgtcccaagtctgtatcggtattaactctaaccgtgggagttgttgcagtttgcccctttgagtgatttggactcgctgattcaagggatgtgccaaacggtcggaaatagtcggaaacggtatattattttattattttcttcgaaaacaaacggaaacggtcggaaaatttttatatttacaaattcatctatttagagccaacttcaatgtcacgctgacagaaattaaaaaaactaaattttgaaaacggtaacatcggtaaaaaaatattattattatattagttttgcggaaacggtatcggtacggtcgggaaattttcataccgttttcatccctagatgtgctccagtgcagtgctctcactgaaagtgaaaatgtgagatgcttctcatcgcgcaatcttttcaggaatgatgctttagctgaaggaaaatggtacatgttcaaaataattcttacaaaaactgaaactgatgcgacatattgtgagtaacatcttacttttccgtaaccaccaactgattggatacaacaagtagcgtatccagcagaatggagcgagttgtgtctcactcaaagatgcatgctgtttgttcacagagacgtctcccttaagaaaggtcggcgtcacgagagggaaacgggaagaataaatcggatccactgcccaagtaggaagtgctaaaaagctcgccgggatgacaaattccagaacaataggatggcacgggatacgaacatagaacaagctgagagcagaaaattcaaccttacaaaaaaattcgagaaagttcatgtcacatatccattcaagcacacttcacgcatcagaagaacaaagaaaataggacggtatttacaagtgcagaaaaaaaaaagagctcaagacttaaaaaatttgtaacaataaacaaacagtttggtatattaagagcagtaaggtaagagctaaaatagaataaataaacaggtttagtatgattacataatcccacacgtacgcacacggtgatcatcatatacttccagcaggatgcatgtatccggttggttttgcttgcatacaaaacactatgaacaaaggtggatcatgatcctgcttgagtttaagaatgaacgacttgtatatcctcatttcataacaagcgccggttgacagttatacacatggagatgcccgcggtaagaacatctcttaccacacaacctccttaaatggttgggatacttcaccagctatgttaagaatggcgcaaggatttatccaatgactcttgcatcctt

SEQ ID NO: 48012 - DNA, 431 bp, Oryza sativa
ttcctgcagcccgggttgccgaggaacgggacgcagcgacaacctcagatcggttcgtgggatttgtcgatgttgaccccgacgagtcacccgtgttgcatattttggaagaccaagagtcctctccgtcgatttcaccgcgagacgtcaacgtgatcaatacagctgagaccagcacgtccgcggcagctaggacgcctgctcaatagctacaagccctcaactcgatattgagagagccctttcgatcctgccctgaaccctgatgttgattagtaggcagtacgactataagagaccatggccaacctcaatagcgcatttgtagaggcagcaactgagcccccgctgcgagatccaccacgaggaaatagagaactagctaatgggaacgcagaagtataaatccctactggtgaacgttcccccta

SEQ ID NO: 48013 - DNA, 224 bp, Oryza sativa
tataccagcttccactgttttgcacatcccaatccaatttcccgacctctgtatccaattccaatatgtagttaagcattgtttactatcctgcatatgtcatatacaatgtttttgatcagtaacctttttcactttattaattagagatagtcaattagcaaaaagatatgtttatttcaaacttccactgtatttattttacaggagcagtggtggaaagg

SEQ ID NO: 48014 - DNA, 1501 bp, Oryza sativa
taagggagaacaggagggggaactactactgacggcgagcgagtggccggccgcgccgagggtgcagtcgacgaaggagcggagcgggagagggcggcggaacgcggcgaggacctcgccgagcatgacggggacgtgctccgcgtgggagtgccgccggtagaggccggcgtcgaaggcggcgccggagcgcgtgcgccgcttgaggtgctcctccagcgcccgcctctgctgccgcttactgccgtccttgtccctcgccctggccttgctcgtccccttccccgcagcggctctgcacgcgacggcgtcgtgcttgcggcggcggtggggagcggcaatggcggctgcgaggggatgcgcgggcgggcggaggtggaagacgaggaggcgccgcgcgaacatcgccatggtcgtcgaggcgagagccacacgcgacggcgggcaaggcgcggatagaacagcaagcagggtgtttgccaaccgcccgattaacaaatggacggccaggatttcagggttcgggcttgaagttatggattcgaggctttgagctcatcgtaattcaaacatgaggcctttggtatcaaaattcgaactgataggatattcaagcgaatttcgaaattttggttaaatctcaatgcgcacagtttacagtgaccagagtataatagtaggggaggaaacacagcaattaatgtaggggtgcacatgttactggcagtggcacaacagaagcaggacacacttatataggtgaaattccaaaaaaaaacttgctcaatccgttccgtaatggagtataacaacattggtctttatttgtccacgaacgttatttttctaaccaatcataattgtcgaccatttaatttttccctcgtacaatcacaaccttcatgttcactccatctacttttgatagttatatttcatcttagcacaatgaccaaggataagtaattctacttatcattcatttaaacatgttactagttattcatcgtaaataaacgattcatttgccttaatatttacatttctccatgagcatgtagccaatcttgtgtggaataatgccaatcttgtgtgaaagaatggatagttacatattaaatccgagaaagtcattaagaagatatctggttggattgaaatatgcccatcaaaagtaaaattttcagatttagaaatattgccttcaaaagtagatggagtttcttaatatccgtgtcaaaaaaaatcattattttctaggacggatagtactataaaacataaatttccagagagaaaatattgcacagaaatagccagctgaaatgcaacagaggggaaacaagaagaaatgcaggagatgtaatgttaatgatacaacagaatgcaggatatgctatgcttttatactttaaaacaaagattggttcctacaaaatggggggcagaaataaacaattcatatccaatgcccaaccctcttcttcttccttttttcttc

SEQ ID NO: 48015 - DNA, 1501 bp, Oryza sativa
gaactaatcttgttttgctgcttgcctcctcttcatgtataataggtttctggaactcttattgttgatgaaaaattggtctagctgttccccctccagcaccttgttgttgttgttgcctccatcaggagtgagaggggtatagggaagaaaaaaggaagaagaagagggttgggcattggatatgaattgtttatttctgccccccattttgtaggaaccaatctttgttttaaagtataaaagcatagcatatcctgcattctgttgtatcattaacattacatctcctgcatttcttcttgtttcccctctgttgcatttcagctggctatttctgtgcaatattttctctctggaaatttatgttttatagtactatccgtcctagaaaataatgattttttttgacacggatattaagaaactccatctacttttgaaggcaatatttctaaatctgaaaattttacttttgatgggcatatttcaatccaaccagatatcttcttaatgactttctcggatttaatatgtaactatccattctttcacacaagattggcattattccacacaagattggctacatgctcatggagaaatgtaaatattaaggcaaatgaatcgtttatttacgatgaataactagtaacatgtttaaatgaatgataagtagaattacttatccttggtcattgtgctaagatgaaatataactatcaaaagtagatggagtgaacatgaaggttgtgattgtacgagggaaaaattaaatggtcgacaattatgattggttagaaaaataacgttcgtggacaaataaagaccaatgttgttatactccattacggaacggattgagcaagtttttttttggaatttcacctatataagtgtgtcctgcttctgttgtgccactgccagtaacatgtgcacccctacattaattgctgtgtttcctcccctactattatactctggtcactgtaaactgtgcgcattgagatttaaccaaaatttcgaaattcgcttgaatatcctatcagttcgaattttgataccaaaggcctcatgtttgaattacgatgagctcaaagcctcgaatccataacttcaagcccgaaccctgaaatcctggccgtccatttgttaatcgggcggttggcaaacaccctgcttgctgttctatccgcgccttgcccgccgtcgcgtgtggctctcgcctcgacgaccatggcgatgttcgcgcggcgcctcctcgtcttccacctccgcccgcccgcgcatcccctcgcagccgccattgccgctccccaccgccgccgcaagcacgacgccgtcgcgtgcagagccgctgcggggaaggggacgagcaaggccagggcgagggacaaggacggcagtaagcggcagcagaggcgggcgctggaggagcacctcaagcggcgcacgcgctccggcgccgccttcgacgccggcctctaccggcggcactccc

SEQ ID NO: 48016 - DNA, 935 bp, Oryza sativa
aaaaaggataaaaagagatggagggagtaccatacaaacgtaaagcatcaatgcagattgatcaaaacgcttctcatatctttgatccaacgacgattaatgcacatggccatgcctccatcaacaacgaagtgcatgaggtgacgtgtaaaccaaattaatctcatctcgccctgctaattgcatttttcatgcctattaaatgcgccggaaatgcagatatatacatgaaaaaaatgatacatgaaaaaaatgacatatggtactctacaggagtaccagtcgtcgtactgttcaccacctctactctactgtttgataccgtctatttcattgatatctcccagcttcatttgtacggtgaatcaaagtttaatttaatactaaactagtattccctctatttcgtaatgtaagtcattctagcattgttcacattcatatagatgcaacggaggaagtaactgctaactagagtatgcatacatggtcatcacatggatcttaataactccgaataaaaaggaccaaaccaaaccaaacgattcgtacgtttatttttttttcagttgaatttggagacaagatcatgtgaactacattcatctctccatgttacagccatactagcatacatacggctttatactttgccatgatcattactactactccatgttgcaaattggcataactgcatattgaaggctgctattacgtccttgcatatctctctgtattctgtaaggtgtcgccaactcggatgaaaagtacagcacagtacatgaacatgtatatagatctcctactgaagtactgaagtggggtactaattatataaacactcttggaaagagaaaaaaaaacagcaactacttggcagtccagtataattatactggtagtagcattatatatagcttttgtagtactac

SEQ ID NO: 48017 - DNA, 360 bp, Oryza sativa
ttagtgtttgaattcttaaaacatgcttaacaactaaaatgtggaatggttggcctgggttggcttgggacgagctgggacccagggtcgggttgccggtttggtctgaatcatcgtaggcctggggttaaggcaggttcgtgtgggttcacggccttgataaataatattgcatagttctagaatcgtgtttacaaaatagctttgagcaactaagcatctttaaatgctgtttactgcaaccctaaccctttatattataactcccttgtactcccttgcatatattatgcacttgtgggtgtgtcttgttgagtacggtggttgtactgagtcttgctcaatttttcccaacccaga

SEQ ID NO: 48018 - DNA, 158 bp, Oryza sativa
gaagtgaagtaaacataatcatagtttagattgcttttctttctttcattgtttacataaagcctgcagggcattcacgcacaccaagagatatgctctcaccgtcaagctttattcccttcgctgcttgtgcctaaccctgtcgtttcatggccagg

SEQ ID NO: 48019 - DNA, 1253 bp, Oryza sativa
ctctccgtcctaaaatataaagagttttaagtggatgtgatatatcataaattcatgatactataatgtatcacatgtacctaaatctttttatattttaggaagaatggagtatctatcattggatcaggaaggagggcggtgccattatttcgggcatcaaagcaaagtatagcatgcttggcaaggaacgaattgaacctaagccttgtttagtttcaaagttttttttcaaactttcaactttccatcatattaaactttttatacacacacgacttttcaatcatatcgtttcaatttcaaccaaaccttcaaacttcagtatgaactaaacacagccttagctagaggaagccaacccagcccagcgcagctagctagccaaggcaagcgagctgacgtaccaatagcagtagcagttgctagcctgacacattcgttctaaaatataatacttttagctataaatctaaacaatatttatcataatttatctatattatagttaaaattaattatattttgaaatagacataatagctaaatttacaatgaggttgttatgatgctgctagctagcgtgtgtgagtctgccaagtgccaactgtacgtgtagttggagaacattcgcatatgggagacgcatgttcaccacctctcgcctgtcgtctccccggctcatctctctttcgttctgcccatgcatgtgtccatcttctgtgaataaccaaccacctggttttacttgcctactaccactggtggagaaaccatctttggtcggtcaaccaaatcccacaatagtcccggttccattaaaaaccgagactaaaaacgatttttagtcctggttaaaaattttttgatctggactaaagatccaggatctttagtcccggttcatcccctatcagatgtatgtcagggggtcgagaatctttagtcccggtttatactaccaaccgggactaaagattaccactttagtcccgattggtgataccaaccgggagtaaagatcgattgatttttactcccggtatcaaccgggactaaagattgatctttagtcccggttggagttatcaaccgggagtaaatatttctctcccacatctgatcggttaagtcccagacagatatttagataagattgaaacatcccctctcttcctcttctcacatccaatcctcttcctcctcccctccccttcctcttctcctcctcccctctcctccctcccatcagc

SEQ ID NO: 48020 - DNA, 212 bp, Oryza sativa
gaccgcacgggagaatatatggaaaattagccaaaaattgaccgagcttagttacaaacatcaaattaaatcaaattacatagaatgtatagtgtttgtaatgttacaagtatccccgcgacaaataaaccttttagtccacagcatgttccctctcccactcccttaggttcttgaatttggggtgcgtagcaagttcgctatgaggatca

SEQ ID NO: 48021 - DNA, 222 bp, Oryza sativa
gggtgaggatttcttgcttgaatagtcttgtgttcttagtagtcacactaattcagagcatttacatgaaatttggttgccatgacttcacttggcacttggcaggtgaaaagcaaacttgttttagcgtagaattagcagaccatatagccaactataacagttcaagagccatccacatttttttatgttgaagctagaaactgatttcgtgtgtttaga

SEQ ID NO: 48022 - DNA, 913 bp, Oryza sativa
aatatcctagttgtttctcaacaaaatttaggaaagatacatgcaacatcccagtgatgattggcctcatgccatgtgcccatccacaagaaaaattagtcactgattaccactgatgatctgctgaagattgtgttctggtggtataaaatgtgggaatctgcaggttccaaccagacactgaatattttttcacatcattaggtggcaatcgttttcatggccattaacattttaacacacacacacacacacacacacacacacacacacacacacacacactcacactcttatccaattagcaattgtctggtagtttctcatgtggttaagccaccgaccatgatagtatgatactgctttcgtcaaagaaatctttgtgtcattttcatacgacgaagtttccaagtaaatcgatattgtgtcggcatatgaacagattgggtggcaagcaagagaaggccaaagactttgttcaggtcaaccattaagtaatacaggccgttggagttggcaaattgattcagcttcttgttctttatttatgtgtttatttaacctgaaagaaacaagacgatccattttccccctgttagctgatggagataaggatcagagatattctatgtgcactgtaaatccagagctggttttaactgtactttgtttcttacaactcttgccaaacatttaatagatgttactaacccagtggcccagtataaatgtacataaataattttcataatatatgacaaggtaatgacatcaagaaccaatccaacataatgtccttatctttctttttgtacgatcgttcagaaagaacaaccacccaactgagaactcttcaatgcaataagctagtatcaatgatcatgaaccacatgtttatttttaatttcacaga

SEQ ID NO: 48023 - DNA, 1501 bp, Oryza sativa
tgaacaaccatacccggctgaacagatctaactccaaaccaggagctaagcaaattattatcaggtataacatccataattattgtgagaggtgtgagactaatcacgaaaaacattgctcaacccgcccataaccgcgggcacggctattcgaatagttttactctggccagaggtgtaccactgtacccacaagacacagctccacatcatgtcaccatgtgcctcagtaccaccacggtacctcggaaaggagctgtgacattaccccttgcataacacaacccaccgcagcgcaccattcctggatcataatcaccccctcaaaaaccagaggcatggactccccagcgacccccgtgggcttatctccgccacttctcagtctggtgctccgcaatgaaccatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatcattaaataataatgagtcataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaacaaatgcacagttgaaataaatagagaatttaaatataggatcaacatgctcaaaggattgtgtttaggatctgtgtgacttgccttgcaataatcggtcttcaaataatcttcttgaacacttccgacgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacacttatatggattttaattgaattatgacgcaataatgaattatttttgaaaaggaaaagaaggattattgcgtcagcggctagggtttgcggtggaccgggtgcacggcggcggttcacgggaacggacggccgagatcgatccatccaaaacggacggccgagatcgatcggtccacgactggctcacggg

SEQ ID NO: 48024 - DNA, 284 bp, Oryza sativa
atttagagacttgaaccaactaaatccgagctaagatgaattagttatgaatttttgaagattaaatcggattaaaacacttaaattgattttaattgaattatgacgcaataataaattatttttgaaaaggaaaaagggatttattgcgtcagcgggctagggtttcggtggaccgggcgcacggcgacggttcacgcgaacggacggccgagatcgacttgatccaaaacggatggccgagatcgaacggtccacgaccggttcacgggagagggcgatga

SEQ ID NO: 48025 - DNA, 337 bp, Oryza sativa
ggtattatgctggatgtatcgttggtgaaattttgttgcctttgctcaccatctgtttgtgccaatgtctgagtgaagattgcacttttgcttcttttttttttctctttgctagttttgctagagtaaatagtgagaaatcagttgacccagctagtgcaagtatgaagcttcgccccaaccagtgccaatttcacccctaaagttgtgatttttgttcgtcctttttgtttgacttgcatctgtttgggttgatggagctgtattactctgggatgatgccattctggctttgttagtgtaatactaagagtaataaagcttttgtcagatgcgt

SEQ ID NO: 48026 - DNA, 534 bp, Oryza sativa
gagtagtttgtgtcaatggttgttgaacgacatgcatctgcatgtgacattgtgtgcacattgccgtacgtactgcagatcgatggagggatgggatacaggtgtgcactgacagtactgaactgcaaagcttcggtgtgaggcaaggacatgttcgatcagcttcctttccaaccaagcgagtgaacacagaacagaatggcatataatgtttggttggtaactaaatttgtcacatctaaccttagtcaagtcacagttttagtaggtagtatttgactcttgccataagtctattttgtctaactcttagccacctagcccacatgtcatacactctattttcttgccaaacgttgcctaagcttagtttgtcattttgtttgccacaaaagtatggctagactaagcttagctaccttagtaaaaaaatgtgtcacaatattagtcccaaccaaacagaccccactcatcaagaatcttaattgaccacaccacaatttggctaactgaaatcgtgtatttgtaaaacaa

SEQ ID NO: 48027 - DNA, 1501 bp, Oryza sativa
caatctgagtcagactttttttttggcttttctttttctttttatgcacctttgcctttgttctctttctcttttattattttttttaacaaaaacgacctcaagtagcttgttgcaagattatagggactcaaatgtaaatataaaattacagggactcaaatataaaagtataaatccaaaaattaaaatcatataaaaatagaatgctctcaacatgtagattccgtttttgcaaacagatcttcaatccggcacattaatttttttttcaccaatctgagtcagtttttgtttgtaacagtgaatctatatccggatacaggagtcggattttttttttggttttttttatcggacaaacctggtttttttccgtccgttttttttggtttttttcgccccttttttcttctggatcggacttcttttttccattccggttttttatcggacaaacatggttttttctgttcggtttttttcacccggtttttttaacggacgatggaagcacctcttattttttaagtagtagtagatagatagatatggactcttaatgtgagaatttgtaggccatgagagcgaacgtggagattcttttttctatccttttaataatataatagatgtggagtactcccgggaaaaaatatattaaaatacacctttttgcccgatgatttaataggaatatacacgtttagaagtgaatagcagaagtataccactgtcgcagaatgtaagtgtgagacggcgcgatctcacgcgactaatagattaattagtgcaattagcaattaatcaattattattattttaattaacatcgttagtaattaaattaatcactaatcagtatgattagttacattagcgtcaactcgagccatctcgcttggccaaccagcgagactgaacgttctcacgctctcgccttacgagaccttcgcgcgttggtctcgtgatttcgcactaccgaaccgcaacaacggtgtattcgtgtaaatccattcaaatcttatatatttctgagacaaaaaattcaaaagtataatttcaaaattttctggattgtgtttttcttttttttcttttttacatgaaacatagaggaattgtcccaaatctgcctggactggaagaacagtagaagactctaccagggaagagatgcagttgggctgtggagagtccacgtaggctcactaaagcctgaggctatccacccttgggaaatgcctctgctgccttctccctccacagaatggcctcgatgtgggccccactggatcccggtgggcccgggccaaacgaaccagtaaactaatagcttcgcttccgagttcgagcctctcatgaccatggccgccgccgccgccgccgccgagctcgacgagacaagctagacgtacagaaaccgcgcgaagaagaataagaatgcggccgtggcttgtgccgccgccgccgccggcgtggcacggcgtggtgatcagga

SEQ ID NO: 48028 - DNA, 1501 bp, Oryza sativa
ttttgcataatataaaataattagtgaatgccatttagttttctatttaacctatgacatatcgagattttcctattatccctaagaatcagaattcctaatattttcatatgaaacatattctaaatttttcatattgatttattagtggtgtacagaaggtagagaatataatttcttttttaaatatatttagtattagactcattttgtttcttacattctctcaagcatagagaagtaggtaaaagtactcgctatatgcatgtgatttactagatatgatcattccaagttatcagtagttttctagacatattactcaagcaattcaaaaggaaatagaagggctattttttttccattttgatattcttttgttgacttcagttggggacttgatggaaatttgtcgttattgttaaactgttgcaaaggaaatagtgcaaaaggggaaaagagtatttggaaaatatgcaacatggaagtttccggaagtttatgctcctaaagatttttattctttttttttagatgattctaatgttctagcaatttggaggtgccaagtggctcaatagactagcaggtttcctgccaacttggcacacttgcttcgtggtgggacatcatggttgtgtgtgctgcgagccgtctcacgtggtcgctttggttcagatatttcattggattttgccttgccactttagaagaaggtggtgaaagggacgcttccgtcgcatatttaattgagagaatctattctataatttatcactgatattatctctttttacaatataccaataattttatctattgttatataatatgctattggaccgaacctttgtttgaaaataccctatggatatataagattaacaatcgatttatctagaagttttaaaaaaactatgaaaattttcatatggcttccttatacaatatggtgtatataagtttcaaattttttgcatttcaattttttttaatatataacttatttgtgttatgctatacaaaataatttttggtgtttttaatataaatcacctttcatatgccacataagatatttttgtgttattatcttttgtgtaagtaaattctctcaaatataccatacaaatatatttttttctagaaaataaatataaaaaaacttgaaacttagatataaacttccatgttatgtaaggggaccacgtaaaaattttcatgcttttttgaaacttcgagagagaaaaaaaaaagaattctagtactaatctgctagatgggcctcttttttcggctcctactctttggaccttctccagcgacgatctctcgccgccaccagccacccgccacccgccgccgttcgccgcccgccgccgacggcgcggccgcgctcttctccggtccactaccgtcagtgagctcagcatcctctcgagccgccggcgtcgtcgtgtctgaaacgactagcacggtgccttgtgtttcccatgttcca

SEQ ID NO: 48029 - DNA, 319 bp, Oryza sativa
tgggccccacgtgggtcccacgctgactcagctgccacgtaagacaaaactagggtcaaaaccaccgaaggagctattgtgaccggtttttattagttatgggacgccaaatatctggttttgcagttgggggacgattttgtaactcgatgataagttgagggaccttcggtgcactttttcctcaagagcgataccggtggcctctaatcgtcctgtaaacactaaacgggccttcggagaaggggcccatatgcatattccattgggcccgaatacggggtctcgctggagaaacggaacgcgcccccacgggcca

SEQ ID NO: 48030 - DNA, 1501 bp, Oryza sativa
aagaaacagaagatccttctgaggaagaattggatgatctcgtgcttaacatcgtgacttgcaagccaaaaagctctgtagcacaattgaatagcgaaaagcaagcagcggataaggtatgcacattgcaagtatttcgaacattattctgtgatgaactactctgttgtgcagttatgttcattaacattttctgcattttcaggactcgcgcttcagaaaacgtcaacaatttgaagaatcttctctgcagaagaggcataaatcctctgatttctctgaaactagaaataggaaacagtctttccctgctatatcaggagccatccaaaatgaacaaaaatcttcagatttgtcaggaaaaggtacacatgagttctcatcagaactcgatggagataaaagttctgctagtgtccaagatgttgaagcactagcagattcttctaccagaaatgggagtgaacaaaattcgcttgctagtgaacctaaaagagtttccttgtggactcagaaatctgcctggagggatcttgttggtggcatggggagtgcatctttcagtctatcacaaatattgccaaacaccaatccagcaccaccaaaagtttcaaatgctaccgaggcctctgcttcacatgctgagtccaggacgaaagtgaaaccaagcgggaaatctttgaaaccctcggaagctgcaactcagctcttgcctgagcagaagatgcctacaagttccatggcaatgctgtctagtgagcgtaaggagaataataagctggaaaaggagagggtggttccaaagatcactattggtgaagtgtgtccgttcatgagaaattcagagtcagaaaagcaatggtcaaaggcaaagaaggttctgactggtttcatcaagaagggcaatgagagcactggatcgaatgtcgggaaagggaagccatcaacaaggagataacaacgtagcatgtcattccagcttcatcttgttgaactacaagctcggtagcatgtcattccagcttcatcttgttgaactacaagctcggtggtttcgtgtctcataggaacatgtgttattttgttgattggtctcatagtctgcctgttaagaatgatctgtctttgtttgtgaagcacaatgctatgtacgagttttgttcaaattgttattattctttgtacgagcaatttaaagtcaaacatgtttcaaaaagtgacatctaacgtgcaatttaaaaacgaacggtcaaacatgtttaaaaaagtccaatatattttaaaaagtcaacggcgttaaatattgggaaaattataaaaaccatccaaatatcactctgagtttgagatgcctctccataagaagatttattgcaaatacccacctcctaaaccttggtttgatttaggcacattctctccacacacgcgtgattcctaaataatctcgtggcgaaatcaaccgagtcccactcagcgggagcaagagattatgttgttt

SEQ ID NO: 48031 - DNA, 232 bp, Oryza sativa
atttagacagaggtatgctcaaattctaggttggttttttatgagacgatgagtcgacatgtttttgggaatacgcgaggtgcgcatttttattaagaaagaataaatgtatgtacaagacgggccgaacaaattaaaaatgaagaggacagggtacaggaggggggaagaaaaacagaaagcctatcttctagggaatttggtgacccatctatcaaagaaggaactacca

SEQ ID NO: 48032 - DNA, 1501 bp, Oryza sativa
aagtttctatgggaggaactaaaatttttgtgagagtccctcctttctaaacaccacctaaataatatgccaacgtgtatgtaccagtcgcctaagcaaaggaggtcgttctctcatctcgtgtgcttttgttcgtcaatgcaaccgagattcaatttattgccaattcagtctgcaatataatcctaaaagaatgtgtaattgtgtagtgggagggtgtcacaaaactgatagctcttctggtgggattagagtagaagtagccctcttccttgggtttgtcaggaataatctgcgtcctagatgacgcgtccatgcggctgctatgtggtgcattcacagcggaggagaaacggtcccatctcattgtgccgttttttttactgatcaacgagttcaactataagctcggcttgctgttactctaagctttcaatataagctgggccttgtgccttttatctcaaattagaaaggtaccccgcgtatgatagattttgaaaagcactatttctcaataatttttctacatcataatttttccaaactatttattagcttttaaaatatatgatatttaatacattcctataaataattatctatgatctcttcagtacagagctatatttagtttgtttagaaaacatttctaatttaaaagtaatatgttttgtcttatttaattgaatgtttagtggccttttgttaacaaattaaaaactattattattaataaatatgttttatttgtagaatcaagttatgcatccttttagttggtttttattgacgcaagttattacatacttagtatacactggtaccttagtgtggcttcttatatatgtaataatatgtggaaaaactcataatgctatggtatggtatagtatagatttaaagccattaatatctaagcatttaaaaattgttatgaaaatgaaacatgcaaaggttggttcaattttagtaaaaagtaagaactatttttttctgaacttattagactttctccaaataattcaatttagtccttttggcattttacttctatcattatagatctaatttaattattgtgcagttatatagaacgataaaatctatatcattttttttcataatttcagaattgtttgaatgtcatgctaaagtaaaaaaaatataaccccaaagtggcatatgaaaagttaaattacagtgaatatgggtttctaaatgtaaaacaatctaaagacataaacggatcgcgtgatttagatgttatagttatttatttttttagtataagtttggcagcattgctcatagttatattcattttacttttctgagatctaatttaaattgtgaagttaagtacgatgataaaattattactattattattgttgttgttgttgttgtagttgttgttgttgttgttgttgttgttgttgttgttgtttttgttgttgttgttcttgttgttgttgttgttgttgttgttgttgttata

SEQ ID NO: 48033 - DNA, 336 bp, Oryza sativa
  unsure (1)..(336): unsure at all n locations
cacgcttgatgactgactgnctcctggnacccctctctcggttttggtagcactgtcgctctgaggacactgttggattttgcgtgtgcttgatttcgatttaggatgacacctatcaacaatcctgcttgtcctataccatttttcacttataatttagtactagttgtggaatgatttagtcgatttaggatgacacctatcaacaattctgcttgtcctatgctgtttcagttatattttagtactagctagttgtgcaatgatttaggatgcagtagtgtctcgaggactgaggcccatatttactactaccacttttttcccttgcataga

SEQ ID NO: 48034 - DNA, 1501 bp, Oryza sativa
  unsure (1)..(1501): unsure at all n locations
gcgcccgctcatgccgccttgaatgtggttaggtaggcgttgaggggcgcccacctaaccctacacacgtggcgttatgcggtggggggtcgggacagcatggagggggcggnnnncgncctacctcgggcccgacccccctcgggggagtgccacatgggtaccggggcaacctcctccctttgggcttgataccccagggcctgtatcaccgacaaagataattataggctgtaacgatttcaagtttttcttatccataataatgacatacttatatcataaatatgggttttatactgtaaatttattaatgataaattatctgaaaacataagctgatcaaatacatgtataatttagatactacatataaataatctaacaacataagcatataagaatacatgcatgatttaaattctttcgatggtgttcataggggtagggtatacgtgtgtgcatcctagggggtgagtgtgcatgtgttgtgagtgcccgcatttgttttgtgtttctaaaaaaaatactatagttgcttaaacgtttttatataaattttgctttccaactaatagaaggaaaataagagagataatagagtgaaaagagtagaacagaataggatggtacggagtacctacgtacacgaacgtccattcaaatagggtggggcccaatttagaggtagattggtttttcttttccatctaatctaatagttcaaaagaatgggtccaccaatttaaatgaaaatcgatggttagatgtttttctgccacgtggcagcttagaagtgctcgtagaaagtttaatggacttttagtatataatagatagataatagatagatagactataagctcggcagtagtcttcttgaagaccagtatctgtgcacatagaaacaagaaagaaggatccaattagcaggtgatttttttagataattattagcagatgaataggaaaggagataaaaaggattattcagagtttcagacacaataagtttcagcttagaacataacagttgctaagaatgcaaagactatatacacaaagcatccagttttgatctgtaattattccaacgatgtcgagtggagcctctcggtgtagcattagttgaggatttgagaacatccttccattgaaagaaaaggttgagatcacgcagcatgacatgggctgccatttaggcgggcaaatggtggaggtactaacttttgatagcaagggatagtgtaggctggcagttgtttctcaggtgttgtgtggcaaaagtactaagcaagatgttaccaggaatgaatttatcagcagtacctgtgatgaccgcccacaacttttgccatcataagtggggatgaaaatatcactctccaaggacaatataatctaacgctaccatctgggaggaatggttctggaaaaaacctgagatatctgaaggcaataatgtctcttttctcacctgaccatcaacaatgagaaagga

SEQ ID NO: 48035 - DNA, 707 bp, Oryza sativa
ccatggcgactccattaaccttgtcaaagataacaaggaaaagagccacaggtcaccctcctcaaaagaaaaacagcctcagcatctgcctcagaagcaacagtttacagttgagacaagatcagtgtctacattgcaagaaaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactatgcaaagaagtgaaagatccattagagttgccaatggagttgaagcaaaagttgaggctggagatcttcgcctagaactcgcgaatggcttcacacttttacttccagacgtttttatgttccttctttgcaaagaaacttgataataagtgtatccaaattggattttgatagatatgattgccattttggaaatggcaaatgtgaatgttgtgtcctcgttgacaaaagaaaagaaagcgaacttctgatgtctcatcgaaattatggcagtgttgtttatgccatatttcgagggggagaattgagagactggttaagaatgtagttcttcctccattggagttctcagttttagaacaatgcatacaatgcataga

SEQ ID NO: 48036 - DNA, 1501 bp, Oryza sativa
ctcagcaagccatgggaaataagtgtttaatgcaggcttcaaggaaaggctgttgtttttgcaattgattttatttaaactcttttctgaaacaattaagtgagtgcttctcaaacgacacgaatgagaccgtgcgtctcgtccggtcggagtatgtgcaaggtatcagtcttttgaattgatcatggttggcacccggccaacggcttttaaacggccacccgggcctggctgatcccatcagccgcagattttccaaacatcgaacccaaaccacatcagcaaatttcacaagcagtaggcaaacaaaactacgctaggaatcacctcacatccacccatgaccgtgggcatggctgttcgaacagtttaataacctctacagagggggtacactttacccacacgacattactaacccggatcatccagcccgtgcagaacggccacgactagagaccttaaggctttcatgacaaggcatttcgaaagccgacacaggttcaccatatgccaacaagaggggtcccagaccatactgtgccaggaaacccgggggttctccccgacaccaccccgttgaatccacatgtctcttggcatcatggctcccccgattagctagttactcagccaggggtgtcccattccacccatgtggtcgcacttgtcttatgttcggatgaacttccaaggaaacggtccttaagtgcaagagcaggaaaccgtacacccggtacgttccccggtccgcgattttggaaattcatttagttcgcaagcaccgacccaggtgtcgggttttccaagtcttttgtaaaacccaagttttacccaagatgtttctcagtttttaagtttgaaggcgaccgtcgatactcgtgcagagtgcacgattaccgaggcgcaactaggtggttacaagggaacatggtataacaattaacaaaggaaggataagatgcaataagctaggtaggcccatcggtctgccttgcagacggggcaaacagattaagtgcaatcctatcaatgcataatatttttcaagcaacataattaagttcaaatataggctcaagatgttcaagggtggcttgccttgctcgagatcttgagcttgatcctcgaaattctcgcactgtgggtcttcgggctccgaaactacacgcgaaacgggacaactcaacaaacggagaaaataaagccctattattgacctctaggcatgccattagatagatctcgagatttgaggagttttggaagttgaacggagtcaaacggacttacggatggaaaaatattgaatttctaagattattggatttttggtctaaaggaaaaggatttatttaaatcctttttgaaaatgaaaagaaaagaaggaaggagggagggaaattagactttcctcgggcggctaggacgcggcccgagagaaaggggcggctcggccgaacctaacagaccggtcggcccgagaaggcggcccaaagca

SEQ ID NO: 48037 - DNA, 350 bp, Oryza sativa
tatattggttccacatagatatttcatttatgccatctggttgtattttcttatattcatgaattggcaaccactgcagcaaccttcggaaaggcgctctaaacgtcttgaaaagcattatctcaaaaaagaagataaggtaagacccacttgtgaaatgatgtatgtttatttgaaaagttttttctctgcaatgctgcattgaagctaattgtttgtgtcctccgtcacatttttgattgggtagctaaagggaacgatggcttatcctttaggctttacattattaattcctaatgaaccccaaaaaaattccgaatgaaccacttctttatactcgattcctcatt

SEQ ID NO: 48038 - DNA, 596 bp, Oryza sativa
ttcagaagcatgatgtgaacgaatgctcaaatggcatacgaggattcaaggaattaatccttttctttgaggcgaaaaactcatttatgtgcatatattctagcagaaagtagtccataaaaaggagtttgatgtgttaaagaaaaaacaagaggttcatgaagcgctaactaacacgaactcaacagaattacgtaatccgtattctgctccatactctttaatcagaagcatgactcgtctcatattggaattcatactttgcatggttaggtgagtaaagttgtgcttttttcttccaaaagttaaactttcatgttgtttcttcagatatctgaactctttcaactacgttaggccaagtccacgaaaggaacttctcaagcttgtcatcttgcagcgttaatcgttgttgtcaacatggtcagaagaaatcccaacaccattcaggattcaactcatgttacacaaggcttatgctaaacttaattattaggtaaagaaaaggtgaacttgccacaagaacggagcagcttcctctgctgcatgttcagttgttcaggtctcgtcagtacacaaagatgaaatggtcaaga

SEQ ID NO: 48039 - DNA, 492 bp, Oryza sativa
tacaaccatgagtctctgaccgcctgctactgctgtctgtatcttaccaaatactcctaccaactccaatctctctcaagcattaacctacagaatttgcagttcttcacggtatcgcatttccagctaatatttttaacgatgcaagttgtatccaacctattaaatgaaaaccgttatctaaaactaatgaaaatccatgttaataaatcttatattcgcatgttttactccaagaggacatccaaaagtattacacatttgcatgtattattcaaccatcgcttaattctaagctaatagtacatatagtttattcaagctcacaatgatatttagctaatcattttgggatgcttaggtccaacaaccgtttataattcttcaactacacgtgcagttgcaagaatactattatcctatggttcagtccaactaaaaatgcagccggcgaagtttcattagtccaaccatttgtcttttggtgtcagt

SEQ ID NO: 48040 - DNA, 1501 bp, Oryza sativa
tagtcaaacttatttaagtttgaccaagtttatagaacaatataatacagtaatattttcaaaacaaaacaaacatattatcaaaatatattcaatgttagatttaatgaaactaatttgatattttagatattgctaaatttttctagaaacttgatcaaacttaaaatagaaacggagggagtacatctcaatcccattaatttaggataatcgagctgtgtatagaagtatagggaatttgtatagaagtatagggaattcagattccaaagaaccactattcctgcttaatcatggtgataccctaacaacagaaaccaaggaagaagtttacactacaacctttacggtaaaatcaagtccattggagcgcgaattggaaattccagcatcactatgattcgatgtacctggtcccttcccaacattagtgacagaaatggaatcatcagtaaattacacagttgagagccagaaatagctatttcactgaactgaccactggttcgcacctagtttatcttttctagcacatgcagacttgtcaaaacttaaatgccatgaccagatcttgccatcttcagagatcgaggttagatatgtcatggtcccttgatacatattttggtttgtatttgtatcagagatgacagaatgtgtagattgtatttgtcccaagtcccgtgattgcttctctatgttacggaaaacagcctctgactgccagattgtagtagcaagaacagctggaggtggaacaattgtaccaattgaaggcatgagatcttccaccgcacacaacaaatgcacatgttcacccctagaaccggaaaagaaaaaagaattacgagaggaacttaatatactggaaagaagtgtatcatttatgtacaaacgtaatgtgatcatgcatatattggttcacaattgtgaagcccatatgtcaataacctgaacagattgtaaaacatatatagtataatgtacgatttcattaaaattgtgtccattaataaacagatcaacggtcactaacaggtgtgtatactgattattcattcgttttacacagcaacataattgaaactccaatggcttcatagtaattatgtgtttatcagcacactcccaaggatgtaaggaatttccaagtttatctagaatttattactatgtacttgcaccattttgaattctgttttgttcctgcattttctatgtagcctattgattgcacttgaccaccacagtcttattgcaaatttagttcatacgagttcgggcatttggacacaattcaatagacatgttttctatattctaattctacagtatccacatgaaaagtatgactgtaaactcactccttgcgcttccagatactcagcttgccatcaatgtgcgtgcagtagagcaggtcgaaatcaggatcagacatgacatcagagaatttgccaaatcccctgggcaatggagtgacagagagcgcagtactgta

SEQ ID NO: 48041 - DNA, 657 bp, Oryza sativa
ggggggagcgtgaggtcagggacgacgcatctgcgcgagagatctgtggctggagaggtgggggcccgcgtgcagccacgcggcgcctcgacgcggtccacccgcggattctccttggatccatccatccgactcagaaatgaatgaatgggtggtggtgaggcgacaacgccggcggaggcaggcccatccgatatgcttttccagaaagaaacgacgctttttttttctcgcccatcgatcgaatctcgccgtcgccgcgcgcgctgctacggcctatagccctcctgaacccatgagcggctaccctcgtcccaagtcagacggatatgagctcggataggttcggatgatgctgcgctttcctcctaggcttccgacccatgcaaatttgcaaatgcgagcagttacgtactacgtatagtgctatagcagtagagtggttatcagtggtgctgtactatacgcaccgaataaacccataccaacccataaccgacggtgtacagaaatggacgatgatggaaggaagatatatttacttgtagattgatagactcaagtctcacgttatgagttactagtattctgtatactctatcatatcataactgatcaataaaatattttattaactgcaaatatttcatctgacac

SEQ ID NO: 48042 - DNA, 1501 bp, Oryza sativa
taagttgaaaaataatggtcaaagttttaacatctccatcacataaagttgcgaataaaaaggtgagttgggaggcgtcgtttttatatttttaaggatgcaacataagtaacaaggcatttatttgatgattgaaacagctcaacgatacattattttatttttgttgtttcacaggttttacatgcaagagacaaaatatattgcaaaacagtatagttatgatttcatctagatgaaattcatttcgtttctcacttcatttatctcttatcatatcataaaaatattggcacggcacccaatttaatgagaatgaaacttatattgaaactaactatcagaattatgaataccacatacctaatagtagttgactaaatctcggcaagacccaccacataccatgttttatacggaaacaacctgcggatatgggaggagttccggataaggaaagacaactagagttctacatggaaacgacaaggactacgcggattgtatccatattggtttccctagttctatttggacaaggggatacctatgggtataaatacaaggtcccctaggaggagaggggacaatcaacacacccaccatgaaaaagacccaccatagaagacacggaacaataaatcaagacagaagatcagcatagaagccagcatacgccaagacaagacgcaggatatcgacttcagagataagtacagttagtcccctacggtgtctccggatactgtcaagagagacgaaagcgctgtctctgatctcgtcgggcacgaactcgaggaagaagactaccctgttgtcgactacgagtcagacctttagaccgccatgtcgacaacagttagataggctaccccaaatattgtactggtgtgattatggtgaataagagcaataccggcttcggccaacaggatgtagggttattacctgacaattcaggggcccgaatctgtataaaaatccctgtctccatctattttatctcagtctcgcgtatatcctagtaccgacgatccccataccatgcaaataccggaatcgcgacatcaaacgtcgacactaacattacttagtaattcaattcatttcatttcttaaactagacaaatcttactgcatataattgtgtggttgattgcctatccaatcggtcggtcctggacaaacggaggaacggatagacacgggggcggttgttcccatgcacgaatctcaaagcactccatggttcggctaggacaagtcacaagccagatctcgtccacctccattcttcccttcccattttccgcttttccggtttcctcccacccaccccgcaccgtactcaatttctcgtcaatctcaggaaaaaaaatggtgcctcgccgcgacgagatctgagagcgcgcacgcgcgtcctcctcgccctcgccctcgcctccgccgcgcgcgcgcgcgatggcgtcatgcgcctcaccgtcgtcgcggttgcacggca

SEQ ID NO: 48043 - DNA, 437 bp, Oryza sativa
aaaattcatgtgtttttttaagtagtactactaccaaacaacatttttacaaattactctggatccacttcccgtaggattcagtaagccttgacaactattcatgtattttctaaatcatgtctcaaagcaacctaataagccagcattcttctcctcaaaactttgggtgtgtttagttcacgtcaaaattagaagtttgattaaaatggaacgatgtgacggaaaagttgaaagtttgtgtgtagaaaagttttgatgagataaaaaagttgaaagtttgaataaaaattttggaactaaaactcggcctttgtggattagatgatcacatctcaaatgctagtcacatcaaacaatggaatgtccagaaggttaaaatactggtacatatctaaagaaacatttgcttcactatggaccaacatgcgttcaga

SEQ ID NO: 48044 - DNA, 1501 bp, Oryza sativa
gcggcggcggcaagttatcggcgacctggccatagttcacccccaaggtagcaccacccgccgccacccccaacgccggcacaaccacggcgacggcgaggacgagctgtacacgaagcgccatggcggtggctcgccggcggagcagtggagtgggagaagcacaataagtgttcgtgacaacgttggaaatggtagccataaacaaaaagcgcgtgcatgcatgtggtgtccgaaacgaaacacggctgctttataaggagatttcgctgtattactttcggctttgcgatggtgaatcgtgtcatcggccgttggttaagggaggttccctagatcacgaccgtacatttttttcctttggttgcatagaagtatgtgcgtgtttcttcccttgttgctcgaacgacgatgctgatttttacactgttgacatggacaattcaaaatgggacaaaacttttcttttcatgcaatgttggatttcctctagattaacgaaatctgtatatatggatattaacgaaatcaccatgcacgtatgaacgcttcactattgtcgaatacatcgtctaccgttgaagaaataatcagttacaaatatgagtatccgtaagtctggaacttaaaaattgaaactacgtggacagattccaacataaagaatataacagttaagccatctaaagtaacaattgattttagttgctagtagcaactagtagtaagaactacgtttgtctttggcatctgttcttttcttacgtactatgcttgagaagtctgagctttcattggattcttttcagtatactgaattagcccattagagaaaccaacctaggatatactagtaacttgtaattaatcagaacaaagggtggaaagaaaattcatgtgtttaaagtgtagtagtgaataaataaaggtcccaagcattttgtcccaaaaatagaacaaccacccaaagccacaactatttgaagtgaaacgatttgctgtacgaacttgagactcttcagttcagttacatgtctgaatcaagtgcgtcgccttcagtttcagagccaaggttcactcctctctgccctgccgactgaaagagccaggtcggtacacaacatctctgcaagatgtcgacgaacttgtgggaaagaattggtcgatcgatcccaatttgagccagcactttagctttcctcaactacttttctcttgcttgagtgcagcttctctttaaaatacagtatcccccaactcgcagcttgctaagctaagctaagctagctgcccatatgcatgacattggagataatcagattacactagaaaagcaaagaagacaagggaagggatggatggatggctccaaaagaaggtaaagtatctcgcatagtggccaactttaaagtggtggtttgcattgcaaactttacttatttgcgtggacactcatcgcacagaccataatttccttttccctgcgtctcgattccgtcta

SEQ ID NO: 48045 - DNA, 1501 bp, Oryza sativa
cgctcgaggtgggaccacctcccactctcgcaaaaaatgccgtcgttatgggtcgtttagcatgtgtttttttaaaaaagaaaaacgaaagacacagcgtgcctgttcattgaatataggagtgttatttacatgtaaaatagaaaacaaagaaatatttacaaataaggcagacgtctatggtaacatcttagttagttgtttggctcccgccaatacccaagatttggcttctccttaattttcataataagatttatagggatagctccttgttttggaagattctttggtcccgcttcttccatatttcctaagagattaggagaattagggtcgaatctctttgttgggaacgttatggtgtgttgctagttttttccactagtcatagattgttgtcacctgtgctcagtttgtcggcctcatgaggtcgcaggctatttaggtagcgatcgcttctaaaattctttttgtgtaactgcaatttgtttggtagggcttaaactattaaatttaattttatgagttagatctaaaatagggtttgtagagctgtctaaacccaacttcatttctacagtttattttgtgatagtattatagttagtactatttccttagagcaggctataagccagctataaacatattttaaagagataaaggaagagagaagagcagcgggctacatatctgtagtcagctgcagcacgggctccaagatataatgtatgtatgacaggtgggaccaaatattaatagtatagtaagcaactattatatgaattggctattatattgactatagatgatttagagctaatagtgggctgcactattgatcttgcttgtattttgaaaccgtttcgttaggctcaaacttcggaaaaaggtagagctccggttcggagtcgtgtcaaacggtctaatatagttaattaagtgatttggataagtttggtgattaatttggatggaaacgtggggttggttggttggctggcacttggcagagccaaaatggaattttgtttcgggccagtaatgtaatttggatagaaagttgctgctacttgttatggtagtggttgcttatcatgcttccttgattggttgtctgaggatgattaactatgccaaatatgttatcttaagatgtcatgtggccaagaaagttggacctgaaatgaacctgcgtgaaagtaatactacagtactccctccgtctcataatataacaatctaggatcagatgtgatattttatagtacaatgaatctagtcatgcatctatctagattcgttgtaatatgaaatgtctcgtcttgtaggttgctatattatgagacagagggagtagttaattacagaggttcatggatgattttaggcatctaggacagaaaaaggttgctttcatcaaactccatagcagtggctacaagattttaatagggcatgattgattgatggcgacgactcaatgcgtcaagcgtct

SEQ ID NO: 48046 - DNA, 225 bp, Oryza sativa
cactctcagatgggctgtcaagcccaccaataaactggcactcacatttcacttggttcaaaatttctaacaaaaattgcttggggaaaaaaatccaaatccatgatttaaaagtctggccatctactgggcgtaaatgttctaatcctttcagaaatctgaatctgaactaattaataatccagtgtatcatgtaatgtcccttacatctctcttccttacagt

SEQ ID NO: 48047 - DNA, 590 bp, Oryza sativa
acttgtttggtttagttgttgtaatatccagttagtgtatgtgcagtagttatgctttatctgaaaaatgttgatgctaatttggtgatatcaggttaatgagcagacattccttttctgcagcccaaagtgaacataaatgtcttgcctgaagcacttaaaagtgacactattttgttctcctttctcttgatgtgctatggtaattctaacttgctgtgcgtaacccatgcagggtactccagaggtggggtgattatattcttcgcagtgaacataatatgtggaggtatgttgatcccttacagctacaggatttaaacaaattcatcactcctgctctaccaacacatcgtttgtccttccacagagctctgatactatatgtagctgctggagcactacctgaggctttagaaacgcttcgcaaaaaccaacgaccagacatcgcggcgctgttcttgcttgcgtgccatgagatctattcccagatcaccacagaatcagagtcatcagatgacacgccagggtctggatcgccgacatcggaacagagccccaagctccggttcccttccaagaatgtggac

SEQ ID NO: 48048 - DNA, 1501 bp, Oryza sativa
actactccctctgtctcataatatagcaacctacaagacgagacatttcatattacaacgaatctagatagatgcatgactagattcattgtactataaaatatcacatctgatcctagattgttatattatgagacggagggagtactgtagtattactttcacgcaggttcatttcaggtccaactttcttggccacatgacatcttaagataacatatttggcatagttaatcatcctcagacaaccaatcaaggaagcatgataagcaaccactaccataacaagtagcagcaactttctatccaaattacattactggcccgaaacaaaattccattttggctctgccaagtgccagccaaccaaccaaccccacgtttccatccaaattaatcaccaaacttatccaaatcacttaattaactatattagaccgtttgacacgactccgaaccggagctctacctttttccgaagtttgagcctaacgaaacggtttcaaaatacaagcaagatcaatagtgcagcccactattagctctaaatcatctatagtcaatataatagccaattcatataatagttgcttactatactattaatatttggtcccacctgtcatacatacattatatcttggagcccgtgctgcagctgactacagatatgtagcccgctgctcttctctcttcctttatctctttaaaatatgtttatagctggcttatagcctgctctaaggaaatagtactaactataatactatcacaaaataaactgtagaaatgaagttgggtttagacagctctacaaaccctattttagatctaactcataaaattaaatttaatagtttaagccctaccaaacaaattgcagttacacaaaaagaattttagaagcgatcgctacctaaatagcctgcgacctcatgaggccgacaaactgagcacaggtgacaacaatctatgactagtggaaaaaactagcaacacaccataacgttcccaacaaagagattcgaccctaattctcctaatctcttaggaaatatggaagaagcgggaccaaagaatcttccaaaacaaggagctatccctataaatcttattatgaaaattaaggagaagccaaatcttgggtattggcgggagccaaacaactaactaagatgttaccatagacgtctgccttatttgtaaatatttctttgttttctattttacatgtaaataacactcctatattcaatgaacaggcacgctgtgtctttcgtttttcttttttaaaaaaacacatgctaaacgacccataacgacggcattttttgcgagagtgggaggtggtcccacctcgagcgggcaagcaaagcagcaacgagaaaaggaatctggacgccaccccaccacaccaccactaccccccacttgcaatctcccctctctctccctttttaaaataaatccggataacgcatcggtgaaccctgcggattaa

SEQ ID NO: 48049 - DNA, 1501 bp, Oryza sativa
gtttcattttgctattactatggttagtctgaattaatttcgtgccctgaaagatctgaatctgttgaaacttcctctgcgttttgatctcaacacagcagctttcgaccgttttataccgtgtagacggaatcgagacgcagggaaaaggaaattatggtctgtgcgatgagtgtccacgcaaataagtaaagtttgcaatgcaaaccaccactttaaagttggccactatgcgagatactttaccttcttttggagccatccatccatcccttcccttgtcttctttgcttttctagtgtaatctgattatctccaatgtcatgcatatgggcagctagcttagcttagcttagcaagctgcgagttgggggatactgtattttaaagagaagctgcactcaagcaagagaaaagtagttgaggaaagctaaagtgctggctcaaattgggatcgatcgaccaattctttcccacaagttcgtcgacatcttgcagagatgttgtgtaccgacctggctctttcagtcggcagggcagagaggagtgaaccttggctctgaaactgaaggcgacgcacttgattcagacatgtaactgaactgaagagtctcaagttcgtacagcaaatcgtttcacttcaaatagttgtggctttgggtggttgttctatttttgggacaaaatgcttgggacctttatttattcactactacactttaaacacatgaattttctttccaccctttgttctgattaattacaagttactagtatatcctaggttggtttctctaatgggctaattcagtatactgaaaagaatccaatgaaagctcagacttctcaagcatagtacgtaagaaaagaacagatgccaaagacaaacgtagttcttactactagttgctactagcaactaaaatcaattgttactttagatggcttaactgttatattctttatgttggaatctgtccacgtagtttcaatttttaagttccagacttacggatactcatatttgtaactgattatttcttcaacggtagacgatgtattcgacaatagtgaagcgttcatacgtgcatggtgatttcgttaatatccatatatacagatttcgttaatctagaggaaatccaacattgcatgaaaagaaaagttttgtcccattttgaattgtccatgtcaacagtgtaaaaatcagcatcgtcgttcgagcaacaagggaagaaacacgcacatacttctatgcaaccaaaggaaaaaaatgtacggtcgtgatctagggaacctcccttaaccaacggccgatgacacgattcaccatcgcaaagccgaaagtaatacagcgaaatctccttataaagcagccgtgtttcgtttcggacaccacatgcatgcacgcgctttttgtttatggctaccatttccaacgttgtcacgaacacttattgtgcttctcccactccactgctccgccggcgagccaccgcca

SEQ ID NO: 48050 - DNA, 304 bp, Oryza sativa
atcggagggtcattcggacagcatccattgcaaatctccacccattaatgaagaaatgacaggggtatcccctgtgtcaggcgagtgacggcgctgggcctcactcaaggacaagctgtgatttagcttccaggcgaagacgcgagccaagttttggtcaggatagggtgggtccccacccaaaagaagagtaggtagaagtggtgcatgtgggatccccttgagatataaaaggaggaccttgcccaccgaagcaagagagaggaggggagacgactctgaaaatacttgagcttgtagagga

SEQ ID NO: 48051 - DNA, 253 bp, Oryza sativa
atctattaaaaaacggaggtagtatttgtcagtgcgaattctcgatccataaaaatggcggcccagcccaacccaccaaaccgtcttccccaaagactcgagacttctctacgcttctcctcgccgccgaaacgaagcaacccgtcgcctcgccgccgccgccatggtaagccctcgccgctcgaatctcactctccctcaccggaaaatctcttccctgtggctgaccggaggaccgattgatctccgccgc

SEQ ID NO: 48052 - DNA, 1501 bp, Oryza sativa
caaccagtccctctctgcaacagttggcagcaggttgagatttcgtcctaggcttcttgcagcagatgcgaacaagagtgttttgttcacaaccccagctgcgttttcttcccggtttcacctgtccaatacattgttgttgtcactgaattccatatgcatctctcgtccgtttttatcttcaggcctgaacgaaaatacgaaatgagttctctgaagaagaaaaaaaatgattggtgaaatgaacaaagcctgagtttgcaagtacttccaaacagcaagaggaagagaagatgagagttgggaagaacacgcccaaatcaatccatttctgtcactccacttgacacaatcacatcgtgaaccccagggttgcaatttgcaaattacaaacaagcctcgagaaccactcgaaaatcctatcctaaccacgacgatcaccaactccgagtgaagtgtatattcttttgctacgcttatagcatgccgtggcaacaacgtcgttacgttgaagagatcactagataggcaaagcttcgaactttgggctgaaaacaaattttgctcgtgcagaagctaatttagagaagctgaattttcttgccattttcaggtacgactaataaataagccgcgagaaaaaacttccaaactcaaaaggttgaaaaaggcataaataatgatttttagattaaaattttatttcatgatattagcaatacaaaggaaaatccctaaaattaacttggaaaagctttaaaattataatattagctacgataagccaacgtgcaatttgtttgcggaatgagtgcaaaaaaaattatcattctctgtgcgcatactttttaaattgttaaacggtgtttttttatataaaattgttgttttagaaaatcacattaatctatttctaatctcaaaataataacttaattaattatgtactaatgactcaattttaaaggttcatttgtaaaagctgtgaaaattggaggcatgttcagattgatggccataccattatttggttgataattacgtgtctacgtttatttgttaccattagtaatgtgaatagaatttggcaacattattaagtcaattttaccaaaaattttataatactattggtattattaaattttgacaaggtttattttaacatcaaacagctggttaccatccatcactaaccattcgtccattccccggtcgttcgttcgaccgccgaaaccagcggaatcacggcgaaaatctcaattttttttacccccggcgtcgcgtcgtactcgtacgaaagaaagaagaggcaagacgccaaatccggcgtgcccctctcctcctcctcctccccccaaaaccccctcccaaatccctctcctccccgccaacccaacccaacccaatccctccacaccccccgcctatgcacgcccgccgcgcgtggcgccgggcggcggggtgacgtgacgtcatctcctcgtcggtcggcgtccca

SEQ ID NO: 48053 - DNA, 1501 bp, Oryza sativa
tcacctaacccatacacgtggcgccaacaccacaggaggtcggggcgccccagccctcggggccgaaacgggagcggcccgacccctcgaggagacagagggaggggtggccacgtcatcctcgggcccgacccccccgagggggtcaggccacgtggatgaccgcggctgcccaagcctctagtcacgatacccccggtcccatgtcaccgacaaacacctaattaaatattagcttaaacttaaaaaataaattaatataaattttacaggaacattttttatagaaaaatatttgcaaacacacactatttattagttcggaaaccgtacgcaaaagaaaggagcgagtgaaggttaggaccacagacttattctacgcttttaaaaggcatcttctatctttttatttttgcttgcttctgaagagggggaatttctagaactgttcggctgcactcattcaacgaagctgcaacacagtggttgcaccttgcagccgaacaggccctctaattatatataataagcttgtaaacttctcaaatacagccatacacaactactcaagccgagagagaatccaaaaattgctcaaatttgaaaattttggtcgtcagccatcaggctcgagccagactgcgaccctaagccgacctattagagcatctctaatagtctctccatcctactctctaagataaattttagccattctagccaaaaaaacgtgctccaacagcctctccaaccggatggctaagccatatggctggctaaaacccttcctccactagccaaatttggccactctatttggctggccaatggtgggccctacgtggctaatcaactccatccccacgcggcaacagagagacacgggaggagcacgacgacgagcacgctaccgacggcctccgctcgccaccgcaccaaacccgcacggcactgcccgccgcctccgctcgccgcgtctgccggcctccgcgcgatgaggctcggcgccgccgccgctcgctgttctccgccagtccgcagtagtccagtaggaggaagggaggaagaagtagtagtagaaaatgggttggaagaggaggaagaagagtaggagagactgacatatgggtcccatttgtaatggacttgtaatagagagggtagatgaagaggctgttgaagtaaacaaatagtattactagccaaatcagattgagagttggctatagaaatgtttagagaggctgttagagatgctcttatgccgcaaccgcaccaagccgcaaacgctccggttgagttggactcgtccgagccggatctgataacccacccgcgactcctaccccattcgagcaccacccgccccgccaccgcctccaatctaaaaccctagatctctctctctccccacttctctctcttctccccccgagtcttcctcacccgccgccgccgccgccgccggaggaggaggaggaggaggattccggtgcggcca

SEQ ID NO: 48054 - DNA, 458 bp, Oryza sativa
tttatgaaagaaacttagcttgtgaatttgatgtgaaggaacacagaacggaggatccagttttgccagagctagcgaccaagtgtactcgtggatgcccaaatatagacctcagaaacatatctcttactgctcgctataagagatgtttttcgagaaacacaataaacacataatagatacaatattttcactattaagagatatcttattcttttgagaaacctgatttttttcctaggcgggtatggtccttagagccaaatggacgcctacgataatgtaacatgcttgcacaatcctgttgcgagatataggatttcagtttagagcaatgctccagtactctctactggtagtattatattactagtagaaaatttgaaccatttattattaaggataaattagtaatttgttaacagagtaacttagccatttacatatttctttttagg

SEQ ID NO: 48055 - DNA, 320 bp, Oryza sativa
ttgtgctcatgcttttaggactgattgccttactttgtagtcttctatatccgtgctgtaggaattctagcatagaatgctaacagcaaccagcgactgccaaatatgtttgaaatttactaccccccttccactagactgtagttatatccatatgacagttggagcatgctctccaagctttctgttgttttgaactgaatatattacaggagtgagaaactaatgctgacctggtgtcaaacaggcgctctgtatactttgacttttttattgattgtccatttccacatgtgcttacttttatttgtccatacagg

SEQ ID NO: 48056 - DNA, 1501 bp, Oryza sativa
tcatcgggatggtctagaccaggttaacaaccaaaaacacggagttttcagtggtgcacacgtaaattaaagaactattattttaggataaaatatgttacttcgcggtttcatccgaatggtttggactgggtcaacaaaaaaacaaatggtttttcggtcgtacacacataaattacggctggatttcatccgatctgttccgagttaacaacgaaaaagcatgtggttcttcggtcgtacacacataaattaaactagaactattattttatgacaaaatatgttacgtccggatttcatccggtatgcccggactaggtggacaaaaattgcatggtttttcaatcgtgcacacttaaattaaagcaaaactactattttaggacaaaataggttatgtctggattcatcaggatggtccagaccaggccaacaacgaaaacacgtggttttcggttgtgcacagataaattaaagcaaaacaactatgttatgataaaatatgttatgtctgaatcttatcgggaaaacacatggtttttggtggtgcacacataaattaaaggactattattttaggaaaaaatatgttacgtcctaaattcatctgaacagtccacaccaggtcgacaacgaaaacacatgggttttttttgtcatacacacataaattaaatcagaactattattattttagaacataatatgttatgtttggtccgttcggactgggtcggaaaaaacatgttgttttttgggtagtgataaattcccctttttataaatataagttcgtgcacgatccaatatttttgttctttcttttttttttctaagcagttctatacatggtatgtccgtacgtgatcatattttcctgttcccactgcggtttcttttcctgtttttatgcattccaatcgatacagtttttattttttaatcacacccatgacattaaatatttatttgttttctcgatattcacttattttcactgtaaacttttgctgaaataatgcccttactaatttatccttctattctcgttagatgagatgatagtaaaagagataacctatataattatatattaacggttgagattgctttctaccaaatggaggagagagctgatgtacttcagtttatgtttttgtctctcccccccctccttttttattgatagttctgcacacgcttgggatatactcaaacatcttatgtcttaatagagtaaattgcagattaggccatgtattttgaccatagtttcacattgaaccatctatggttcaacttttttatttaacaccagatctttttacccaaagttacaattaggactagtggcccacctgtcaatgacgattgaggatgaaaagggaaaattggagctactgatcgagtctaaattggagctactgatcgagcagactcgccatctccatagtttgcgtttgtggttgagtatggagttggatgctagctagggcca

SEQ ID NO: 48057 - DNA, 569 bp, Oryza sativa
ggatcccccttgttgtgagaaaacatacaaattctggagcaaatcgtaaaatacattattgccataaattcattttccttgggaataagttcactttgggtccctctacttgttctcaacccgattttcgtcccttggtcgcaaaaaccaggtatgacgggtctcccaacttacgaaaccagtacaaacaagatcccttgatagtattgtccctggttttggctaacgtggcgcctatgtggctcatttggcttggtctttatcccacatgtcactgacgtggcgcttacttgccaattcgataaaaaaaactaaaagcagcaaattgaaaataaaaaatcgaaacaaaatatgtgggacccacatgtcagtgggtcccacttattcaacatcacccctctctacctctgtctcctttagccacgccgtgggagtggagtggcgagcggcgggaccgcgggattggagtggcatgcagccggcggacgacagaagaggagcggcgcacgacacatctctatcctagcattgccctccgtgactatcgtgctcctcatctcaatcctagc

SEQ ID NO: 48058 - DNA, 237 bp, Oryza sativa
ttttttccagcattacacggatgctactaaaattaacatacgcatatcgtccttacatatatacccgtcaatctgctccgaacaaataaacgcttaaaaaaagtggaggcctgaaaaaaaaatctctagctagtcactaaaatcctattgaaattatgaagtgagcataaactcaactagttaggttccttgtggtggaaccaactcatccgggctcaaattctaaatttgactagt

SEQ ID NO: 48059 - DNA, 1501 bp, Oryza sativa
tgtataaattggtaaaagtaaaaatggagtgaacgcgtataggcagtgtaagacaaaaaaatattgttgccgaaccgcttgggctgttgggtttctgggcatcctctggcttgtaggcccaatactgaataataagcccatgaactgacaatacttgaataataagcccatgaactaatatttttgctcatataccccatcagaccatatccaatcctttgcgctgtgtggggcccacctgtcactatggctctattttctttagcaaatctgcactgatcagtgatcagcttcaaaacagagtctgccttttgtggcattccacaaatgttgtggattgatgtttgacaagtcaaacggcatcgttgggatgggctagtgtagtttgaggcataaattaggtttatcaatatttttcaacttcaatagtgtttagtgtctatttggtttgaaccaaaatttttaacatgcctaagaaaatatgtcatttcaatagtgaacttaggctattttaacttcaatccaaacacaactttaaccaaaatttttgatatgcttaagaaaataggtcatttcaatagtaaacttaggctattttggcttcaatccaaacacaactttgcctgatcaaattttgttatttctaaattttactaaaatttagtaaggtttatttaggccacaaatcaaaccaacccgaaatggttttttagtatgagtatgtaggcttcattaataaataatgatgattaatgattcctagagtaaaaaaaaaactgtaggcacattggtgatcggtattttggcagaaatattcaccacaaaccacagtgcatttatagtttattgctttctccccgtgcaagtaattaacctgttattacagtttgcataatatttttctttgttcataaattttattactgagagaaatcacttgtaacatctcgttttctgcgtataaaactgtgagaacaagcaacctccaaccaaccccaaaacacgtagccaaaaaccttcaaccgaaagaagcacacaagcacaccccacctcacaaaaccctcaaattctccccaaaaacaaaaccatctctcaaaattcaaaccacccaacacccgcctctctcccaatttgaatccaaactaaaaaccccaaacgaaaacgcaaacccgcaactccaaatcgggttcagaaacacctcccgaaaaaacacccgaaaaaacacactccccatttccccaatccctcccaatcccccacctccccgcggcgaaaaggtccagaagctcccagaatcggcatgcgcggatcggcgcgccacgtgtacggccatgattcatctcccccggatcccgatccgtgtgaggcttcctccagccaatcgcggcgctccgccctccggtataaaccgcgcgcctctcgaatccgcacctcgtcacgcacacagcagttgagctctttttccactacgcactagtagtagcactctggtattctccca

SEQ ID NO: 48060 - DNA, 1501 bp, Oryza sativa
ctagctagtttaccattggcatttggcacataccttccctggagtaacatttgcggtaccatttatctttgtttcttttcttatttttcaggtgatcgaataattgcccctttttctgttacaagcaaatgtgataatggacaaccttggccatagagaaaatgggaggcaaaggccagaccaatataaaggacttcatacccaggtttgtgcatcataagaatgcaggcatgattttagatttatttatattagtatggcacatgcaatatctaccattgtttaatatatttgctacgatgttcaattggattatttccctagatgaatactcaaaatgtgcatatatgttttggttagataaaagactgcttaaattctgactgcaaaagtgcaaatcaaaacattatctaaaaaaaggtgcaaatcaaacaaattgaaagatggggatatcagctgtcctgctttgctgtactgcgtgacaaaggcatatacatgtcaaagtacagaacaccttctgctacggcacttagataaaacttatgtgtgctgtccagtcaaaagttccacatatgcaagtttttaatgagtgtattacgctcacattgttggtattttggaaaataaccgaatactcaaattatggagatgacaaattttgatgggtgggaactgttttggtacaacatatccaatcagccgcaatcatttataactgttcatgtatgttctacttttctgtacttattcctgtattatggtgcgtgtggtatttaactgctttccatgttggaaattaattactgcgggtccaatgtaattatgtcaatcatgattttaagaaaatagaccttttggtgtagcttgcgtttagcatgcattcgtagcactattgtttacataggctttacctatcttattctttgtcaataagatatctcacataagtgctctagatggtcctagttctcttgcaatttacaggataactcagttctgttagattgtaatttatgctttacaagtgtgaatgctggcttgcagggaacatgcatttcttgtggaacatttgtgttatgtctgtgtctgtgtccaatctgagttttatgaactagcttcaggctgatgtatcttttcatgttgcgagctttttttgtccttttcttctacgttttctgtgctatgtatgtccttgttatagcaggaggtggatattgcaacctccaaaagatctttcagaaatgtgcactgttcagctttaaatgtataacttttcagctagatcacaaacaaaacaaataacattatgaactgatttaccagcatgtattgatttcatttatgaaagttctctgaagatagttgttataaagaatcattctctaaaagaatgtgccaaccatgtcaactaatatatccactcaatgtttttttcagtggatgatgccccagacccaaaggcatctgaaggaccatcaaagtatgaatctcttggcactga

SEQ ID NO: 48061 - DNA, 784 bp, Oryza sativa
tttgctagggccagtctttgtaaggttgtcattggtttgtagcggatgtaggtagaattttgtgtttaaagttctgtaggttcttctctcccgttctgaactctgaattttctcgtggctctagaacgctgcagcccacgagaattaaaaaatgtaaccgtagtctgcaggtattcatcgtcagatcattgtatagtttgacaaccagatttatgtggtagtagaccagtagtgaatggcatatttgtcgaagaggccatttgcctgaatcgtttggtagctagcaactgactgaatgtgaagctaaacattcagttgccaccaaacgattcataccaacatttttttgctcgttcggaaggctgcttgcacaacatctgtttttcaagggaatctgtacatgatgctactctgacaagaggcctgcaagaaacaacagaaatccccaaactctacaggattcagttagctaaatcatgccactttgtatcaatcaatatctgttactcactccgatttcgatttaattttaattgacgttttagataataacacaatatacaaaatatacatttaaccttatttttcgattataatatacacaagaaataaatacatgtttacttttattatagtgttttgaaagaaaaatctatatatgttattctagtttctttaaactaaatatttttaaagttattattgatgacgaccaaagttataaaagtttgatctcaaccttataaaaaaaaaagtcaattattatagaaccagagggagtagt

SEQ ID NO: 48062 - DNA, 1501 bp, Oryza sativa
tttttacatataagtccctatccgggaattctcctccataaatactgttcgtgtggggcatatacgtaattatagaaaatcggagggcttttttggaaaaaattccacccagcgcactgttcctatccgacgtggcatcgcccagcgctcgcccagcccgccgctcttaatagtttctaatattatggcaggacacctcatcagttatccactttaaatgtgttctgtatatttgtctctcttttttttttatcttagcaaccgtaccactccctccattttcaaatataataaacatttgatttattttcttaaattttaacaacaatatttattcatattcaattacttagttattactctgtcatttaaatactttactttaaacacacataatatatttaactatttacacgaatatttgtagagaaaacgagtagtcaaacaaattagaaaaaaaatcaactacgttataaaaaaaaactggagatagtacgtaactaactccctgatttgacacataaaacttatataacttgtgtattatacaaaaaaacacagcttcagatcccgatccaaatgaaattttactgttaaattgttaaattatagtggtttaaagttttatgtttcctctaaaatagtgacacagttccctttcaaaaaaaagtttgataaagtgtagtgttgcgtgtgtagtggtgtgcgcgcgcgcttgtttcgtataatcataaaaattaataacaaaataatttatccaaatgttttcagtgtaattgtaggcccctctccatagattcataggtgcatgactccctccatcagaatacaaattatggcacccaaaaatattacacacatgtaaatgagattttccataagtattaagaaaaatgtacctctgattttcgtctattagagcataaattataagttatgggacgtattagcgggggatgtgagcatggtattccatatgtagtgatgtgccgtgtaatgaaaaacataaaaatcttagatcgggagctatggacatttgtactcctccgtctcaataataattcatttttggctcctcacatttgtcccaaaataattttattttcaactaatcattgcatcggagtttgtgaaagtagagaattattatattgggagtaaataaaattaagaatcatttgatttgataaaataagggtattttagttttttattttattagtatttacgggacaagtgaaattaaacttatttgatatgtagggagcatcatccagattccagatctcaccgtttcacagttacacagtttatacccgcacggatccaaacttcagtccttttccatcacatcaacctgtcatacacacacaacttttcagtcacatcatctccaatttcaaccaaaatccaaactttggactcaactaaacacagcctaaggccctgtttagatgggactaaaacttttaagtccctatcacatcggatgtttgaatac

SEQ ID NO: 48063 - DNA, 264 bp, Oryza sativa
ataatagtaatatgctcactctatatctccaaaaatctttccttgatgcatgcaggttggtggttggaaccattgtatcatgtactcacttgaacacgcgcgccacatacttgtacctttcttggcacaacaatacaatactttgatacctttggcttgtctttttggttaggatgatcaagagcatagtgtaatgtaatgtaatgaaatgaaaagagggtttggcgcgtgcactgaccgaaagcacattctctgccacgaaga

SEQ ID NO: 48064 - DNA, 1501 bp, Oryza sativa
tatctgaatgtgaaaagtgacaagtattttttatcttgattaggcagagtctgacacagagttatctgaatcttttctgaacctgtgtgttgtggcacgcaatatggcaggctggctggcatacatggtgatatatacgcctctcccagggaccatatatgtgcttctctgcataactgggctctgccaatagctgacccactattcaagacaaggtataaagccagtccctacacaagaaccaatgccaagtaaatacatatgcctgctgtaatttttcccaacagattttactcctttgtttgccaaccgtgcttgcagtttgcagttgcagaggatgcatatgctttggttttgcaatggcgatgcatgcacaaatgggcatgcaggtcagagattggagttggtctcttttcaagtgactttgatgagtctgatgacccagggcaggttcacttcagtccacccttttctttttatgagattgactctctgttgctgacattggattaatgaatagcatatttggaataggaaaaaaaaaggagatttggagggagagacatccctctaaacacttgtttaggaagaaattgtgagcgtgttgagtattgaacacaggacctcggggttgaaaccacacacccccgaggataattcttgagatacacttgatagtgcagtgataagggtgtgtttagaaggacgtctctcccttcaaaattcaaatcttgttttttatttggataaaaaaatggaccagtcggcagaacataaggtggtgttcttttttaattaagacagattctaccttgatttttattaccatccttttcaaactgtcaaatggtatattccatgcgaaaactttctatatagaagttgctttaaaatattaaataaatccatttatcaagtttgtcataattaaaactcaattaatcatgatctaatggctttcttgcgctctcaagttgttgtatgactctgtttttctttcaaaggctatattatatttactctctatcacgccgtaggcttgtggagcacatgaatgatgagtgatgaattcatgaatatatataatcatatacaagcagtatatatatctcagtcctgaatacatgcatgctctctttgtgtattatgcaatatattcatatcgatttttgctggaacatgatcccaactgcctttctagctgatgtttgatcatgtatatctttgagttactttacaaaaggcattagcattatgcttatagggatttagggaggtgatcatcgttttaatcttctacttggaattcttttacaagtatctctttaaattgaaagattttgataaagggtgaagaaagggtagaaaccagaaagcactgttgaattgtcttgtattgaaaatgctttgcaatgatagatctactagctattgtactgggtgtaaataaaggtcctgtatattgtatagatccagtggaaagttacacgtagtctagctg

SEQ ID NO: 48065 - DNA, 1501 bp, Oryza sativa
taaacggtgtagtttttatagaacttttcatataaaagtttttaaataatcaaacaaatccattcttttaatgtataataattaataattaatatattaattatacgctaattaagtgtcttctccggccagcaaaatagctactcgatcggccaaaccacagagacaaaggtgatcacgcattgtcgatctagcatatagttcaatttagtttttggattattcataataggttctctgaaatatttatatatatgaacagaaattatctcaatattcttaccatttaagaaggtggttctgtcccctcaccttcccttgtctggagagcacgctacttttatattttgcaaatgtgtcagtttggtcaaaatgttcaatgaacgccaacaaaagaggttggaaaaaagatatccttatgcaggcacaatgaaaaaaaaatctcaaattaattattagtacccatccgtctcaaaataaacaaatctaatacgaaatgctacagaatctctatctagattcgtagcatgatgatacatcacatcccgtataagagttttttttttcttaatagagaacgctgttgacttttggctaatattttgagcaacatgaataaccaaacgttatttcaaaagttagacatcatcgattaaaaaacggaggtgatatatattttttattttcttgttttagctatcaaattagtagtgctctctcctccttttattttctttatgcattagcgaagggcataatagtctttcaatctcatgtttagcatgaatttgattagtaaaaaggacaatttttaagtgagaatatgtgtgaacacacgccgagtatctatatctatacttgtttaaaagcatctagtattgtgaaatagtctaacatttggttcaaataagtgaataccaaataatcgagcaaccaagatatttgataaagaaaatatattttgcttatagtgtttttttctcttcgggcatttttgctaatacagtatgccatccgtcttaaaatataaataattttagactccgacacggtctccgagatactactttgttcaacaatatctataaaagtaagatgttttaaataaaaagagttacatattatgatagtttgtttaataataagtctagcaacattaattttgcatgatcgatattttttattcttttttatattaatagttaaagttaaaaatgtttgacttgtcactatgtttaaaatgcttatattttagggcggagggagtaaaaaaaaaagaaaaaacaaaacaaatatactttttttttaaaaaaaagaactcaacatatctccatcattctcccattctctctctccccccctctcattgtgctattaatagcccatcttctttcttacacaaaccccttctctaaccccctgctgttgctagcagaagtccaggtggacaagaacgcgaggaggggaagaatcatccccgagatctcgctgccgctgctca

SEQ ID NO: 48066 - DNA, 178 bp, Oryza sativa
aaaacaaaggtacagatggtcatctcagccccaatgcttgtattttcagcagtaaaattatgcgtacaaattctgaaaccgtagaaagaatcatttccagcattcacaatttttattatatctcgttgaaacaaaccaccaacctaatcaaatttttgtgttctgcaaaacattcagg

SEQ ID NO: 48067 - DNA, 1357 bp, Oryza sativa
ccgaatgatttccttttctgaattctttgaatgtcctctgaaatattaatgaattggtgcacaaagtgtcacatttggctgtaaattttggcttgatttgttttctcactgcaactgagaaagtttcttcttcagaatttgccttttgggattcagggacttcatccaatccacggactgctctttagtgccagtgattcatcatcttataaagcttaaggtcacatggtgatcaagttaaattatcagatcatgtgatcatgattcatgaccagcttctggaacactgaaaacagtgacagttgatcaaacgagataaggataacacggtggcattacaccatatggtgataaattttaaaattcgtgtttatatatgctcctaatacatggcagttcagtgctggaaagtgactggtaggttagtacttcctccgtttcatattataagactttatagtattttctatatttatatatatgttaatgaatctagacatatatatatatatatatatatatatatatatatatatatatatatatatatatatatatgtctaattcattaacatctatataaatgtgagtaatgctagaaaatcttataatatgaaacggagggagtactaaagattagaatctgaaatctgccaggaaaatgacaagagtagctagcaaagcgattacacaagctcgtcattagacacactaccatgctctcgcacatgatgcagacaagtaaatgcgattgcagatcaaagaaatgtagtacattattaccaagttggcatccataaagttataaattatgaactagtatgatccatgaatgcataatataaactgaacacatgtactgtataagatcacactgacaatcgccatggaagaaccgaagaactgttctcaagagaaacagacaatacgtaggacaatactgaaaatacatagtgatctgatctgctgtcgtgatctgtacgtgtccatgtgcacattgagagattgttcgtcagaactagtgtacaaatgtacatccttggatacttctgtatactgaaataaatacaagagtgattccttatcatgatgaaattaaaaaaacagaagtctagaactactccaatattcatttctgaattcttgcccgttaattccacgtgaagtacttgccttttttttttctttctggcagatgagatctagctactgctcatcgtctcaattactaaattctcaataagaatttagaagctaatgtcaactaatcctcctggtttaatttagcgatcgctctcgatcgtgctatcacatgcagaagacctatgcctcgtactaagaatgattaattgtgaga

SEQ ID NO: 48068 - DNA, 1501 bp, Oryza sativa
gacctgcatcgatggagagctaattaattagtactaatttcaaattgcaatgtgttaattgggaatatatatatatatatatatatatatatatatatatatatatatatatatatatatatatatatatatatagtaaatttgtttggtgctccatggtgcccgggcaccattgttgaaattgagtatatatccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcctatatatatatatatatatatatatatatatatgcagacaagcttcccatgcacactccgtacataccaattacaaatgtcacaaattctagaaaaaattagacacatactcctaatataatattacacatatctgcaaaatctcatattcaaattcattatattttagccataaaaaaagtggaaaatctgacaatttttagggtaaaaatctgttagaattttgttacggctaaaatataatgaatttgagataagatttcacagtgggtacaatactattagaaatatgtgtctaattttttctagaattttctatgatatttgctaattggtgtgtacgaagtgtgtacggaaagtttatgtgtatatgatatgttccttgttaattagtatctctcgtgtgtgcaagcgcatcaatggtgatgacatgtgtgtgatgaccgatggaaaggttccaaattaaagagaggaattttttttaaaaaaaaacgaggagatgatgaggaagaaccgaggaagaagatgacttaaatttgtactacttttgtctctactggaaagctagtgttaagcaaaggaaagatgaatactacagatgattaaaactaaggtatcaccaattaattaattgggtcgatcgatctgatgctcacagctcactcacacactgactgacacgcacaaaatcagctaaaaattaacgaaaataaactgtaccccctcttcttccaattaattaaaagcttaaatcagcttaattatttcctaataacaacatgattatattatgtaaagctcatggctttccagtgcaactgtactcactcactcactcactcactatttatacccagctcagctcatcttcttctccgacgagatgcgacgacttctcttcgatctcgcgccaactcatcaccgccatagcttagcttagcttaaccataattaagctagcttagcttagcca

SEQ ID NO: 48069 - DNA, 770 bp, Oryza sativa
ccactactatgctttactgctttcagattaatgaagatatcagttgcagagagggctattgtggttcctcagccatggcaatgtgagtatatatatgtatacagctctcatatgaacagcattttctatctccgtttgtgcatatgttggattggtgaatgaagataccatgttcggccagacctgtgttggtctcagagcagtggtttctctgagatggtaaagggattccaattgttttttagacaccaaaatgattgcattaagttgtcatcttttgtagatattagttatgcattttttttttagcttctcggatttatctgactgttaaacaaataaattgatgtgcacatcttatgttcttctcattgaggtgttacttacgcagactctggttaaattttaacaagcatggatgaagaaccaaatcctgcaaaggagcttgttggctgaaatgccaagttagatatgattataacttgaaagagtagctgtcttaattaatcaagaaacatgtgagctatgattttcctcttttagtacaggtatttcttgtcatggtttttgtgaagaaaaaaaatcttttgacaagtatgcaggccaataaaaccaggtaatatcatggaacagaagtagattgtattgatagaggtgcaaatcgtttaattctttgttttgcaagaatctttactgtacagagtttctctttctgctgttatcagcggtgcgtggcacatgacatatttatggcaacttaacatcgatgc

SEQ ID NO: 48070 - DNA, 607 bp, Oryza sativa
agactgaaaggatgtgacaaggcaataatgtgagtatgtgacaaggcaatattgattgaccaaaaccaatattactcttccgaccagtattctgcatagatttggacgcccactccgtttttattgttgcatctagatttattgttcaggtgcgtattgtggtttgcatatttgcatgaatctagatgggcagaagttatgcacttatgcatgatcattagctcaccattagccgataccatgtaaagaaaataaaaataagtaatgactatgcatttcattctatcagaatttcatgtcaaaaataggtaccatgtatacggatagttttctccatctagcatgtttgagttggtgctcgtatagtaggatcattttctattccctacaataaataaaaaaaagaagagagaaaagtttaattattaaactctaaacaaggagctaggattgagcgatgattgcaacaaccatttgtagccaaaatgggcatcaccttcacagctgatgcagctctatcttgctgaattgtttaacagccacccatgacccatgggctcatggcaaaattttgtatattttgtttctttcatggctttagagtttg

SEQ ID NO: 48071 - DNA, 1501 bp, Oryza sativa
tggaaatcttggtacttcataatgcattaatgcgtattgatttcatttagggcatatggtacttctatatagttttattgttttattatattatagagtaaattgcatattggacaatatattaatgtttgggagaagccactggtttcagactaaccaatttagtaaattatttttgtgcacctttgtttcgttcaggtttaagtaatttttgtcgtttcgtgcttgggagaagcttttgcaacaattttgatctgcagcatttctgtatgggagctgcagagtcatacgggcatataatgtactgattttttttcgggaatacacatatgatgtactgatgatatagatatctactttactggtagttagataatgtatgctttttgcgttttgtggtaattattctgctatgcacgaggccgctatatgttgtaggtgattgtttttcacattgatgtacagtaagagattttgcaaagaggacatggttcattgttgatttcatttgtttttccaatgaagttcgtttgctgaacttggataacctacttgtatctagcagctacactgaagatccttttcttatgtgcgtttgaccatctcatagttttcattagaatttatcatatgatttggattcttcttttgtgtagctacctgtcaatctgcaatgttcgtgagatattccactgtttacggggttccagttcatagttatttggaaaaaaaaaaactagtacccttagcttagtgcccaacatagttttgcatgttagagaaatggaaaacctttctatctttgctagtttcatttccccaaaatggtaaattataaattccctgatttcatatggacattttatttgctctgtcaatcatcataaatcggcttaaggcttgacaagatttaccaacctatttttctttggacagcaacctgacattccagcatttgggaactgggacaccactggcaacacaccatacacacagaagtttgagaatgcccgcaaaaacaagaaagcgggcatttcttcccatcccaacgatccaaggaggcaccctgaacctccatccaagtcacctttgcatccagcatacacacctgatgctcaggggcagagtccaatgaatccacagcatggaagaaggcaggaagctgatccccatcgacggcattcgctttctcagcagcgagaggtaggcggtggcatcggtagcgcaccgagaagcccatacaggatggttcatggctccgcttcaccagcgcagccgaacaacccatcgaagccgaagcacaggtcatctggaatgcagactccagagaggagggcttcatcggagggacatggccagcatactcctaggaggagcagggacaagcagggtggccgaggctatgatgcagtacattctaaatccctttttgtttcttgttaatccagagaattttgcctatggagtaatgtgatgttgcttttgcgttttttttttccaa

SEQ ID NO: 48072 - DNA, 445 bp, Oryza sativa
tttgatctttgcttgggatctttacacgcttgctatcctcaagaaataaagcacttaagttcctcaagaaataaagcacttaagtttgtgttcctcacacttgatgtttgtgcaattaaagatgcaattagatgacaaggcttataaattgtggatattacgaggaggtcgccttcattgctaatggaaactttgtagttccacaatatctaggattgatgtcaactttatatgtaaaaaaacatcaaaatgaattaacctcttcaagaattataagttatatgtgtgtgtttgtgtgtgtgtgtgtgtgtaattttttccaaaaccaaataaattaaccataagaagaggctttgtaccatgtacaaggctcctaaacccaaatattttgtaacacctagctccaaaatcatggcccaacctttcctgcaaacaatattatagc

SEQ ID NO: 48073 - DNA, 1153 bp, Oryza sativa
aactagattcttttgcaattgatgacattgtccacaggaacacccacttacgctgtctaatgtatcaagttcaaagcttcaaatataataccctcaagtgcaatattttttcattcaagttcaacatggtttagttcaaccatatttgtgttgtcagcaatatacaagcataagcaacctctattatgaatgtaaaccatgcttaacactggttctttgttttttttatggttaatctgctgattgcttagcctttgatcaactgtgtgttaggaaggttgcctctggacttgcaatataaggaacaaaactaatgtatggccttacagtgggtcttgtgatttcattgcattaggtcaagtggctgaggaattgacctagctaggcccatggaaaagtgtgatgctgctacagatagagttgcaacatgccatttcatcccaaatcacatattgaaaaaagtactgtagcataatggatacaattttagatgacgatgaacattactgggttgagttgtctacaagtatatcatctaaaattgtatccattaaattattcggattgcttaaaaatatctccttgatagcatgcatatttttctctactagtcctggtgcaggtgccaagactaccgaaatgactaccctattggaataaacaagttttgtgcttctcacatgaaaaatacatattatagaaaaatatgaaattatatgcatcggtctgatttaacctagtcattggaaagttaagtattaaaaaacctagatggagtataaactgtatagcacattggcttctaatttcggatagttcattcttcggacacctgcatcatcctaatgaagttcatatggtatccacatattatgagaaaagttttgttttaaagacaagcttgttctaaattttctctgaagccatggtaaacaagtagagtatgttgcacataatttcatgatcgatgtgcttttgtttgtttggttttgccttttccatttatccccgcttctcttctcagagctttataatgttgaacacatacatgattatctcatgcattatttttcttttttacgccaatttattggtccttgaagtctcccttataatacatgaattgcgatttcataataccttttattgtagt

SEQ ID NO: 48074 - DNA, 247 bp, Oryza sativa
gactccccctcgcgccgcctccacctcctccgccatcgccgtcgccgtcgccgtcgcctcgctgcgtctccgggcgcctccgcctccgtctccctcctcgcgtcatcgccgtcgccgtcgcctccccatcgcgcagccacctcctcctagcgccgtccccatcgccggccacctcctcctccgccgccgccgtcgcctcgccgtctccgtctcccccctcgcgtcgtcgccgtcgccgtcgccaagc

SEQ ID NO: 48075 - DNA, 1501 bp, Oryza sativa
aatttcatcagcaaataaatcatcattttatccaaatttacactcaccattccccaagagaggcctttccaacccttgagccccgtcctctcaccgtagtcccaaaccagcgccatagccgtcaccctgcaatccggacagaacaggcgataatcccctcatcttttgcagccgtggaagcaagagctaggcaggtaggtattgtagatcgtaccactcggcgacgctggagacgtggacggcccaagtgggcagcgagagcgcgttggccggctcggcggccagcgcggcgatcgctggcggcgaggcagcggctacggctgccacagtgacaaaggctatgccgttgctcgccaggcgcgccgcggacggcggcgctcgtcggggccgcggtggcggtggcggtggcggagcgggcgcgaatgcggcgatgagccggagagagaccattagtggtgggatggggagcttggcgttcacacaagacacaacacaaagaagtgagacttgatgattttatacggacttgaggattttgtacggagcagctgtacacagtacacgtgtacatctgtatccataccgtaggtgtacttaatttttttaaaaaagataaatttaattaccccttcaatttctaaatcacttgaggttgcgttgaaacggacaaatagaaaagaattctcgttttccgtgtgtacgtttatcagctgcgtttttttggaaaaaaatcgaaaattgttttaatataaatcatattaatctatttttaattttttttgaaaatcgtacttaaactttataaaaatattgaattcacattgtttctaacattctattgttattagattgtacttggcatatatcattttgttttttattctaaactataactgatttgaatttattaattacctaatttaaatatatatattattagtctaaattatttttaatattaaaatattaaaatattatagatatatcacaatgttttagagacgggaagataaagtaagttcgatggtttcaatttataacctgataaaaaaagaatgctaaattagattcatgccaagtggcacaatatatattttagaaaatttataacctaataaagaaaaaaaatgttaaattagattaataccaagtgttatcttttagaaaatattgtggaatgaaaacttcttataagaatataccttaataaaaaagatattttgtgtgttatgagtagcttgtggtatggattcttctgaagaaatttatgtgagtttggatgagtacaaattattttctgtacaactattctaagagtgtttggatgagattcaataaccaaattacatctgctaaaaacaaaaaatcaaaattaacaagttgaaagtaggtggagctgggcagaggcagatctaacccagtttcggttgaacccccaaactaaacttttctgagggataacgcagaatagctgatgatgaggtgtggccgtgtgggtagg

SEQ ID NO: 48076 - DNA, 1501 bp, Oryza sativa
attggagggctttttccgcaaaaatccgacctccgcctcccttccttatccgtcccgtctcctcgcgctgctagcagagcagaggtagcggcggcgttctcctgctcccgccgcattcgctcaccgacaccggtgagggtgaatccatcccatccggcctccagtttcgtctcctcgatcgccccgccgcttgcttgcgccgatccccatcctgcgcccggcgtcctcctgcttcccaccgcatcgtcgctcgccggtgagcatccctccctacccacacggccacacctcatcatcagctattctgcgttatccctcagaaaagtttagtttgggggttcaaccgaaactgggttagatctgcctctgcccagctccacctactttcaacttgttaattttgattttttgtttttagcagatgtaatttggttattgaatctcatccaaacactcttagaatagttgtacagaaaataatttgtactcatccaaactcacataaatttcttcagaagaatccataccacaagctactcataacacacaaaatatcttttttattaaggtatattcttataagaagttttcattccacaatattttctaaaagataacacttggtattaatctaatttaacattttttttctttattaggttataaattttctaaaatatatattgtgccacttggcatgaatctaatttagcattctttttttatcaggttataaattgaaaccatcgaacttactttatcttcccgtctctaaaacattgtgatatatctataatattttaatattttaatattaaaaataatttagactaataatatatatatttaaattaggtaattaataaattcaaatcagttatagtttagaataaaaaacaaaatgatatatgccaagtacaatctaataacaatagaatgttagaaacaatgtgaattcaatatttttataaagtttaagtacgattttcaaaaaaaattaaaaatagattaatatgatttatattaaaacaattttcgatttttttccaaaaaaacgcagctgataaacgtacacacggaaaacgagaattcttttctatttgtccgtttcaacgcaacctcaagtgatttagaaattgaaggggtaattaaatttatcttttttaaaaaaattaagtacacctacggtatggatacagatgtacacgtgtactgtgtacagctgctccgtacaaaatcctcaagtccgtataaaatcatcaagtctcacttctttgtgttgtgtcttgtgtgaacgccaagctccccatcccaccactaatggtctctctccggctcatcgccgcattcgcgcccgctccgccaccgccaccgccaccgcggccccgacgagcgccgccgtccgcggcgcgcctggcgagcaacggcatagcctttgtcactgtggcagccgtagccgctgcctcgccgccagcgatcgccgcgctggccgccgagccgg

SEQ ID NO: 48077 - DNA, 324 bp, Oryza sativa
ttcctgcagcccttgtaaaccttaagaggctgtcaaatatgctactgattattatgttcattagcacagtagcatgggtagtaccgcttactacaactgtacactatcatatcgttcacttatattgttcaatcatatcccctcccttctctctctaactggtgactgtagcatcacaatgggtcttatcatgcaactcattatcagcagtattacacattgtaaactaatatgttaatgtggacatgcaaaatcacctccatattgtagtatttgcagaaatatatcttttgttcacacatttatcttttgatatgtggcaga

SEQ ID NO: 48078 - DNA, 200 bp, Oryza sativa
gttaggtaattctgtaattaaaatcgtcaattgtacagaaatagataacacactataatagatgatctgcagctgtgaatgtctgaaagcgatttgaattgaagttgtgaatgtctttgcattctatttctgtatgttatactgttgatgaatattctggtctcttgtctcttaacttttcatgccattatgataccaga

SEQ ID NO: 48079 - DNA, 1501 bp, Oryza sativa; identical to SEQ ID NO: 26835

SEQ ID NO: 48080 - DNA, 216 bp, Oryza sativa
accaaatttcactgttaacagtgcgaggcgtggcggagcgcgccgggaggcggtggcggcagggcacagcggtgacggctgcggggctgcgcggcgacgacgcgcggcgtagagggccgcggtcggcggtgccccgtgcggcgggctgatgccgcacggtctaatgccgtgccggtgcctgccgtcccggttctcctccgtgcgcagccggggcca

SEQ ID NO: 48081 - DNA, 626 bp, Oryza sativa
ataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattactagagatgtaatattcgaaatatatttgattgttagagatttaatataagattattagagatgtaaaattcgaaacttaattagacttaggatatatgattatctaccgtacaaatacacgacacttagacttaacatatttgagtgttagagatagttagagatttaatataagattattagaggtttaatatacgaaacttaattagacttagcatatgtgagtgttagagatttaatataagattattagagatgtaatattcgaaacatatttgattgttagaaatttaatataagattattagagatgtaatattcgaaacttaaatagacttagcatatatgattatttgagttttaatacaagattagtagagtgttaatattacgcttagcaaatatttcttctatgaacaga

SEQ ID NO: 48082 - DNA, 199 bp, Oryza sativa
taactaataaaaatggggttacacttctggattgaatgaatttataaactctaacagcagttccaattccacctaactttcagaaattcctgttaacacagttgcaaaaaatagggtctggcaggtggtgtgctactttttgggctaattcttgaaaatgattcagttctcctaacctagcctttgtgtgatttgtagt

SEQ ID NO: 48083 - DNA, 1501 bp, Oryza sativa
gcttattttttatatactctctcatcctagaatatagcagtctataactaaatgtaacttacactactatgtaaatctagacaggaaaaaaaagtacaagagtactctccatcttatattaagtgcagttgtagaatttaattaaaaaccaaattagtaggacaaacgaattacctaaatgcccggatgggattgagagtgggatggcatgtaatttaaatgatgaatgataaaatgggaaggaattaatttaaatcaaaagtggttgaaacagaaaaaatgtgaataggttgccacttattatgtgatgaagtttgcatactaggaggtgtttagatacaggggtgtaaagttttggcgtgtcacatcaggtattatatagggtgtcgcatggggtgttcaggcactaataaaagaactaattacagtatccgttagtaaaccacgagacgaatttattataagcataattaatctgtcattagcacatgtttattgtaacaccatattgtcaaatcatggagcaattaggcttaaaagatccgtctcgcaaattagtcgcaatatgtgctattagctatttctttagcctatatttaatactccacgcatgtgtttaaacgttcgatatgacagagtttaaaattttggggtgagatctaggcaacttatcctatgcacacacctatcttggtgtactcatgcactcgaccactatcagctcttgtattctaatccaaaggctaaaaacctaagtgtggcgtttttgtaagagaaaccacgaggtaagacttcatgttagttttcctcaaaaaaaaaattccatcaaatggcccattccgtaggaattctgaagatgcttttcagagtcattcttttattcaaaacaatcacataagaattatttcccctaagaattcaatctttgataattcctccatttcccctttgttccgaaggagcccatagaagacagtgtcgatgtccaagactttacataattgcgaccacatagaataatctcacagtacacgtggaggctgacgtgccatggtcctatcatggtacactttcacagcccacttggcacgatcttatgaccttccaagacaataacgcccaaaagttgtggagattttagctgcaaatgttgccatccaacacaaccagggagggtacagtcagtagaaaatgtacaatcgagtggagcaagcggccttgccaagttgccacggcctacatcccagcatttgttgtcaaaacatgagtgacccatcttgttgtgttcgtcctccaaacgacaaaccgcaaaacatcatcgaacatatgcctagaccacccaagtttctgctgttcgctagtactgttggatccacaagaattaatactctgctagagacagacagagatgcccctaggtggtattggcacatgtacaatgctactatagtttgcaatgccatgacatgaaagatatcataaaacgagaactaaagaaaat

SEQ ID NO: 48084 - DNA, 1501 bp, Oryza sativa
caagaaagcaaaatccaacaacatcaatcttagggccccaatctgcaacagaatagactatgtaattcacagtagaattacagacaattaacaacaaaaattgctcagttaacaccaaaattgagcaggaaacttcaaggttttttccttaacagttaacgcactaatatatccatatcttacaactcatattattgaaaggatatgatagttccttatacacatcagtgattactgaaaaagcataaaatagcttaacaagcattttcctaatgatatattttagaaagaattggatatttgccaccagagtttgcatcagtcatcggtctgccatcggaaatgagcttattgctacagtgccattggtttttcggtggttttgatatatttgctactcctacagcattagaaaacaactgactcctttaggccagcagcctctaaccatcaaaagaaccccggggataggtacatgacccaaaaaaagaatgctctccacacctttcttcacttctcctctctactctctcccatattttttcataatcatgtaaaattgatgttactagatttattattaaacaaactatcataatatgtaactctttttatttaaaacatcttacttttatagatattgctggtcagagtagcatctcggaaaccgtgtcaaagttcaaaaattcttatattttgggacggagggagtagcaaactttcatgctcattaccaattagaaaaatgtggtatcaaactgaaaggctaccaatttcagttggcattactaatattgacttggttcacagtgttatcacagcaaatactcaagcaagctcttttcaatacaacaactgaatgctataagaaagtcaaatgaaaagaaaccataggaccagattaaggtccacaagttttaaaaactatacaatcgaaggatgacaaggttaagcatgacgtgaaaagggataacatataaatttcagataaagctaatactcatcaggaacctttcggttttggaacaaggtgaggactccagatgtaaccatgaggaatgtcattcccagaaccctgtgcaccacttaggtatgttaccggacgcaacttcagcttcttcttcctaaattcatttatcatatctcggataccaagccaaatcatagagtcaacaatttgataagaaagctgcaagtgtaaaccatttgaagattagataacaaatcagatcagaagaaaatgagtgatttgagtatgaatctttcaacaagtgcttgatgtgagttagggagatgatctctaactttgacatgtggtgcatggttgtttttagggaatgcagcaaaattgcaacctatttaattacaagaattactataaattggatcaaggtcccttgcaacctaaagagcactcccaagaacaccagccacactgaatgaagccagaaactaactctctgcatacagtaactcacttgagtttaccacccaaatcagt

SEQ ID NO: 48085 - DNA, 421 bp, Oryza sativa
tcctgcagcccggcgtccgctgcgcgtgtggccgtagcgaaattctaatcccctgtgcgatagtttctcatctcctccctgagataccctcctccgccacttcgacgtcccatccatctctctctatttccttttctcccgctgctccccacctctctctctcctcctcctcttcttcttcatccaaccccccatggcgaccaccacctggtgctgtggttgctgctgctcctgcctcgccaccgctcgaagccggtgagtgagtcgtcgtcagtcgaggcgccaacgatcgagctgagctatagccagggtgaagcagaaggcgaggagagttggtggtgagttgaactcgatcgaagtcggaagagcgagagagggtggaagtgtttggttgggttgccggtgtggtgaggattggaga

SEQ ID NO: 48086 - DNA, 877 bp, Oryza sativa
ttaaacctctaataatcttatattaaatctctaactatctctaacactcaaatatgttaagtctaagtgtcgtgtatttgtacggtagataatcatatatcctaagtctaattaagtttcgaattttacatctctaataatcttatattaaatctctaacaatcaaatatatttcgaatattacatctctagtaatcttatattaaatctctaacactcacatatgctaagtctaattaagtttcgtatattaaacctctaataatcttatattaaatctctaactatctctaacactcaaatatgctaagtctaagtgtcgtgtatttgtacggtagataatcatatatgctaagtctaattaagtttcgaatattacatctctaataatcttatattaaatctctaacaatcaaatatgtttcgaatattacatctctaataatcttatattaaatctctaacactcacatatgctaagtctaattaagtttcgtatattaaacctctaataatcttatattaaatctctaactatctctaacactcaaatatgctaagtctaataatctaataatttctaacactcacatatggtaactctaataatctaataatcttatattagaaatctaacaatcttatattatatctctaacaatcacatctttacatcacttgcctgcgcgaattccttcgagggctagctaccacttcggcttgagggacgacgacgacgacgtcttctctgcaacatgcaaaaaaatgtatttcatgttttcaagtatatataatcatatatatatgctaagttcaacaatagtttaattatctcgttcgtacacgtttcgctcgcgttcgttctcacacttttagt

SEQ ID NO: 48087 - DNA, 1501 bp, Oryza sativa
  unsure (1)..(1501): unsure at all n locations
tgaaactatttcgggtacacctatgctaagaccggaattgttaggaattctctccctattaatcctattgatgttgataaaaagaaagggaaaaatggtattggtaaggatcctcgggccaagacacttaggatcaataatgcgaaagccgaaaatcataaagttgcaaaggatgagtcatctagtatccaaaggaccaaaaagccgaagctcacttttgatatgcttatggctaaatacaagaaaggattagccggtcaatgatttgacaaccaaactagtgattcgaaaagaccaagatcatctcgtaggaagagatttggtcaaacatcaaagcaatcggagccatcaaccataccaactccatataaacctccaattgtgatgccatggtatccatatccaatgtcactatatgggtatccttttatgtattacatgccatggatgcctcaattctctacgccgtttcatcaaggatgggaggaatcacctaaggcagtaccaagtcattctaactcaagacaagaccgtttccacaaaagaatcggtccggtggatcaaaggtgaaaaaggcgaagaaggtgtgggtgaggaaggaagccaaagctccggaggtcgttgctatcaaagaggagtctcaagatgttcatgtacctactggagatgcgatggaaattacgcaagcaaaggagatcgaagccgacgccgtgactgtcaacattggtggtctaaccgagatagctggcgggtctaaccgcaagactatggccggtctgaccaaccctcctggccggtttgaccgacggcttgtggccggtctgacgggacctagaggccggtctgacggaggggcattagagaagagtgagaaaattgagagcaacacagnaggttccacttcgaccaaaaatatgaagaatcatcatttggctcctggaaaacaaccacagccgaagtggataccttccggcttatctcgctctcaaaacaggaggcttcagcgtcttcgggccatgggtaaaaaagaaaaggagaccaaagatgtggagaacaaaacatgtaacaatttagatcctcgaacgacatctaggcaagtgtggagacccaaagaggtaaaagttaagagaccggtgatttcccatagtagagataaatccaatttgatgagagaagaatcatcggtcattagagataagtctccttcgcatgatgctatggatgttggtgcggtgttcatcttgccttcgaaatcgtgcagtcgagaaagccgattttgcttgaggggcaagacattaatatgctcatgaagaaatcaagagaagatgaacggcgatggatacaacatcacatctttgagccgccgttcgtcggatgctaaggcaaggtatgggtttattgtgtttaccattatatgcctatgccatgttaaaacattgcttgtgtcagggttacgggttaggtataccccttacccttcgatatgcaccacatatcgaca

SEQ ID NO: 48088 - DNA, 325 bp, Oryza sativa
cagtagttagttcgtaactgagtatgaactgtctgagtggagtaattaacaatgttttttttcctggtttaatagattatatatagatctttatttatccaagtggaggttttgtcctgctgcttgtttgctagttagcttagttttgtgcgatgccctttttttttgttctctctagacggtcatacattgattttctctatggtgggtggggtgttgtatggaacttgggttagtgttatgttggccagaatgcttttaaaatgacatgttagtttttcaacatagctatagaaataaaaatgaaaaatgcgctacattttta

SEQ ID NO: 48089 - DNA, 1501 bp, Oryza sativa
ctgcatccaggttttttacttcatctaatctttctcaatgcataaaatgggttctttctcagtgcatgttgattgcattagtaaatctggctctaaaaaactatggtgttgtatgacatgcaacagcagattataccccctcatcaacacacatgctctatctctctctctctctctttctcacacacacacacgatctgaaaagaacaaaaggttgctactgtgacagttttgcagagtttagttcttctagttccattatcatgtatcagaagacactttagaaactagacaacaggtgtagtaatcatagagagtaaaactcaagacatgtcactatggtttcaaacagattaaagcattggcaaacaaatagattagatttcagagcctagtatgaaattttagttcacatctaaccatttcttttcagaatcctagagcatatggactttacagaagatagagaaaacaaatgaactgtaaatagcacattgttacctaacatcgaattagggaggaagtaactttggtcatggccacagcatgttggaagaattaacaggcacaacctattggtgagcagaacgatgtcaagatttactaactgattttgttaattgctagtacaaagaaccaatttattgccaagaacccacacgtcttgccaaattttagtatttaatattcatcaacaaatcacgtgtttatgatgcgaaatattgaatcatgcttagatggtcacaaacttgtgaaatttgaattgtgaagcatccttaactccagctcccagtcccagacacaatattcctgttgacttgctactgaaaataagcaagaactgaattaagtacctgaaaaaaattacttgtacagcactagaacttaaatagagctagaggtagaattaaatacataactgaattagcatgacaataaatcaatgctaccttacgaacagatttatgaataagtcatggatcttgatatggaaatatggaagagttagtactattgtaaactacagttatgagtcatgacattgcaaatcctaaacatattcaatattctttgtgcggcactgactagcaagtagttttttttagacaattatcagcaagacatggagcatgacctggatatgcatgcaaatggaaatgaggaacaagaaattcaactgggtaaaagttcattactttttgatcagttacaaacatgtttacattcttgattttaggactgaataaatctacacaatctgattaacatacattaacttaccatgtaaaattttttgtagacaatgacaatgaattgcaacatgagctggaagccttggaggatgatcttcgggactatggcgtgtatatagatactgtcaatgttgtctttgatagagaggagttgtcggactcagaagaagaagaagatgcaaatccaaatccaaatccaaatccagatgcaaatggaaatgaggaaaacagttctacagaattgacaa

SEQ ID NO: 48090 - DNA, 638 bp, Oryza sativa
acatttataccgaagcttgcatgtacggtttcaatataaacactgtaaaggataatcgtacgtatctcagatctgaatatagatgtaactaaaattatgattttgagaaggcacttaatttcccatttcatcattgtttgagtcaaaaaaatttatgtattaagtcatctattaaacccgcagcaacgcagcggggtacgtactagttacctaatggtcattccagaggttctcaggaatcaaccgttccagcaaggccaaagcatactgtttatggtgttttgggagctttgtagcagctatgagatcaacgcggggaatcctcatgactcctccttgatgaaccacgtgatcagcacataggaaacggtgaggattagggttggtgttcgccattgcagcaagcgatggcagcgaagctagattggattggggtttttctgtaacaggaggggaagaaactggagcgtctatcagagaagaaggtaattttttggcacccatattaacgaagtccttttcacatcagagttaatatagccttaaccacctctcctttaccagatagagtgggctttaggggctttggtaaccagagttattggacttgagactagcagagtgggctttaacacaag

SEQ ID NO: 48091 - DNA, 612 bp, Oryza sativa
tagtgtccgataaggattttatcttttccttttatctttagtttctttcctgtccgacaaggactagtatctccctatgggtataaatatgtacaccctgggtcattgtaatctatcaatctatcgatcaatacaactactctcggcgcatcgccaccctctttaccgaggtttttacttatcattcgatggaacttggcacctgacgcggggctgcatcggctttcgatcttcagcgaaggggtaagtcctacgttccgtcggcccaggcaattgtctcatctacatcagcgttgttcaaggctgcatcagtacattcgacctcttggattgctccggtttggatgatatatttgtctacctatttatcatatgtctctgttaatctagtcttagcatatcagtttacctctatcggccgcttctcgctttagggtttctgccggtatcggctaaatcgtgttgctagattagattagcttagacatttaccaccctaaaaatcagtcaacggcttgattgtctagatattatgtttcttttcatacttagtactgcatcagttgagtttgatctactaagtcatgtttagaaccataatctctagcctgc

SEQ ID NO: 48092 - DNA, 257 bp, Oryza sativa
tattacgcttgttagtggcccgaacctgtataattatctttgtctcatcctctttgagggacccgacccccttgatagcttccaatcttcctagctgcttagctttcactcgctgcccccagccgaaacaacaaaggaggggcctcacggtcccctactcgaggagttcatcctccaacagctggcgcgctaggtagggggcgcgttcgtgttcacctgaggagcactcatcttcgtgcgccccaagttttgtccgg

SEQ ID NO: 48093 - DNA, 170 bp, Oryza sativa
agcctgaattcatccctgtaaaccggaacagcgcggaagctccatgctcttcctgttccagctcgatgccaccgagcaacagcggggatgaagtacacgtcccagatcaaaggggtttaggatggcgagcctcctgtgggttcagcaggaggaggtcgccacgccacggc

SEQ ID NO: 48094 - DNA, 535 bp, Oryza sativa
atttcagctccacttaaaatgggtacagagctgactagagcactatcataaaataaactagagatgtggagctgggtttgggcttgtcggaggacgaactcctcgagcgggggaccgtgaggcccctcctttgttggttcggccgagggcagcgagtgaaagctaaggagctgggaagattggaagctgtcaaggggatcgggcccctcaaaaaggatgagacaaagggaattataccggttcaggccgctaaaaagtgtaataccctactcctgtgtatgatgatttttctgagctttccaaatctctgaacctctggtgtacaaactagggctaagcgatccaactctttgttcttcgaccccccctcttcactggacatgaacctccttttatactccaaggggttctctcacatgcgcgggggtgtgccgcccagtgaagggagtaaatattccctatattaaatatgtgtcttgcaccacaacgtggaagtcctcttagtatcggctgttgtgcggggcccatcaaatca

SEQ ID NO: 48095 - DNA, 1501 bp, Oryza sativa
tggcctctccaatgtatttgagtaggctactgctgtattcagcttatacagctttacagaaacaacaagtgcaaccgtaagaagcgctttttaatatcccaatttcaagcagtttgcaggtcacagaagtcttatttgctcactgatttgtcgaatcaaaactttagttgcagtgctcattttatctgaatcaatcaaagaacagttacccagatgaagattaagatggctttctgatctaatactgatggacaatgtctcttttcttctcgctatattatgtcatgtgcaatgtcggttacaacgtttaaatataagaaaggactttgtatacaacatgaaccccgaaaatatagataaataatagcatagaagcaaccgatattttacaacttgagttacattggttgtgatgcaaaaatgggttattcaatggaagattccctggaatgtagtataaaacatgcttccatttccttaaacaaaggctccaaagatgctgaaatactgatgacatatttgggaaacaggttataatgtatttctaaaaataccatattaacacaaagatacaggcatttcgattaatggttgcaaaagaacaatgttatgggaacagacaagagaaaggaatgcctctcctgttaaaagaaagcaactatacagaatcaaaagaatggagaacttgttcaagaacatttctagtctggctgtccaagggcttctcctggctatccgagtgggctatatttaacagatagagcttcctagaagcaacaaatgcagccgaaaatatcctcttcatccctccccttgtactatccagtaagtattcgatttcatacactgtcaggccatcatggcctgatctctcttcagcagaaataacctctgcagatttggtgctttcctgtattaacggaaaggattcaaaccaactgtcgatactagcattgaactcctcaagtacaactgatcctttacaggcaatcataagcaaaacaataaaattaactaagttgagttttcacataactgtttatttacatatgctactgtcaatttgtcacacaagctaagcaacaatacaagatgtatcacagacccctatatgataattaatcagcgtccatctaatctaattagtagtgcacttcaaatgtgaaatcatgaaaaatcactaggaaatagcatggagctgacaaattgcaatgtccaaaaggatcgttcatgcatttacctttttcttctcagcctgaatcagcctttcagcgacaaattgcggtgtgccaaactctgtcagcgtcgataggcggacgggattaacaacgataccaatattgttactccctttcccctcctgctgaaagagcgccgtcgccccggccttctccaccttcaccaaatcacgccacagaaacctcaaaattcacagctccaatccacacaataccagcgcatcaatttctactgcattgcacgatgcgtgctcacgcaatta

SEQ ID NO: 48096 - DNA, 1501 bp, Oryza sativa
attgtcaatccaattttatttctaatatccctacacacgttgagatattttatttttttcaaggataacctttgacaatcattgacgctcgcaaccaccataccacattgtcctaccaactctcctagctaaaaaaaatgtatcatgtcgtcccaccaaacctcctagctatagaagatatatcatcgcgatacttcgtgttgaaacaagtggtgctatgctccatgactagagattaattccattgtactctctcatcgcccatggcaaagatctatggtcaggctttggtaactatggtaactatagctatgtttggatagagcttgagattttgagaaacatttgatgagccaaatacgaagttaagcttcttggcttctgacttttagtttatttttaattctgtaactataaattctcaaaatctttctgagaatccaaattctctacttacgagaagctcctccaaacatgcaacaaaaacctaagaaagtgaagtacgaatcttgagtcacgaacaatgaccagatcttgctaaccctggagagaattatttggacaatgaaaatactgggaaaaaagaaaatgttacagaatggtatcccgttcggatgggataatgcctttgagctactgcatgatatagctagtattgactgaggtatcatacgatacctggtaggtatcagctgatatcccgttcaaacgaaatgatatctttgaggtattacataatacctaagatgtataggatgatacctgtccgaacataatactgtcctgtaacattcttataaaaaaaaaacaattgaaagctggggccatgggcaccgtttttcttccaaaaacccggtagagaggaaatcgggaagcgaattaaatactcagataagccggggaaggcgacgtcgcgcgctctggtctcttcacccgggcaaacatccccacaacgagtggtcctcctcacctcacctccaaccccctcgtctacccacccactgccacgtgggaccagccacccacccgggcccacccgtcagtgaccaaacgtgacgacgaggtgaggcagatcagcggaggcgaggtcgtcgtcaacctcgcgccattaatggcgcgcgcggtaatcagttaatcaccgggcttaagccgctgggggcggagaggcaggcaggcaggcagtgcgccattagcgtcacatggggtgggctcttgtacactagccattaatacggcaggtcgcccatcccatcgcgtctcctccgcttaaatccccgcggctccctcctgtccgtggttgcagctcgctcgccgcgctagagcttagctccgccgccgccgccgccgccatcgccggtcgagctagctctttttggtagtgtagctaaggctagcaagaggccgggagcgcgggtggtgtggccgcggattatctgggtgcttgcttgtgcctccggatcggccgggggtgatcgaggcatggacgcggtcatgtccgccg

SEQ ID NO: 48097 - DNA, 407 bp, Oryza sativa
caaccttcgggatatcaacactttttttctttctgtgagcatcatgggcctcttggcaaatcatgcacccatttcgacttccaccagtaccatccactgcgagtccattgtctaagggactaaaagacgcttcatgctccccaaacccccctgctatcatccaccccagacctgatgctgacttgtgccaactaactggaaacattttgtggcattcttttacaagtcaattttgaggtaacgtgagttacgtgattagtgataagctcaggttgtctttatcactaagcatagctctgatttgtatacggagcctagcttgcttgagttccagttctaccggctgcagtcctagatataccatcagtttgacatataatgtttcaaaaatgtttactttcttttga

SEQ ID NO: 48098 - DNA, 259 bp, Oryza sativa
ccaaaagcgtgtgacgcttaaaacctcatcatcacgacgagttcccatcgcgatcgcgatcgcgtccagctagctctagctcgatcctgctcggtgccgtgccgcccacccgcacgccacgcgtggcgcacgctgatccgcgcacagatgcgcgggggacggcctccggcacgacttcacgagccaccgagtgtacagccaactatcggcagctataagagcaggtaaaataggaggctataagctagctataaacata

SEQ ID NO: 48099 - DNA, 1139 bp, Oryza sativa
tttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccgaataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagatttgtctcgcccggagatacggtaacgccgcttcggtcggcgagcgtaattaacgcgcgcacgatacaatccatttcgattgccacaaccgcatatccacttcatgcgccgtaagcgggcgaatgggattagtggaggcgtgggcacgggaaacgagggagcgagatagcgagatacgagggagcgaggtagtgggcgcgagaaacgaggagccaggcccagcgatggcaagggtataaaagcatcgagtaaaggatttgctcccttcctttcgccattgttcctcttgccttcgccgcctgagctctaactctttctctgctacgccctactttcgccacacgcgctcgttctcaatcatctcttcctccaccacca

SEQ ID NO: 48100 - DNA, 1501 bp, Oryza sativa
tcataagaactgcatggcaattgacaacatgtgaagcagaaaattactattttccatggctggtttggagatacttatctcttttgaaaagcatagcagattttatagctaagcacccaatctaggggaatgcgattttatagcacatccatggctgctgattttgatgtttcctttcattttgccgtagagtttggatgttctagaacatatttgagagtgaactatcaaattactttttttcccttttcttttgaaatggtataactttcattttcccttgtggaaacaaagactatcaaggtgtaggtaacataagcctgctaatccagagagcaatgaaacaaatagacataatttactagagagttaaacagaaaaagggactgccaaaactgaaaacaaacttgcatcgtctcaagtaggcaggcctcaaatctcaatccatcagatccactgctcctttttacctgccacctattcaatcctgaattgctgacttgcaagtcttaacccttgtattgagttggtgccttacctcattagttgcaaccaggtatttgcaaacctgctcggtacccagtgtgagaaacgagcaaactttgtactccaccagtcctggttctctgattgctttctgatgaaactaatcatttctggttctttgttgaggtagatgacatgtaattccttacttgtagtaatctaagtaatgtattcctgatctctatatctgaactatcaataatttgaataaaacttgcatagtttctctttaccaagctcatacaacttaagtgagcgatttaggtcaaatgcttaatcaacttcctctcatacaagaaattgttcatccggcatcctattgttgactgtggtttggttatttctttgtttctgtactctgtgatagcttttctaacgtgctttgaatttgaagagtaataaccccccaagaaattgattaaagatgctaaaataatcaatccctttagcagttagccctgttccagtcttattttcttaaaaacatatatcacattattactactctgtagaatgcaattgctcaaactaacaagaaactataattgtgtgttgaaatttgagtttggagtcgagacagctttcaaggatttaccatccagttatctgtaatttcttcaaaggcataaccagtgcattaccattatcttacaattaatgctgaagattgcaatcaaatgtgaatgaaaaggcttaaaacctggagcacacaataatgtagcattgactcgtaatctattggctttaggatgcattattcagcacaagatgccatcttttgagggagtactcccaattattgaagatcattacctgatcttcctgcttatccctagtatttgataaaccaacaataagtagtataggtttgttgtcaatttgcgtaatgtgattatcatgagtccactgctaatccagtgcccacaataaatagatgaacatcggagtgctgcca

SEQ ID NO: 48101 - DNA, 253 bp, Oryza sativa
gaaacattatttatcccaatagtgtgctaatgtttctaagcatggctaagcaattatgtctaacatctagctgaaccaatatataaagctcaactagtcaaattatcacccaaggtataaagaatagagtaaggaatgcaaagtgctgatgaatcccctaatgattttggtaaaaatcattaagttaaggtggatacacatcttgtcatatgatcaaatggtttcgcgaaaaatcaataatcagacaacaaga

SEQ ID NO: 48102 - DNA, 923 bp, Oryza sativa
aatgcatcgaaggagatgggtttgagacccatgtgagttatactatggtggtaaacttatctatgtgatcggagatcccgtgaattagaacctgggaagaacaaaccattagtaaactagaggagagtaccaatctataccctttctaagtgaagatgtatgtactctcgtgagctgcaaggcaggttggctatgccttaatgagttctgttggctttaattagcgaagatgatgtcctacagagcattcttgaaagaacttacctttgtaagcttgactgttggtcgcagtctatgaagattttgggtgaatcttctaggaagcttacgaaagacctaggagtatgacttatacgctccacccgaggagtagtctacaaacagtctagtaccagataagactctgagtgaaacttgcttgcacaagacttgcaattcaaggcgtagtccattgttcaagttgtgagtaagtgtagcttggagttctaggtggatgttcaaccttaatcggtctccatcgaaccgctggtatataaacagtacattggaaaaggaaaatctcaatgggattttgagatttggtgggggattgttggaattaatagatgggctaaggcccattcgaagattaattctttgaaaaatcacaaaagcccatctcatgggatggcatgcatgtggagtttagtaccaccttacttattctaggagagggggaccttcttaaaagggaggatgccctcctagccacttcaagcatgtgtggtggagaaaagagggggaacacacacgcgcgcttgcctggcctggcagggcagggcaggcggcgcgcgtgcacgacgtatgcgtcgaatggtccgaaaaattggctcctcacccttgcgcagaagtagcctccttttgcagttttgtttggttgcaga

SEQ ID NO: 48103 - DNA, 249 bp, Oryza sativa
ccaagttgcctctagttcaaatgcaaccttaagctgtggtggtcttcttgccagtgaatttcacagaaatttacttagaattatgaattgcttttcctgataaggacactgtttactatctcaaaatgactactatcacttgtctgataaggacactgtttacttgtcggatatttacaatgacacaggcatatttacttgtatgatctatcttctgacactcttccttttttcccctctaatttcagc

SEQ ID NO: 48104 - DNA, 308 bp, Oryza sativa
agaagtcgcttgaatagaatgcatgttgcacactgaatataatgattttacaaagaatccagaagaagtagcctaaacatatatgaaacgtttgtactttcacatacatgcataacattgagcaaagacctacatggatacatgtaattcaaatggaaaccaaatctagaaaattttcaagagccttgattcaacaaacccatatttccatactctctacaagaaatggtcaatgtgaatatctgggaaatggcattaagaaaaagtgtcgattgttttttttttctattataccttctcgacgatca

SEQ ID NO: 48105 - DNA, 302 bp, Oryza sativa
cataataagtgacagaccaatacatgattacaatataaccaaatatgtgaatcatattactgatccgattattacgatggaagtggcaaggaaaactaataataccacgtgaactgatatgggcaccaaaattaccccaaaaatatataaggaacctgagactagtaaaaatgtttctgaaaaaagcaaaatcacaaggatgttcatgtctcaatttggcatgagctcaacgcaatccatcccactccacgggtcccgagcaacagccgatctactactcctacccctcccggctcagcaga

SEQ ID NO: 48106 - DNA, 1501 bp, Oryza sativa
gttcgtttgcatggactgaactaatcaatgcaacactagagatgccctaatcttggacaaagaggtggttggcttatcgtctttttgagttacgacgaagaggtgatgacacaactcatcctcatggtcaatgataatcatcgtcaagccctcatggtgtgtattgttgataagtgagagatcacgagaaagcatagcctagtgcacaataaagcttgttcgggcaagctcgtctcaacattttttagcgtccaaatttatcttggtaatgctagttgagtattgatgcagatacattggttgacttctatttcatcgaattggctcagtttttgagtcccttctatttactatggtcacatgcttctcatgactactcaacatcatcctgcttggtctagccatcaacgacatcgtatttctatcagccacgttggtgagttcgttcgttcattctagctctctgtattttttccatgcaaaaatgatatactgcttgctactccttttgcgtgtcaccttttcttttggcattgtgtaaaggcctgtgttcatttttggcgcttgataatttgcccatttatgacattggttactgccaaaaaccacccaaatcaaagaatggccaaaaatcagctggcttcacccaacagttggtgctacacgtcatcccattcaatgccttccggtcaatccccccatctctctcctcccagctcccaacacgtgacccccggtgacccccacactcactgcgaggtgggtcccacctacgccacgaccagcctatggcccacatgtcagtgacgtggcgtcgaacagccgccggcgcgcgggggtgacctagcctgacctgcacactgaactgcacctgagacctgacctcccaccaccaccatcgtcgcctcgctctcgcactcgcactcgcgctcgtgtgggttcccttctcggcttctccgaggcgagggcttggctgcaggctaaaaccctctccgcccccaccccccgcgcggtggctagggttttagggcgagggtgggaggaggcaggcaggcgcgcgcgcgcgcgcgggtgttcaggtgagggggaggagggctctgatcccgtctccgcaatgtggggggcgctgggttactcgcagaaatggggggaaaggggatgtggttggttgtttgtctgttcatcgtcgcttgttgtggggggtttgggtttccccgagggaagggaagatttgggtcgtgcggagaggcgtgggttattcaattttggtgcactttgatatgcctttttgtttcccaactaaggggttctatctcatgtatgataaatgttcaccggagtaatccgtgtgggtttggggggaagtttgtggtgtgctgggaatctaaacgaatcctgatgattgtgcgaaatgtttttttagttaggggaggggaggggatcctggtgagcatccgcatcctctttctgatgattcatctctcactctaccacctggagt

SEQ ID NO: 48107 - DNA, 1501 bp, Oryza sativa
cctctgaaaccatcactcccagcattcagcaagattcagagggagcaacaagatggaaaccaaatcaacacgagaacaaaacaaaaaaaaaaggaaagaaagaaagattcaagaacaatcacactcacgctgctgcggcggcggcggcggaggatggcatctcgagggcggcgatggcggcggagggcagcgcgtcctcggcgcgcgcgcacggcatggggagcgcgcgctcttctccttcttctccagcagcaagaagccaagaaggcaagaatgcaaaagattcagctcactgcagcctcggcgaacggaacgggaccgattaaatgctcattgggagacgaggattcgcgctacgaattcgaggtgggtcgatgggcgccaccattgtaggggcgttgaattggaagggtggaatggaaacgacaagggcgtgtgggtgcgcgagggcttttatgtttatggagggagggagggcgtgcgaggaggttggaggtggaggagtggaggaggacgacgagcgttgaagtgaggtgacgactgtgggtggagcggtgacgacggcggccgttccacaggggtagcaatagcagtagcaaatatgatgttcctaccctacgtaactgtacacctactttcatcattaggccggtgtttggatcaggacttaactttgttatctatttttagacactaatttagagtgttaaatagtataaactacttacaaaactaattacataaataaaagctaatttacgagacaaatttttcaagcctaattaatccataattagagaatatttactgtagcatcatataggctaattatggattaattaggctaaatagattcgtctcgtgaattattccaagattatggatgggtttattaatagtctacatttaatatttataattagcgtccaaacatctgatgtgatagggacttaaaagttttagtcccatgtaaatagggtcttagttccaaacttttttttcaaacttccaacttttccatcacatcaaaacttcctacacacataaacttctaacttttccttcacatcattgcaatttcaaccaaatttttaattttgtcgtgaaataaacacacccttagtttctatttttgttgtaataaacagttttattttttatattataactcattttgattttttttctccaaaaacaagtttaagtcttcaggtttagtcaaacttataagaaaataatgaaatttttcaacgcaaaacaaacttattatcaaaatatattcaatattacgttcaatgaaattaatttgatgttgtagatattgggtagttttttctataaacttagttgaatctaaagaagttcgaatagtaaaaaaaatcaaagcgacttataatacgaaatggacagagcagattttaaaaagagaaatttatatatttgaaaaatatataggttgtattagtgtatttgaaaataaaaatgaaattgatatactctc

SEQ ID NO: 48108 - DNA, 1501 bp, Oryza sativa
ggtcaaaaagaaaagctctcatagcaacactcatcttgataaaattaatcttacaaattcaaattttgcattgcgattgaatagcacagatcatgcatcataggtaaatctaattgaatgatatcaaatataaaacttgacctgacgggggagggagggtaagaccttctcacgcatgtcaagaaaaccccctaaccccccttacacagcggcacaggcaggtcaagaaaacccccgaacccttgccccacccttacacagcagcaccgtaacccgtgaaaataggctggtccttagacctatgctttggcgtgggacaaacgaggggattttttttcaaccccagcctgaaattcgctcccacaaggagtcgaacccaggacctgaggagtgctactagagccacctaaccaactcagctagaggtccattcgcaaatgatatcaaatataaatgatagagaaaaggagggtttctagatctcatcatcaagagtagttacatcaatcatatgctcccttatcagacggtactgtctctaatggatcacaatgaccaagttgtcgcttctgcatgcatctctttctgcaagcattgctggtaaaaagcatcagagaaggagaacttacaatctcatcctcagtggataggctaagcttgatgctcttgatggcaccttcagcaaccggaattgctgactggtcctcctccatctatctgaaatagacaaagggacatggctgtgtccgtaaaaagaattgaaaagaaagaaccggtaataccaacaagctagaacccaccattagctccaattaaacaacaagaaatagcagaaacaaacagaaaacagcaacctcaaattcgcaaacgtaggataaaaaccgctgtaattatttgttggcttctcggaaaataccactccaaatcaaacttgcttttgattttaatcatttgtttccttttcctaatgggtgcactaacaaatatattcccttagagagtgtgcccttgtctccaagcaagttaattagggcaaagtggctaagctaatattaggttactcctaccgctgaagctgcatttccttctgtttcatcttagctctagcatcctactacgacccaccaaaagtacacccaacaacaggggaagatccaaaagtacaaacaaactgttacttgtatcaaggttaaggctctgaaattaagagaaagagcttcttccagatctagaagagaagctagggttaacgaacgaacgcgagcaaattccacacaaaagcactccaggtggtagagtgagagatgaatcatcagaaagaggatgcggatgctcaccaggatcccctcccctcccctaactaaaaaaacatttcgcacaatcatcaggattcgtttagattcccagcacaccacaaacttccccccaaacccacacggattactccggtgaacatttatcatacatgagatagaaccccttagttgggaaacaaaaaggc

SEQ ID NO: 48109 - DNA, 282 bp, Oryza sativa
taataatcaggtttgtttcttgatcctaaaccatagctggaacgaatttgggtggcctaaactaatcaaaatcggcgccgaaagctagaaaccaaccaaaacccaaagactgaacacatccaaatccagcacataaacacaaacaaacaaaaaataaaaacaaatcagcacagaatcacctccccctctcacaccacatgtccccaaaccttttaaattaaagctgagcaaagaactaaactaaagaagaagagagacaactctgaagcaaagcacatcaca

SEQ ID NO: 48110 - DNA, 1501 bp, Oryza sativa
agctaaatatagctgtaaacatatccatattgagagatcaaattctccaaattagctagcatcaattatgcaaaaagaaaacaagcattttcaagtcatacatattgcaaaaaagaaataagttatatggcctgatccacaatatataagatgcaagatgttaatttaccacacaaaacaaagtgtgctaatcaaatgatgctccttctactatgagtttacaacactgagaattaaactctctctcttttttattttttattttttatttttttgcggggaggactgaagtaaactgaaatctgttagtaaatgcatcgtcttacaatcatacgtgaatgcaaaatgttcttgtattaattagtggctaccaaagtttttgctgccacgccccaatccctaaacaatttcgaatatttttcatgtgtgatttacaacgagtgggccgctaatccgcatcgagaaatgccagaaatctcaaccaaagtttttgcagccacgtcccaatccctaaacaaagacaggagaatcaaccaagaagctttgatttacctcaagagcgcataccccacggcctccacgaacagctccgtcctgcgcgcaccctatctacgggctacggcggcggcctgacctgccgggcgcatctgccgcgagcctccgcccgccggcgcgtgttggaggccgcagtttggccggcgaggatggtgaggagatggttcttcagatcgcctgtaggagatcgaccgggcctccaacatgggcctcgggctgctggctggatcggatttgtttgggccatttgggccgggagaggatccgtacaaatgcggaatttttttcctttttagattttttttaatatttacagaaataatctatcggcgagaaaaattgcaaaaatagaccctgccgccccaatggtgggcggcaagctgacgtgacaaacgggggaggaacgggcgttgacggagggtgggttttttgcatgaaaacccttgcgctctctggtggggcggcaaggggtccgaatgcaaaagagcggcagggggccggccattttgcaggcggccccttgccgccctctggccgggcggcaggcctcgctgcctataaaaggcctgccacccagcccccagccctcattcctcacctctcaaatccagtgaaaaaaaaagaagagaggggaggagaagagaagaaggggcgaagccctgccggattcagacgccgatttcaggtaatattcgtagatcctatatgtgactattgagttaaatagtgtgtatttttaaaaaatttatttgaataaatgcattatatttttatggttttagttgtactaatttagaagtgcgtattgtagatatcggtaacaacgtagatctgctagtttggaatcaatattttaccgttgcattggcttacacaagaagatattacgttgtagatgtttattgcatgaaagagtaatatgatctagttaattcgttgacagata

SEQ ID NO: 48111 - DNA, 1501 bp, Oryza sativa
agcgcaagggttttcatgcaaaaaacccaccctccgtcaacgcccgttcctcccccgtttgtcacgtcagcttgccgcccaccattggggcggcagggtctatttttgcaatttttctcgccgatagattatttctgtaaatattaaaaaaaatctaaaaaggaaaaaaattccgcatttgtacggatcctctcccggcccaaatggcccaaacaaatccgatccagccagcagcccgaggcccatgttggaggcccggtcgatctcctacaggcgatctgaagaaccatctcctcaccatcctcgccggccaaactgcggcctccaacacgcgccggcgggcggaggctcgcggcagatgcgcccggcaggtcaggccgccgccgtagcccgtagatagggtgcgcgcaggacggagctgttcgtggaggccgtggggtatgcgctcttgaggtaaatcaaagcttcttggttgattctcctgtctttgtttagggattgggacgtggctgcaaaaactttggttgagatttctggcatttctcgatgcggattagcggcccactcgttgtaaatcacacatgaaaaatattcgaaattgtttagggattggggcgtggcagcaaaaactttggtagccactaattaatacaagaacattttgcattcacgtatgattgtaagacgatgcatttactaacagatttcagtttacttcagtcctccccgcaaaaaaataaaaaataaaaaataaaaaagagagagagtttaattctcagtgttgtaaactcatagtagaaggagcatcatttgattagcacactttgttttgtgtggtaaattaacatcttgcatcttatatattgtggatcaggccatataacttatttcttttttgcaatatgtatgacttgaaaatgcttgttttctttttgcataattgatgctagctaatttggagaatttgatctctcaatatggatatgtttacagctatatttagctgatattatgttgatgtacattttggctttctgctaacaagttgtgtactatttccagtccaaagagagatctttttttttttttttttttggggcaaagagagatctctttaacaagctaagttttgtataactgtgtgagtggagctaaaatgataatataaagctttgattgggatgtgaaaatccatgggtggactcaggtgcatggggtctatcaagaatttagataattattgttagcaaacatgttttaagtgttcctctgctttgtccagtacctttgtgtattgtcacattgctattagctttaggagcaagataagggctaaagatcaaataggttccagcaatgccaaatatttcaccatgttacaaacaccaatattggttaaagtttctaagtattttggtttgttccatttggtttttggcagcttcagtatggtttttgtgagctaactttttattgaaaattttgctttgcattgcccaga

SEQ ID NO: 48112 - DNA, 1501 bp, Oryza sativa
cggacacacggccaacgaacgcgtcggcagcaacaacgtagcggcggtccgaatcattcattcattcatcgccagatcgccatcagtttttcataattttgcactgcaagtggacaggtgtgaaacgctaggcgagactaattttaatcatggttgtgtttagttcgtggtccaaaatttttttaagtatacggccatacatttaaaatacatttaaagtattaaatatagactaataacaaaacaaattataggttctgtatgtaaactgcgagacaaatttattaagtctaattaatccatcattagcaaatgtttattgtagcatcacattatcaaatcattgcgcagttaggctcaaaagattcgtctcgcgatttacatgcaaactgtgcaattgattttttttcgtctatatttaatgcttcatgtatgtgtgcaaacatttaatgtgacggaaaagttggaagttccaagaaaacattttgaatctaaacacggcccatgtattcttccatagacgatatgatatgcagcacgacaaaagacacagggccccgctactcctacagtgatgattaggatcgcttaccgtctacggatgggtgcctgggtagaccgtgtccatgagcctggaaaatcattggtttcttgttttgacgaaaattggaaaatcattgattgatctgcagtgcagcaatcctcttcagacttcgacgtgtacgacgtgcagcacagcagtacagcactacagtcgtctgaactggaaatggcctctatgctgtttctagaattggtctttgtgcagccgatcttctgtaatcatcttgtgttccccatgctgtttctgttctggccgaaggatttctccagtttgtgctgcacctgaaatggtgtcaaaagaaccatataaccaacgacataaaacacgtataagagagaaaatgaaagcatgggaaataaacaagcaggagggatggcatatgtaattgcaactatgtaattttcatatggagatcctgatggtgtttggtgacagaaacttgctgtctatattttttcagttaatgcagacacaaacaattttgagctacctgtattagcacatggaacatcataccgcagaagctggacatgaatataaagtgcaattgcgcctgctacagatcatcagatatcagaacgatccgggttgattttattagaggatctcatctgcagataaatgcctttcgaaacaacaactgttcagctaaattaaggtctggccgtctgggtgccccttaaaaaaagattaaggtctgggtggctgaattatgtcccaaagacaatgggacgaattaattaaagtgcagctacacctactacaaagcatcaaatgatctcacctgaacttttttaaaccagctccgtatgcaaattggaattaaaataagaaaaatatgattatgacaaaagaaggaaggaagaaatggaattctcacaaacctgaagatctgtg

SEQ ID NO: 48113 - DNA, 1501 bp, Oryza sativa
tctttccaagtgaatctttgcaaatcttcagcaatcttgcaaactaagtaatctagttaaccttgaccttggagggaacaatttgagtggcagggattccagaatctataggtaaactcaagaaattagaggaactccatttaggctacaacaacatgtatggagagatcagatgtgccatcgactccgagcagctgcacaaatctcgaaaccatagattagatatcaagagcaacaacttcagtggagagctctccaagatcattttctccaccttacccaatttttacaaactttacatcttatgcttaacaacttcaaaggaacaattccgcaaagcatatattcatgcatcaatctagttaagagttgccaaaattaagtagcaaaccaaatatctatgcgatattattaaagttgtcaaaaaaatggtagggcaaaaaatagcttcaatccaaacaagcctaaaataattttgctatggaattgtataggtcgtatcgagaaacttgatatcaaaatgtcaagaacttgatattcctcgtacaatcgtaataaaattggtagggcaaaaattagcttcaatccaaacaagccctaaaataattttgctatggaattgtataggtcgtatcaagaaacttgatatcaaaatgtcaagaacttgatatccctcgtacaatcagaataaagtttttctatgcttccctgtggtgtcccaactcccaagtgatcagcctgctgccacttgcagccctcacacgctaccttcttttttttagagaagggtattttttacccggcctctacatccaactggatatatacggccattgaaatagggaacttagccccgcaaacaacctaatctctgaaattcgctcctatgaagatttgaactcagaaccttggggtattactcaggtcactgcaatcactagactacaccctagcttacttaaactcttcaagcatcttcagaagctttgtttctttttacagacatgagtcctttcctccttaccaaaaggtatgcatccttgtgtaaaaaaatgaccgtattagtagcacgcaaacatatctgtcaagggaagagaatggtgtcagatcaagtgaatttaggattgctgtaacaatgtcaatgtcataaggattgaaataaataaaaatgattaaaggaaaattgaaataaataaaaatgattaaaggaaaataacttgtacggtcagggaggcagaccactcagacttttcaatagaagattttatgaagtccttgacctgtatttcttttttatgacttcgagtagaaaaacagaataaagttgtcacgtgctaggaaaatggaagcaagagccacttctttcttcctcctcaagctctttcttgattagatcatctcatgctttgcccagtcagaaactcaggatacaaactaagcataaggcttccatgctagtatcaccagaaaaccatgcagccacctcattcttcatgcaaga

SEQ ID NO: 48114 - DNA, 1501 bp, Oryza sativa
agagagctttattaatgattaaatcaaagcattcgaaacgagaaaaatgttttagtacatgatttattaaatattaactatcataaaattaaaaaaaaaatagttttacttgaatttctaaacaacttctgtatattttttttaacaaatacacacattatttaacattttaaaacacgtactaacaaaaatcgagaaaattaaaatttagagttgaagaaaaaaaacatggtctaagtagaaatatcatgaggttgcctgtaaccttgatccaagcagcatacagatcgctactattggtagtgatcctacccggaacgactttaaaaagcagaattcaaaaacacaggcaacaggaaaacaaaggaattaggacggtataataccatctcatcctaaataatgtcaaatcatagaacacaagaattgtctagtcatatagtttggatgcttcacatgaaaacgctataggatttggagaaaagagtgatacaaagacttccaggaggtgtgagttcatgctaatttttctctaaaattcctaaaaaactaaagggctcattccttaaggagcccttaagcacgaatgcacagtagtctaagggctcacgtgcaaaatgttactactccctccgtttcataatgtaagattttctaccattattcatactgtctagattaattaacatccatatgaatgtagataatgttagaaagtcttacattataaaacggacgaagtattatataatcgctcgcacgcgcgacttgatccgaaccgttgaaacgagaccagatggccaccgctcggtaaggcgaccgttcaccgctccgcgcccattctccaataaataatcacacctccacgcctccacggcggcggcggcgggatgcagagaaggtatctgacaatagatcaaagcccagtgaatcagtttataatctcatttcaaaaaacaaaaaaggacataagtgatcgtctgagttaactagtcatccacccatccatcacatgcttaggattttatgctcgtgatccatcgtttcgcttatcttacgtctattcgtaacgtttattagcaaagaaaaaaataatttaatggtaaaatttttatattcttagtgatacaaaaaaaataaaccatgataaataaaaccacaaaatcaattttaagataagaataattttaaaatttaaattttagttcataaacataggcataagcataagagcgaaaacctacattatatactagtggaaagcggaaaacaactgcaagcgtgtggagcaaataaaccaaagcgcacgcttgataacaacagagtcagcaagtaaacggtcaagattcaagccgaagaagggagcagcagttttggtccctccactcaccagttgttcattgttgttgtacacaccatgaccgcgacgccgatgcatgatgattgctgtaaatcatatacacttcttggaatgacgctttaattccatgtagtgctatct

SEQ ID NO: 48115 - DNA, 1501 bp, Oryza sativa
agcactacatggaattaaagcgtcattccaagaagtgtatatgatttacagcaatcatcatgcatcggcgtcgcggtcatggtgtgtacaacaacaatgaacaactggtgagtggagggaccaaaactgctgctcccttcttcggcttgaatcttgaccgtttacttgctgactctgttgttatcaagcgtgcgctttggtttatttgctccacacgcttgcagttgttttccgctttccactagtatataatgtaggttttcgctcttatgcttatgcctatgtttatgaactaaaatttaaattttaaaattattcttatcttaaaattgattttgtggttttatttatcatggtttattttttttgtatcactaagaatataaaaattttaccattaaattatttttttctttgctaataaacgttacgaatagacgtaagataagcgaaacgatggatcacgagcataaaatcctaagcatgtgatggatgggtggatgactagttaactcagacgatcacttatgtccttttttgttttttgaaatgagattataaactgattcactgggctttgatctattgtcagataccttctctgcatcccgccgccgccgccgtggaggcgtggaggtgtgattatttattggagaatgggcgcggagcggtgaacggtcgccttaccgagcggtggccatctggtctcgtttcaacggttcggatcaagtcgcgcgtgcgagcgattatataatacttcgtccgttttataatgtaagactttctaacattatctacattcatatggatgttaattaatctagacagtatgaataatggtagaaaatcttacattatgaaacggagggagtagtaacattttgcacgtgagcccttagactactgtgcattcgtgcttaagggctccttaaggaatgagccctttagttttttaggaattttagagaaaaattagcatgaactcacacctcctggaagtctttgtatcactcttttctccaaatcctatagcgttttcatgtgaagcatccaaactatatgactagacaattcttgtgttctatgatttgacattatttaggatgagatggtattataccgtcctaattcctttgttttcctgttgcctgtgtttttgaattctgctttttaaagtcgttccgggtaggatcactaccaatagtagcgatctgtatgctgcttggatcaaggttacaggcaacctcatgatatttctacttagaccatgttttttttcttcaactctaaattttaattttctcgatttttgttagtacgtgttttaaaatgttaaataatgtgtgtatttgttaaaaaaaatatacagaagttgtttagaaattcaagtaaaactattttttttttaattttatgatagttaatatttaataaatcatgtactaaaacatttttctcgtttcgaatgctttgatttaatcattaataaagctctctcttt

SEQ ID NO: 48116 - DNA, 1501 bp, Oryza sativa
atgctttctggaattgtgccggtgaagttgttgaagtaaagatctaaagtttttagattgtgtagagcggagaaattgactttgccaagatctccactgaagttattgtgcttgagatcaatgattgagagatttgtgcagctgcccagagttccgggcaactcgccagacatcatgttgctgtccaaatgtaactcctccaatctcttcagttggctgatagaatctggaatcttgccaatgaactgattccctcccagatcaagagttactagatttctcagttttgctatctgtgtaccatcaatttccccatgcaaattattgttaggaaaagataggtactccaatgagacatcattgaagagttcacctgggagtgtcccactgagcttgttgtgaccagccttcagaactttgagcatggagcaattaccaagtcctgaggggatgctgccactgaattgattgtaacatagttcaagcacagataaatttgatgagctgtcacaaaaacgagtcggtatcttcccagtaaacttattactgctgacattgagggcgaccagatttttcatcacatcccatatgaagatggaaactgccctgtaaataaattacttgagatgttgagtacctgcagtggcctgataggggttgaagatggcaactcgttgagacctccattcagcctgttaaagctgacgtcaacgatgatgatagtgctggaagacaccaattcttgtggtaaggcaccagatagcatgttgtgggagagattgagacgcagcaatccagtgaggttgccaagagacggtgagatgttcccctgaaggttcctagaagccagagaaacatcagttaccgtcccatcttggctgcaggcgatcccgtcccatttgcagcaatctgtgccgtcctgccatgatgcagagaggcctccatcctgagagagctccctgatgaacttgaggagggagctcctgtcctgctctgtacatgaactggtgagagaggcgaggttgatgagcagcaccagcgcaagggcaagaacaggtatgggaaatttgttgctgtgtttcttgtaatgaagtagctgcatggttttctggtgaaactaacatgaaaaacctgatgctgagctttgttcctgactggataggactaatcaatgaagagcatcaggaggaagagagaagctgcccttgcttccattttattctggtatactagtcgtaatcataaaaaagaaatacatgtcaaagattaggtgatatagcctatggatattcattaggacttttacagatactgccacaatatcttcttggcaaaatatggttatatagcatccagtttcgcctgtcttcttcggtatgacgtctcactagcgagtactattgaaacatcaagtggccgacctccctgatcgtgcaagttatttccttttgtttggaccattttttattttaatcgttgtcacattgacattgttacaaca

SEQ ID NO: 48117 - DNA, 312 bp, Oryza sativa
atatgaagtttacaaactgttatcttcgttttagaatgtaaggatttttagaatttaatttgtataccataatataagcattttagcattgattcttgtgaatttcattatttcaatagtcccatagccaataggaaaaataatctaagcaatttaaaaattaaaaattgataattgaaaggtttaaaataatcttttgatccaaccttagtccttaggaaacaatctaaaatatgaatatatttagggaaagataaagtagaaaataggggtttgaattggaatggaattatggaggattccctggtttca

SEQ ID NO: 48118 - DNA, 410 bp, Oryza sativa
cagagctcatctttttcagataatatcttaggatgatcctgcattttgcatggacagaagtctaacaacagtggtaatcaattcgtacatagcatcattatgtcttatcgatcatggactttttgattatatatatgtgaaggaatcttatcctttggactgctaaaatattatgtccaaatatttggtgtcttggctgtatgcatctcaattatgcagaggtcagaattgttcttaggacagttgtatcatctcgatgtaatttaatgatcagttcaatgaagcttccattatctaaaaaatatacttggtgtctaaattctgaaagtttcggagatgaatatttttatcatagctctgatgcctaatctttggtatctgggactggtcaacgccatccaatattcagg

SEQ ID NO: 48119 - DNA, 1400 bp, Oryza sativa
cagagctcatctttttcagataatatcttaggatgatcctgcattttgcatggacagaagtctaacaacagtggtaatcaattcgtacatagcatcattatgtcttatcgatcatggactttttgattatatatatgtgaaggaatcttatcctttggactgctaaaatattatgtccaaatatttggtgtcttggctgtatgcatctcaattatgcagaggtcagaattgttcttaggacagttgtatcatctcgatgtaatttaatgatcagttcaatgaagcttccattatctaaaaaatatacttggtgtctaaattctgaaagtttcggagatgaatatttttatcatagctctgatgcctaatctttggtatctgggactggtcaacgccatccaatattcaggtctgctgggacaagaaaccttcgccggtggaggatagcttatgtacaaaaagcacagctgttactgaatgaagctgcttcttggtcacatctttggtacctctatgtgaaaggtagtagtttcagatccacttaaatatattgttctatacaccccccttttccccttcatcagtaatgaaaattgtagatcaatattcttttaaatactgctaatgtgttaagttcatttatctgcacattttgcccttggcagtcagatctgtaaattcacctaatgcctgcattatctttgttgataggcactgactacttccaatcaagtgggtgtccatttagttgcaacaagcggcgttacggcacaattatatctgcagattgtactttagcttgagggtctgtacacaactcaaaaatatctattttgggagctctacatgaggaatatgatcagtaaaacattcgtgccattatcctatgttatgttactaagcaatgatcagatatttgacaaaaaattaagcagtgatatattaaatattcttaacaccttttgattttttttttgggtggcgatcaggtcactgcaaacaagcgcatacttaataaaatgacatcactagcttacctgtattatgcaagatcatcggtgcatgtactgccacaacatactaaattatcctctgggaattctttagttaatcttggtctccccatcagctctgataagattttgcttatttattttaattaactattaaattattataaaataattatgtaagtgtgaaaattttttttgtgttgctgatttgttttgattaaatatcttgtcctccattccttcttttactttaggggatgcacttgttatctgaatgtattcaccagaaaattgatttattagaggtagcattgactactatgaaaggcagtatatatgctttactattgttgtgagtgttcccccttctaccattgcagtaggatg

SEQ ID NO: 48120 - DNA, 528 bp, Oryza sativa
gccaattctaataataaccgtgccaggtgggccaggtccattccattgtgttaataacgatcatgagagttgaaacccagtgaacagataatgagacagccttcaaataatgtaaacaagacattcacataattacaaaggtttcaagaaaattgtcatatctgcatcctttctatcagcgtggcataattaagtagcatgtcaagtaatttgtttattgtatcgtagttgacctagtggtttcttgtaccttgactacctataaaaatagcagagtaggacacctgagtataatatgaatgcatcagttagtcccatggatatatatgcatagtctctgtccttctgttagcttcagtgctctggttatgcagttatgttcacaagagtgagcaggaaggatgaacatatgtgcggcaattctcctgttctacatcttgcaatttgtccatggccagcctgatagtcaaggtgtgctgctcctaatttgttcaactctttatgttcaggcagtacacaatggaaagc

SEQ ID NO: 48121 - DNA, 1501 bp, Oryza sativa
tctcctgctcttcagttcttgctttctccaactcgaggcttggagctcagctttggaggtgtgctggttgatttgtgctgcggctagctcaagatctgtggcatttgacgggcctcatgcatttgggggtctggattactgtgtgctcatggattcgtgttatgattttgggggtaaaatactgaaatcagtgccgctgttcttgctttcatgagggcatttggtgatttggttgcttcgattacatcgaattggagtgtctatgctctctaaacctcgaatttattattgggtaccgcattagattattggcttcgcaagctgggccttgtgcaaatgatcctgtgtgaaatatgcacataatttgcttccctagaggagtttctgctaactggtgtatcttcagttcctcatccaacattttagctttaccattcaactctccagtcactttcttcttcagaaatataaaaatgtcaaagaacagaaagcactttcttcttcagaaatataaaaatgtcaaagaacagaaagcatgtaaaacaacgatgctcaggaactgttaaatgattatttgctaatatggaacaaaaattatcatataattataccattatatctactgtcacgaagagtacattctttaacgccagtttagcagcaaagacttcgccccgagtgcgtcttaactcagtagaacaactgattatttttactatatcccattagtttaactgatttttgtctgtcgagtgcgttataactcagttataactcgagcctttcctatataatatcagtttataggcaatatggcctgagttgcagcatgctactctcatctccatattagcaataacacacttcgggtgcgtctttaactcggtagtacacatgatgaaataaatatgctataacaactgagcttaacaacacacttcaacttaattaagctcagttttatatagtaaagaacagaagcatatatgacgtgcctcaagtgcgtccacttcaacttgtatggctctctcatcgaatgcgtgtgtgtgatacagtgaagtaatttttttttaatttcttctgctgcgcaatctctgcaggtgttcgggttgcacgcatgaggtggatctggacaagccgccggtgctgcaggaggtggagaatttctttatgggtcactgagttggagatttcaccttcagcaaaggcagactggtacatgtagcttctaatttgtgccgtttggtttgtgtagttacattgtgccgaaattagtttaaagggtgatgaattcatgatatctcagcttcagtttggtaattagcttagccgttttggagtaatgttgtcgtgcatggttttgttcagtttgggagtaggtttggctaacacaaactgctgctggtgttttgaggacatcaagcaatgtgtccaccaggaaattttatcatccaaatgtagccagctagctgaatttctcattcaattgtgcagagataga

SEQ ID NO: 48122 - DNA, 1501 bp, Oryza sativa
tatgggtggcgtagttccataagaattgctagctaaaatattttatgtggtttaacgctagtcaataataaaggggggttggggatttgtcccatcaccttatttctcattctgatttacttttatcttacctttttattactattaaacttattgctgtgtgtcttatgacagaagccggagatgtaatccatttccattatctaaaaaaaatgagtttgatggttaagggtcgctgcctcacggccgacaaccttgctaagcgcggctggccgcatgaccttggttgccctctgtgctcatatgagcaagaagactgtgatcatctcttcccaaagtgctcttttaccaatagggtttggtccttgctgagggattggctcaatgtgaattttatctccccccccccaaaggacgacaaggccttccccgccggagtggtggcaactggcgagacgctgttttcagacatgctacatgagtgcttttgacaccttatttatgttggtgagttggctaatttggatggaacgcaatgccagagtttttgaccaaaggagcaagatggccgagcaccttgtggcagatatcaaagaggaagttgcagtttggagagctgcggggtgcgtttcagtgttgtgatgagtagccctagcaatcccggtcttttctctctatctctctctctctcttttacttccatcccgatttctactctccgggggtgttggcccccggctcaatagtttaatgtcgtgtaaaaatctgtaactttccccctttcaatcttaatgaaatttggtcggcccctttgccgactcggcaaaaagatgtggtgcggcaatttcctagttcatctgcatttttttaatcatggatggagttctctgcacatacatacatataggcctcatcattattgttgggtttagtcccacatcagtaattgatgatgggggagcacgacttaaaaaggtgggggcgatcctcacccatcatactagtcttttgagttgtgtaggcccaggatctaaaattgtggctctggttgggcttgtggtggagcaggcccaatgtgacctggggtggcccacggtagatggcccgggctgcgcactttaacaattattagtccacacaaaagatctataattatggcagaaacaacttaacaactttatcaggcctcagaagcagagttccacacaaaaaacaacttaacaactttatcagtcctcattcggttttttctcttttaagtgggcagagtttatattaatagtgttcacatatgtagagttaaaattatcttcactcgttgcaacacgcatgtattttgtgctagtagttctttttttttaaaaaaaaaagtatgtctatattagggatttctgatactcaaatttactttacattttttcttttggcagaggataaaaaggtcggcccaacaagcatggacctttcttagtaggctaaaaatcgcctatgcgctaggccc

SEQ ID NO: 48123 - DNA, 1501 bp, Oryza sativa
aactcaggccatattgcctataaactgatattatataggaaaggctcgagttataactgagttataacgcactcgacagacaaaaatcagttaaactaatgggatatagtaaaaataatcagttgttctactgagttaagacgcactcggggcgaagtctttgctgctaaactggcgttaaagaatgtactcttcgtgacagtagatataatggtataattatatgataatttttgttccatattagcaaataatcatttaacagttcctgagcatcgttgttttacatgctttctgttctttgacatttttatatttctgaagaagaaagtgctttctgttctttgacatttttatatttctgaagaagaaagtgactggagagttgaatggtaaagctaaaatgttggatgaggaactgaagatacaccagttagcagaaactcctctagggaagcaaattatgtgcatatttcacacaggatcatttgcacaaggcccagcttgcgaagccaataatctaatgcggtacccaataataaattcgaggtttagagagcatagacactccaattcgatgtaatcgaagcaaccaaatcaccaaatgccctcatgaaagcaagaacagcggcactgatttcagtattttacccccaaaatcataacacgaatccatgagcacacagtaatccagacccccaaatgcatgaggcccgtcaaatgccacagatcttgagctagccgcagcacaaatcaaccagcacacctccaaagctgagctccaagcctcgagttggagaaagcaagaactgaagagcaggagattgattggttacctgtcggtgaagagcaagccgaggcagaagctcccgctcccgaggcagagcagcacggcccatctcctcgacacccctccatctcctcctcctccttttctccagcttatcaccgccgccgctatgagtaaaacttgttcgtcctcctccgtcttagaatctcacgagcttcacaggagagcaacccatggagaacggatcacgggtcgttcttgagtcttgacttgtattctccaccgtcgacggcccacaccatctccatctgcgccccttaattttccccgatacgaaagccacataaaagatctaagcaatgaccctcttcatgtgcatgacaatgtgaccatgttttccaaatagtaatatccataacaatatgagaaaataattaatacaaaattattgccagcaagagacctaacaagagataagagtaactaagaccctatttagatgggactaaaacttttaagtccttatcacatcggatgtttggatattaattacaaatattaaacgtagactattaatataacacatccataatcttggactaattcacaagacgaatctattaagcctaattaatccagacgaatctattgagcctaattaatccatgattagcctatgtgatgctacagtaaacattctctaaatataga

SEQ ID NO: 48124 - DNA, 1501 bp, Oryza sativa
tgtgtggtgtttacttgctaacacctcctgacagcaacatgccaacgaattgattgctcaacctggattaacagctagccacatatatatatgcaagtaaaaaaaattgtattttatataatgggcgaatcaaatttcaacctatcccttttcatggatttaattttctgtcccttggttaattttgtaggtggtgatattttctttgctagctaggtctcctttttttttgttcgcaattgggtctaggagagttttcacctagaaattcgttagctgaccttttccttgagagaactatattgccatgacatgcgctctaatagaaccctacttgcttccttgaagttccttccctgcaccttaattctcttctagagggaataacccaacagaaattatttctcacacaatcacaagtagggcttcaacattttggatttttcatgagacaaaaaaatgaaagaaaaaattaaagcataatttgaattgcaggggacaaatctgcaagaagttcctgccccaaaatccacacaattcatttctagattgaacatacatataaacccaatttcttctcttttaaagctccaccattgatcggcgatcggacgacgctccaagcccggggagtcccgtggaccagcagggctggacctaccaaaaaactgaccaccggagcaagctagctataggaagtgggggccagtccaaccagaacaaaactcagcttaggaaaggaacatgaggatagctttgttgcaacaccaccaaatcagccttgtggccttgttgcaaccaaactgcagagaatgcagaatgcaactccactgtggtgtgcctgtctttgtagtttgtaccatatgggagtaccaagcagacccagtagattcatgtccctgtcctcctcttctcaagacactgccatgccaagccaagccaaaccaaagcctaccttctcaacctcaccaactcaccttccctttccacacacatggatggcagtggcacccacaccttatattcctaccccattttgattgcttcctcccctcctctcttgatttgaagcccaattcttctccattaatctctcctccctctcacatatacccaaacacacatgcatatatatacatatatatacatgaatgcagctaactagcatatgtgtctgtgtgtgttcatcagtgatcagtagtgttcttgttcttgttcattggcagctggaggttcttgttcatttgccttagctggaagtgattaaatcagtagccattgttgtttagtggcgccattaatcttcagttatcagtttccattccgggagatcaggcggtggtcagctggcacctgcatgcatatgcaggctcattgattgattcgattttgggaagagagttattagtgatcgatcttggctggatcgattgagcttgatcatccggtggtgatatttctggattcttgtatatttgtgaggggtgtgagctgtttgatc

SEQ ID NO: 48125 - DNA, 241 bp, Oryza sativa
acttgtgaattataactgtagcaccccagtttcttggtttctatatgatctccattaattttttgtgcttatattgttgattatgcttccatgtttcattttatcgtgccccatattgtgccatgagttggtttctacatgttctccattaattttatgtgcttatattgttgattatgcttccatgtttcattttatcgtgctgcatgtgctaattccttcgtttttttgcttgtggaat

SEQ ID NO: 48126 - DNA, 1501 bp, Oryza sativa
tggtataacaccagcctccttcatgcggttaaagagcttcatgacagtgtccaaacttccggctttcgagaagcacgaaatcatactcccatatgataccacgtccctcttaatacccttaatttccatggcattccaaaacctcttcgcctcccgcacactgcggaccatgttgcaccagccattgagcacaacgttaaaactcttggtctcgaaagggaactccttctcgctggacagaagcaggtgctccgcatcctggacgttcttgtaccggcaaagcgcggtcaggaggccatggaactctgcgacgccaggccggaaaccaaggttcgggagcgcacggaacgccgcgacggcgccggcgacgtcccgtgcagcgcagtagcgccggatgagaagcatcaccgcggccggagacgcaagcgacgagcggcgcatttggtcgagcagggcgcgtgcgtcgtcgaagcggcggtgcttcgcgaggatggcgagcatggagtggcacgcgtgccgccctggcgcgtaccctggctgcgccgaggcccaccggaacgcggcgtgcgccgcggcgcagctgttgcggaggcggtccagcacggccaccacgaccggctcggacgccgtggcgccgcaccgctccaggaggcccctggcccgcgcggcgtccgcatggaacccctcggccgcgccgacgacggcctccacgtcacgcgcgacgtccggcggcagcttctggaggtccgcgaacgagaaggggtcatcctcctcgccatcaccgccattgccgccgccgccgccgccgccgccattgccgatgccgccctgcgaagtggagagacgcgaaccttcgcgaaagagtagaggaaagctccgcggatcggtgaatccgcgggtggtggcggcggcggcggaggatcgcgggattgctctcgcgaggagactccgcagcatggcgggcggagaggaatcgggtcgcgaacttcgcgattcgtgtgtgtgcgcgacgcgtttccgccttttacgtctggctgttacgccacgagtgtaagcaaagcgtaaactgcattcccgccttggcgtttgcttcgtcttccccgtcgcatttacgctgccgatccgagcgcaagtgcaagtgcaacccaaggtgagcaaaaacgatggacttcctctccaatctccaattctccattgttgcttgcttcaccttccacatcgattgcactagcaagtgacaactactagagtataagaggggtattgtgctagggttttggggtttgggaggaagactaggtagtaggtaaccacgcgtcctagccgtccatggctgggctgtcacctcgcttcttggggcgcacaagcccacccgtcgatgcgatcgccgcccgccgcctagtggcgctcctcctggagcaccaggacaggaggcgccagctcctgcagatccactcccagctcattgcccaccaggtgttcgaccggcgtcccacgccgt

SEQ ID NO: 48127 - DNA, 1501 bp, Oryza sativa
  unsure (1)..(1501): unsure at all n locations
ttgcggctcgcatcgcacccacacccgacccaggcagcggctggttcactgcatctggatggataggcatcatcgatgtccagccagccacgtgcagaatggcagcataaaaaatatttttttcctttttaattttactgacggcgagagggttagaggagatgcacctactctctctcgttggctgcgaagcgaagtgattctgtgataaaaagtgagaaatcgtggtggtgccatgcaagtatgaacggtccatagtttggaggcgaatggaaacgatacccttctgaatttgctgagtgatattcgaagcatatcctcgtgtgtcgatcggtagatggatcgatatggaagctacagttgggcagtacagcctccctgtggaatcagttagagcgatcagtgatgctactagtatgtgacagcctgacagggacacatagaaccatgaatgctacggagattagtaaagggaacacgcggccggcttgcattaagctccttgtgttaaagctgtcagattcttggatatcacgttaggcagcgccgggggattgaaagcatccggtaattggcaactttgaatgcatcgtttcagagacagaccgatcgaagtgatnccgggncccccccaagtgtccgnctcaattgctttcctttcatttcgtgcgcgcgagttttcctcttagcgtaggcccctgcaagtgaaagaaaaatccaagccaagacgccgtccaatactccaattgacaggcaaatgaaatgaatagttctagagaaactaccaaatccacatcctaaaaaccgaattccatatgcgtcgacaacgcaggcaggaatttcctgggcaccgcctgcctacacaacgactggtgactgactgactgcatgcaaggcgcaaccgatgcagagaaagaagcagagcaaaattcgcacgtggtgcagcaggtgaaagcttaagcacgcacgccgggcgattacgacgccggagtccacgaaacaatcgggggcagatatgtgtgtgtgcgcaaaaacagtcaaaaacatcgagttgttgttgtcttggcgatgctgcactgcacgcacagccatccacaagccatgagccggcgcgagattacaatattttttcttcgcggaagatctatctctcgctcgctagcttgtctgtcttttgactcttctgtttccatgaggctttcgccctttgagagaggtcaagctattttctacgcgcgagaaccttcgtcgtagtagccgcgagcgcacatcctcatccggcgaggtccaggaggggacagggccgggcccacctgcagcccacgttccggaggagccacccccatatatagccgcgacctcgtgtccgaggccacgaaccgacttggtcgccacggaagcgcagcatcaacaaaggcagcagcagcagcagcagcagcagcagcgttggtggtggtggtgtgtcatcaccaacattttcacgagaggagaaggatggaaa

SEQ ID NO: 48128 - DNA, 1501 bp, Oryza sativa
gtttctttccaatatttagtccttatcccaggaattctactgagtcccatcaaccaaagcaagcccaggaaccttaacagaattcctctgatcgactagttttcgtactatttcagcatcactaaacctacgaagctcagtaagcatattggatagaaccacaaaatcaccaccaaattctctttctaaggctaatatcttcttcattgtcctctctcccatctcaacttctccatacttactgcaacaacccaacagcgtcctccagacagttgcattgacttccacaggaaaatctcttattatctgctcagcttcacgcaaacgtccagccctacctagcatgtctatgatacacccaaaatgcttgacatctggatttatgttgtattcataaatcatgcttttgaaaaatgcaactccttgctctaccagccctccatggctacaagcatggaggacactcaagaaggttattctgttaggtctgattccagctcttctcatatcggcaaacagttcgactgccttaactgacaacccatgcattgcaaaacctgaaattattgatgtccatgacaccaagttccttctgtccagcatttcatcaaacacccttagcgaattctgaatagacccaatcttggcatacaagtctatgagtgaattgccaacccgaacatcccacacaagaccctccttctcacaatagccatgcaatgcttccccgataagaatctttccaacattagatagtgcaggaacaactgccaacacagttatctcgcttggactaatgccttctgccatcatgcggcggaaaagagcaactgcctcgacagggcgacaagcacgcgtatacccatctatcatcccgctccacgaaacaacattcctacaaggcatccgctcaaagagcagcctcgcatactcaacctcgccccatccagcaaagcctgttatcaccacattccaagaaaccgcgttcttcaccggcatttcctcgaacgccatccgtgaatccgccaggcacccgcacaagatatacacattgacaagggcagtatgcacgtaggtctggaactcgaaccccttccgtacgacaagcccatggagctgcatgcaacaccgcggccaccccaggccagcgcaggccttgagggcaaacgtgaaggcgtacgtgtcgtcggccgcgtgccaccgcgcgtgcctgaagagctgcagggcatcctgcgggtgagggccatgcgagtaggccttgaggagggcgtgccacggcgtgggacgccggtcgaacacctggtgggcaatgagctgggagtggatctgcaggagctggcgcctcctgtcctggtgctccaggaggagcgccactaggcggcgggcggcgatcgcatcgacgggtgggcttgtgcgccccaagaagcgaggtgacagcccagccatggacggctaggacgcgtggttacctactacctagtcttcctcccaaaccccaaaa

SEQ ID NO: 48129 - DNA, 361 bp, Oryza sativa
ccccagtggcggtgaaagaaacaaaccaggacgttcgaacgatacaggagagatgaagatggagcaggtttcgcagaggaaggcgccgctcctggttctagtaatcttgtgtggccttcttcttcttcttcccctggtttcatctgtgcctctgtccagtaagtgattgatgtctccggctgattttcattaattcttgctctgttttaattcagtatgtcgatgatccgtgcttgtggttgattagttgctgatcttgtttgcgtaggaagcgtgtccttgaggaaccaccaagcatcagtctctgctctggaggcgcctgttcaggtatttctttctttgtttctctcacacaggctga

SEQ ID NO: 48130 - DNA, 572 bp, Oryza sativa
ccccgaggggctcctctctcaaatccatcaaccatcacaatgagacaacgattaatcaatccatcactttcccatttgctgctctttggtcaccactattaatgtctttcagccttgccaacgacagtacgacacgagacatgttgatcgctagccatatctgacagtatatcaagctcgtgagtccacagttgaaaatgttactcagctttctgcccactgtcttgtctgcagaggcgacgtcgatcgtgtcgagagctgacgacgaaacgctctgagctgagatttctactgcacaacacccccggaccttaagcgattgcagtgcagtagttaactgttcaacgtcactctctcgctctgcgtcgtttacgccactcagaggagagcgcgatgtgtccggaaatgatcacaaccgaacaaaacattggacatcaagatcgtcagccacacatgcagtacgcaattatggtttatcaaatcggtagcaccactaatagtcaacgatcgatggagacaatgcgttgattgtactaattaatcaggcatgagatattgagctcgtggatctc

SEQ ID NO: 48131 - DNA, 793 bp, Oryza sativa
tacagtgtattttcttgtaagttacagtgtaatttatgaaacttacactgtaacttttgtaagttacactataatttttgaatcttccatgtaaattttaaattttgtattggatttggtctttttcttgaggatatggtaatttattgtctattatggtgtttcttaattgctttttgccttttattatatatatcggattttaatctaaagattaaaaatctgtgtgatacgatcataaaaatctttcgaaagatgtgatgtataggtactcccaatgttaaactggggctcttcctgggccgaactatatggttctacaacagagatcagataaaatctctgagacctgtaacaaacaatccgtaagctttcaggagaacaaaaggatgtgcaacattggatagttgcacatgaaacaatcctaaaataattaacttgcacaaaaaacacacacacaataatttcgatacgaaaaggtagggagtacaacagaaaaccaaaagacttcaagcaattcaacttccgcaacagttacgattttttccccacgttttcctatgaacgcagatgttctaccagtgttcccacccctataatttcatatgctgggagtctggaaccccggatcacccctacccattgcgaagaacaaatgccagctgaagggtgctgagcaacaaacataaactcgcaaaattgtaatgtaaatcaaagatgtaagcatttcaacctcaaatgctttagctagagctgaaaataattcacttgcaccaaaaaaataatttcgaca

SEQ ID NO: 48132 - DNA, 342 bp, Oryza sativa
ttcctgcagccctactcctactgggcacctcgcgccccgcctgcgcgtgcggctcggtagttttctgcccgcctcgcgtcgcgtcgcgttctcgcgtggcgtggtggcgtgacgcgctaggtgggcggggaaaagcgacgtcgaggctgtggagggaggcaaccagccgaaccgatcgagggacgagtggaggggagccgaacgagcgtgcgtgcgtgcggacaaaggccggcgctgaaacggagggcggtgacgcatccaacacggcgggcgcactgaagtaaacgcagtaaataaacggacacggaccaccaccaccaccacgtactcctgtactgcagc

SEQ ID NO: 48133 - DNA, 864 bp, Oryza sativa
atgaaacggagtaattagctaattatggagtaccggatacgttcctttcgacggagataagcggatctgaatctctgtatcaagtgctgtagtagtaccattcagtagcttactaacttcagtttgcacttgcacaacgtgctaatcgagtaaaagcactcattgtcagctgcaaacttggcttccctgctgaaaaacatagctagactagtaaattcctactagcaactagtatagcttagcatgaatgacggccctgttcagttctaaaaaaccttttctcaaaaaatatcacattaaatctttggacacatgcatagaatattaaatatagataaattaaaaaactaattacacagttaaggagaaacatcctaattagtccatgattagccataagtgctgtagtaacccgtatttgctaatgacggattaattaggcttaaaaaattcgtctcgtggtttccaggcgagttatgaaattagttttttcattcgtgtccaaaaaccccttccgatatccggtcaaacgtccgatgtgacacccataaatttttcttttcacgaactaaacatgtccgaagttcaattacccttcttcaaatgaatgcttgttttccttcatctgttctcgggaaaaaaaattcccacctatagttaatctaatacgagatgcgatatattctaatattatgatccagatatacatatgtctagattcgtagtactaaaatatatcgcatactatattagataaacttattttaagattactgatggtttgtcaagggagtgttggcttgtcaattggatgaatcgctgcaggtctaatcattttctttctacaattcgcgcattaacaga

SEQ ID NO: 48134 - DNA, 815 bp, Oryza sativa
gcctgtggatatatgtatactaattagagtttaatgtgtatttttgttacgacttgtagaagtggaattggaatttgcatgtttgttaagtgatatattacatattaacctatcttgtaaaatttttttaaaatattttcataatcatttaggtggcatgtaagaaatgggtggacgtccactcgagagattagaacccatcctccatgtgcagaactgaaggagtagccagaaagaaacttgaaaagctgacagcgaagtacacggatccttttcgcatcggtgagcaaagccgggcccaaatagatgtcctaacaaggtcagtcttgttttatcatgggccagtgtacagtgggccgatatggacggaccgtttcgttgaaaaaggcttgggtttgaacttttaaaccagcaacgcgcgacccggaaagtagctctctcccctccacatgatattcagattattttcagtagctctctcgttgacatgatatccagattttctttttaccttgtaggaaaaggagcaataagattcaggtgtttcaaaaaaaatattttcaaaaaggtgtgttgacttgacctttctttcgttgatctcttgaaaagaacgatttttttttttggaaccaatcggcgcttagatgtgctcatttcattaaatatatagcatgataattttttttatagagctagagctttacatctgagcgaggaaaagaaaacgaaaaataaaaagaaagaaataaagcagctactgcccactggctaattgtttagtcaaggacggctagatacgattgagatgcaacaaa

SEQ ID NO: 48135 - DNA, 393 bp, Oryza sativa
aatgacaattttcttgttgggaccggggacccaccctgtgaggccgccgcgaggggggatctcacccgcgggcgagcggtgtcgagcggggataaaaattgacctactggtgaggtgacccacgaggctctggagttatgagttactccctccgtttcaggttacaagatattttgactttgatcaaaatcaaattgctttaattttaaataagtttgtagagaaaaatagtaacatttttaactcaagacaaatttattatgaaaatatattctgtcgaggagtgatcctctctagcgggtgatcgagagatccctcttttgtgagttcggccgggggaaaggctcgcttgttgagatcgtgtatccgcctggagtgtttcgagatcacaca

SEQ ID NO: 48136 - DNA, 257 bp, Oryza sativa
gatcccttgcgttagttagatggtatttgttgctttataatactacaaactcaggcctcgcaaatagaaagtccggtatgtgggagagagaagttacatatatataatatactatatatactaatcaataatggatgcgacgaagactatttatctgcaagattcttggtgcctttgaggccactactactaggtgactgccaatagtaacatgttagttgagagggacttaagattccagcgtgagctacacctgt

SEQ ID NO: 48137 - DNA, 807 bp, Oryza sativa
ttgcattaccaatatttagaacacattgcattgccatagcagtggaattttccctgtttcgaagtagtgttcttttttcctaatgtagcatatgaatctttagctttattaatatgaatctctgttcatttgcttccatcctgaatctgttctgaacttctgatgcattcattttcatacaattttcttccttgttgacagagtgttgagaagcattgcattccaatactgcattgcgttgcattaccatagcagtggagggaggggggggggggggtagaagttgtactgttgtggggcttggggtactgtactgataaatggtgctagggtggcactgacttggtggcagatttgattcctctctcgaagtacactctcttctcgctacttgaccataccatatgcctcatgttcatgcaggagtagagtggagtaccaatcaatcttttggctataaattgcatcatgtattacccttcacctacctcacatctctttgtgtagttgtacaaggcacgccaaagtccaggctcccaaattaataagcagacatctctttgtgactttgtcagcttccacgccacgctcctgctgcatctcgctgttccttggcttcaaaacaaaggttttgtagtaggagtagtagtgtattcactgaaaaatgtataaatgaaaatgcaatgcatgcttgctttcagttgagctcactctcatggccggtgatgcttttgaggaatctagcaagaggagattaggggtcccatgtatctgcagacagacatcgagatggagcaaatgcagtga

SEQ ID NO: 48138 - DNA, 245 bp, Oryza sativa
gtaaggagttcatactatttgcatgtcgaagcttaaaggttatggtcatacatattttcgttaactacggatgaagatttacaaatagacttcaataattgtttactccttatgtgttggttttgtttcgatgttgtcggattgttatgctctcttgagagaattttgtattaagcggttgtagcttcttttgaagtaaatgccgaaatttttttatattatctgaaaaaaaaaattcctccagc

SEQ ID NO: 48139 - DNA, 319 bp, Oryza sativa
attcctgcagccagataagtgcagaggaggcgtcaaagttgacgtgtgtgggtggattagcatcgttaatgtggtgttgtaattccaaaagataaactaatcacgcatggcatccatggccagctccgtcgctttaggcttttggaatcgatcagagcacagcagctatctcatcgattaagctaattaagctgcttgattgttagtaattttcttccaagtccacacatgccattatcatcctctcctctcctctatatataaggccaaagcccgacccgagctctcccgccattttcctcaaacgatatagctagct

SEQ ID NO: 48140 - DNA, 381 bp, Oryza sativa
atatacgcaagagcgactcctagctaggcaagggggtcccgaccgctgggacctggaatgactgtgtgaagtttgttttccattttttaagaaaagaacatgccctacaatgtaatatgttgaaaactcggattgctggaaggatacttcaattcagagctgggaagtgtttttttagcttcgccctgctcctgtgagaacgtttttgggaccctggtttgtgttattgtgttattgtgagaactcatgatgtatattattttggtttgtccattttttgtgtcattgtttgtgttttttttgttgtgtgccaagttctcaatcttgatgtatgcacatcttcaatatcatatcaatatatcatgcatgccaagcaaaaga

SEQ ID NO: 48141 - DNA, 869 bp, Oryza sativa
tctttcgttaggttaattcaggcttgatgatcttaggtcgattttgcagctttgcgtctgcgttttttggatttctgggagacattcatttccagcgatctctctaatcctaatttcacagctaaacactctcgcagtatgaaactttgtctgatgtttgtgatgaaatgcattgaccgcttctgtgattcgtgattgggctatttgtaatgttcagatggtgaactgtgcatgttgtggttcaaattttcagttcctcgcaaatttcatctggaatttctcttcgaattcgtctgtttcatgtgaaaaagtgatggaatcatggaatgaaaaaggttgttttgccctttttgcaaattttttttttaaaaaaaaggttgttgataactgggcagtctgggctaccacatatgccccaaattaacatgctgtgttcgccggggaggatgtgattgattaagtattagttaatttttttttcaaaagtgatcaatatgattttttttaaacaactttcgtatagaaactttttgtaaaaaacgcaacgcaccgtttagcagtttgaaaagtgtgcacgcggaaaacgagagggggacatgagggatgtaaaatgacttattcattttcacaatgtttcttattgggctagaacgttcggcccaaaagaatactggaggcctatagcgttctctgtaggcggcccacttttgaccggggcccacctgccggaaaccacgaaactgcccgcctcgaaattcgaacgaagccgaaaaaaattgaaaaaagaaaaagatcccccaccgattcattccgaaaccctctccaccgtctccggcgagccctccaccgccgccgccgccgccgcgaga

SEQ ID NO: 48142 - DNA, 275 bp, Oryza sativa
acctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttatctcccagagatggcacgttagtcctagtcagatatatgccaggcttcatcctaaccattacaggcaaga

SEQ ID NO: 48143 - DNA, 861 bp, Oryza sativa
atgtggtggacaagaatgaccgacgtgactggcctgacaccggtcatgtcgtcagcagacagccacgattccacgtcgcatctgctcccggcgaaagtggaggtagttgtgggccgtctcatcagaaggtgactcggacggcaactatacaaatctccgtccatttatgaaaaggtggggtaagtccccacaaaaaagagagaaagggtgcatgtggtatccccttaagatataaaaggaggaccttgcccactgagaggggggactggacttttccagatggggaacccagaacaagggagaggctggctcatactttgtagctccttcatacacagatctcccaaaacacaggagtagggtattacgcttctcagcggcccgaacctgtatacatcacccgtgtcttgtgtgtttcctgtctcgcgagccttccacatacagagagcttagaatctcaccctgagtccccggccgaaccggcaaaggggggcctgcgcggtctcccggtgaggagccccacgctccgtcaagctggttactaaccagccgcttcttataatcttaagcttccctaaccagactctagagcttccattgagcatttagaatgtactgtaattgtagcttggatggacccacatatatggaacggaggacaacacttgcaggcagtggcggagctagggcccgaccatatatgaactgtagttgaatgtgctgtaaaattaaacaaagcaaactaatcgaatggattttaatgctcgattgatattttacacttaattaattacctctctgagatttccgttttaaacagaaaaatgttgagttaaggtcgtcctaatctggtaactaaaa

SEQ ID NO: 48144 - DNA, 693 bp, Oryza sativa
aattattatcgccgattatctgctccacgtctataagaatatgttttctcaacacactttcttatatgtaatagtttggaccaattataatttatttctcaaaatatttaatgaatcaagataattaagtagataatctatagtaataatacggtgattaatatgtctcaattgggccatataatatcagtatgactaattatgggctaggggtgaacacggattgaatattatccgatccattccactccgaatccatccaaattgaagacatggtaaaggtttttagatatccgtgtgatatggatgcaggatgtagatatggagtcaaatgtggtatcggtggtatccaacggatgctgattatctgatagtttaaacgaattatccagtatagagtttggcgcggatagtccgcacatttctcaggctatacaaccactcaatttgaccaattttacatcaggcagcccatctctttgttaacctaatctcctacctctcattctcactctcgtgctcttttttttcaaacggtcaggctgttgccgactttttatataaagaaaaaggtgtcccattttaaggagaaaacgggaccaaaaccttacaatgcacagttaattaggggaaactgcacgaaaaccacaaccacaacactctaactaacctaagctaacaagaccgtaaaaa

SEQ ID NO: 48145 - DNA, 866 bp, Oryza sativa
ccatgtcattctttttttccttttgagtgtggttttgtatgttcggttgtgtgcatcttagttacgcagagactgaaagtgttctcaagataattgtatcaccttaatgtaattgactgagttcaatcaaagcttccattatctaaaaaataccgtaagtacgtcccccataggcaccaatcaaaatgttaatcttcgtgatatttttattatttttggaaattttaatattaaaagtgaaatttatgttttcaaatgttaaattttgcaatatatttatatttcatttataataatattagtgttgaatatgtgcaaaccaaaaactctaagacactatataaatcaaagtagatcatactgaaaaatactgacagtttctttcactgtttgcgacaacattgatgagtcacctattttccatccagctggtcaaatttgttataaatgacaccaatttttattaattcagttattccaatgtaccccaaaattgtttctctgattatcattgcaaagatgcacgagatggagtaggacattgagccaaggtcacctgtgtcttcctcagattggatgttattttctaatctatatattttcattgtgttgctattgaattattttcgatttttattgtaagtatacgtggttgttgaagcatgtgcttcatccaaataggaatcctagttgcccccacctctcttcccccgccaaacacggggaggagaggtggagcaagggaagcttggcggagttgtttaggagggcgacgtcaccaacgtagacgaggagtatgagaagggagagaggttgagagtgtgtggtcggtgagtcttacctcgctggcggcgatgctggtgaca

SEQ ID NO: 48146 - DNA, 423 bp, Oryza sativa
tcactttcccaactcactttctttggtttccacactcacatttttcaaattgctaaacgatgtactttttgcaatttatttttttttacggaagttgctttagaaaattctattaatttatttttaaaaaataactaatacttaattaatcatgcgctaataatttactctatttttctattttttttaatgtgcgcgagatattagtttcgaacgaactcagcctaaacagctcggtaaagcaacatgggcgacgttagcaacaacctagtttgcccacctgggcataaagttggcaaacaaccaaacttggcctaatacttttcaccttattcaactgccattttattttacaaaattgcatatataaaaataatttggaagatgccggcggtactcaaaatgtcacgtggctcgtcgaca

SEQ ID NO: 48147 - DNA, 1501 bp, Oryza sativa
tccatgtatttcttcttcctctttagagctaaatgttaggcatgcatttcattttcaaggttgcaaatcatgggaagttcacacttacttggaaaaccaggagtgcaggtcacagaattcagaatttgaaatagaagaaatttgtggctgtgattcaccaaggatggggtagttgagccaaatcatctctgtgcaggggtcaaaactcaaaaactggtccataatttccatagcagaacagatttctacttacacatcgctttctgagaagtgaatctttgtcaagaccacacaggctgccaagaaacatgtcatgatccaagaatccctgcaagaaaagtaacaactcttgaaaaagagatcctggaatatgctttgtgagctcaagtcttaaaaatttatcttctgcaggcaggagagaaaaaaagagagcataatatataaaaacttgagctgttgctgaagcagtgaagctgtagtccaggagttgaccagctagcacgtcgtgctattctgatcaactgatgagcttcagcttccagtctggaagaaacaagtggagctttaccttccatgggataaatcttgcagtgttgctttgcttcaggtagcttcagatgcagcatccagacatttcaggcttgcagcaacaagagatcactgtgtcgatatgcaaatgaaagctaggcattgctacaagcaaaacaagtactaccatgacgagggtccagtgatttagggtcatcaagctgaatggctgacagcaaacaatcacttcctgacatccctgacgaaatgttgggtgaaaaataattggctacaccaccataaatggttattattacgtaattcctccgtttcataatataaataattctaacattttccatattcatattgatattaatgaatctaaacatatatattcattaacatcaatataaatatgagaaatgctagaatgacttacattgtgaaacggagggagtattatatactagtaatgtataaacgagttaaacaatcttattgtaaagttaagggatgacagatgatcttattctcgaggctttcggtctacctgcggcccatctgtgttgagccggtaaagtgttgtaactcgcctgcggcccaagaatgagattgagaaatggagaaaacgtagtgggccgtccacaagctacggcccactaaaaagtagtgggccaacaaaaagacggcgagcggctcatccccgacaaggcgacaacctctccgacgacacggcggcgcctccactcctccctccggcgaactccgccgccgccgccggcgcgacggcagtacggcctcaccgcatgctcccccgcttccccgtctcgctcctccggtctcgcagcctgctgcgaggcagcgcccgccgcggcctcgtcactgcgatggccggagcccgcggcggcggcggcggcggcggggaggatggccagctcggggagttctatgagtacatggagcggctgcg

SEQ ID NO: 48148 - DNA, 877 bp, Oryza sativa
ataggtttgacataaggcagttcccagaagaacaagtttctaagagttagcaatatttctaggcctcatttggagagtaggatgtctgtatttccaaagtcggttctaactattgattttgttctcttttattgagatctagcactaatcaaaagtaggcctctagggtttaaaactgattattgaattcaactttatagcatttgcacctactgtgacaaattattggctcttctttctattggttgcctaggcaggcctcggtggagctagagatgccacaaacgtcatacaaagtactgaattagctgcatctgtcataacaacagtagggaaagaacatttggctgctttgggtggttctttacaaagtatagcagtggcaaagtctggaatcatcaagcaggagcgaccagttatgttgttctctcatctttggccctttccatgttcatcatgattaatttgctcttgcttgtaattccagcttatattctgattgagtgattaattttgtattgcttttctcttatcatattttgattactgtcttctatgttaattttgtacttgttatcaaactattttaccagacaaatcctgtttttcttctaagtgtaagttctatatgtgaagcttcattcctcagaggcatgagcatgaccagcatggctaaaatattctcattgcaagcacttctcacatgtgccacttctagcaagagtttatgtgattaaatttgttgagttgtttgcaatgttatttacatatcaagtgatgctgctgcattgtgttcagaccaatgtcaccacagttccaggttacctgtatggttcctgacatggagtttgctgtctgcataccaaatattttcagg

SEQ ID NO: 48149 - DNA, 253 bp, Oryza sativa
ctaggcaaccaatagaaagaagagccaataatttgtcacagtaggtgcaaatgctataaagttgaattcaataatcagttttaaaccctagaggcctacttttgattagtgctagatctcaataaaagagaacaaaatcaatagttagaaccgactttggaaatacagacatcctactctccaaatgaggcctagaaatattgctaactcttagaaacttgttcttctgggaactgccttatgtcaaacctat

SEQ ID NO: 48150 - DNA, 305 bp, Oryza sativa
ctttggctctggttgttggaatggccaatgacaaagaacacttggcctttgctgacagcttctgtcaggcaagatttttcccactctaaacatttcaaatccacacgcatcggatcaattggcttattatttgattttaagcacaaattcatgaatgccgtctcatgaagaccttagggatactatcatcccatcaatccatgtcattcttcgccatacaaaaaaccatttcccttcatttggggcgagaattgcaatcaaatctttttgtttgcttataaggcacgttttttttttgttacagg

SEQ ID NO: 48151 - DNA, 225 bp, Oryza sativa
ttttgaaccttttggaaacaacactaacaccagcagaaaagacctgaccaaataacggtgtcatactagccagaccgacgtaacagtgttgttttaccacgaggcgtagccaaaagattcagatcaagttttgaatgagtttatttttaaaattaaaaattcaaaaaaaaaataaaaaaaaactccagcctcacacatttcacacgctgctgttctgtcctcagc

SEQ ID NO: 48152 - DNA, 954 bp, Oryza sativa
ttttgaaccttttggaaacaacactaacaccagcagaaaagacctgaccaaataacggtgtcatactagccagaccgacgtaacagtgttgttttaccacgaggcgtagccaaaagattcagatcaagttttgaatgagtttatttttaaaattaaaaattcaaaaaaaaaataaaaaaaaactccagcctcacacatttcacacgctgctgttctgtcctcagcttcaggtccaaacgaagagaaggaagagagattttttccagggcaaggcaccgacagcaacctgtcaaagcaaacaagattccagcaccaacaaagcatcagctgtaccacaaaacaatgggcatcaggagcagtatttctccaaaccacacaacgtgccatatacaaacacggcgtttcactcacgctataattcttgcacccatcacatgcaaatgctaatgacactacgacagtaggaatgaatgacccggctccaacagttggatgatagtaagatagtaaagtaaagtagagaaaagaaaaccaccctctcaaccattgtgggagagttgaccatgtccctatattttacaatgattgacacagttttgaccgagttatgtattctatattatattataattatgctattaagatcttttcgggtttgtattatgttcaaactctttaagtttaaccaaatttatagaaaataaaataacatttgcaataccaaattagtttcattaaatccactattaaatatatttcatagtatatttgttttgttggaaatactattatattattcaacaaacttgcttgacttgagaaaaaaatataacaccttataacagagggagtacatagtaagatagctggttttaatatatagatcaaaataccctcattaatatctcaatcacaggaaacatggtaggcaaacctggttagacaagtaagatg

SEQ ID NO: 48153 - DNA, 1501 bp, Oryza sativa
cttccatattttctatacaaagactaatcgaaccattatcttaaaagaaagactaatcgaatttgaatattcatggatgcaaatatgaatcaaatgcaggaacagattgatatgaattttgaacggatatagtttaattagatcagtcagatcattgcttgaaaatattggtgagacgctatatatcatgattctgcaactcttctttcacatgtcgcaacactctatgttcaggatgccctgctaatatatccaattgagaaccaaccatcaaagtacaccctgccaaaccataccaaaagggaaacactaatccaaaagccatcacaaaatatagtaggcgattagcctagttagatccttgctcaaataactcttacaccgtcaacccacaaatataaatatttctagaatttttttaaagtagaaattaagttcgaggagaaaatactttcggccctaattaaagaagggatggaaaggggtaggagggggcgagggctaagatgacaagaaatttgagtaagagatgatggataagagacgtagtactctaatatggttttatttacagacaaaatgtaaatgcttggaatgcttatatctgtggatagaagtaggaagtaactatacaatggcagcacacccatcataaaagttgtttgagcatttgagatgtgcaagctattcacatcacatccctgtcaccatcccatcccatgtgttcctttgctttgcaattgtctcatgcatgaaatgaacacaacactcacattcacacacatagaaaggaggagtatgaagaatatcaagctgataagtgtctcatttattaaggtccttttctcctctttttccttgatggaagaatgatttcagcaaggaatgatgctttaaactcctgccaagggtagacatagggtgcgttttcgtttgatggacaaaggagagaaaaatacctcattttctacatgcatgcttttcaatgctaaacatgtgttttttaaaaaaacaaaaaatacaaatagctttaaaagaattatattaatctatttttaaatttaaaataattattccctctgtccctagatatttgacgccgttgactcttttaaatatgtttgaccgttcgtcttattcaaaaaatttttttaagtacttattaattattttcctatcatttgattcattgttaaatatactagtactaaagtttttgaataatgttcacaaaattttttaataagatgaacggtcaaaaatatttaaaaaagtcaacagcgtcaaatatttaatgatagagaaaaaacatttaattaatcatacgctaatgactcattaattatgcatgccttcttggtcttctcttttttttttcccctcgcaaacacaacccaggagctgccgctaacacaattccaaggatcaaaggagctttggaattccaaagcctggtcctgtgggccccaccccaaaccccccatccctccatccttccaga

SEQ ID NO: 48154 - DNA, 422 bp, Oryza sativa
tgcagtattcgacgtcagttcctcaaaatggtcctgttaggtgttcactaatctcagttatactgattgctggacttcaccctactgtacaactcatcaagtgacttacctgatgttcacccttagattttcatataccttactgttctttacaaaatctaattgcagtccgagtgagcaactgggcaagtactgagaaccccaagtgacatttagaagatctattcattcatatgaaatgtcactgcttagtagattcttctacaagaggcctcctgatggattactggagtttattgatagggtctatggtgagcctccaaattttgtaacacggtcacattgtccttttacgtgccatttgaactgattttgctctttgttacattgcacagtttttgattcatgcttctgcacagaag

SEQ ID NO: 48155 - DNA, 227 bp, Oryza sativa
aatctttgaaaatgtgtctggttgagaaaaaaataataactgtgtattaaattagaaaatcctttagctggataaggggcggatgtagccaagtgatacttccccgttctattgctatcgcgggtcttatgcaatcgatcagatcatagagataagaaaggatgagtgtatcgctaacaagaaaagatctcatgatagtcaatatgggccctcaccacccatcaacc

SEQ ID NO: 48156 - DNA, 1501 bp, Oryza sativa
taaattaatgggaggaatatcttggaagaaatataaagacattgatgaagcattaagccaggctagaaaaatactaggaataaattattatctagagcctgctgcaaaagaatatattcaaaaatgcaaaaaagctaaaggaaagaagactccagaaatacccattaaaacgactataaaagaagaagggtattctaaaaaacccacatacaaggaatgcctaacaaaaggagtggatccattagatggggaatatattgattggaaaataatagaaaaatttgaagaagcctccccacaattaaagaaggaattaaaggaggaaatacttaaagaattaaaacaagagatggatcagaaatttgaacaaataaaaaaggcagtagatgagaaattagaagtttctttttctgatctggacactatagatcttggtggtcatgggcagccagatgaatagaattctttaagctaaatatgtttctcaatatatattgataatagaatatcaataatttgggcgtggaagaagaataaacgaagatttcagaagactactcaagaaggaatccagaagaaggaatccagaaggacaccctataagcataaaggaacaatatagggtgcggtgaatgacatatccctgtgaagaataaaactttcggcaggaaaggcctcaactttagcctgctctcgtgaatccacagtagcgaagagataagcaggaggcacaggcgacgccacccctgacctctataaaaggaggggcctgcccagctgaggaagacaacaacgaagacaccattcagagcaaagcttccaagcgcgctctcaccctccattccaccgttcttagtagtagtgactttagcctaccttgcatagtatattgaagcaaggagttgtgttataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatctttttaagttgcttctaaaaagacagataggtgaggcatacggtgagtaccgagtaggactttacatcatctgaagcaagcttctgaggctgtctaaataggattcgccaccctgcaaagatcctaaagttaaaatatctctgaaagtgaacagtattgaacagtaatttaaacagtaaactgaatagtgtttttgaatagtaatcagccgaataaacagtaaactgaatagtattcagccgaataaatagtgtttttgaacagtgtatattgtctgaagtagt

SEQ ID NO: 48157 - DNA, 1501 bp, Oryza sativa
ttgtgtactattgtctttattataccgaagttataatgttcttgaatagggcatacgcagattgaggatttattttcattgagtaacaatatttttattgtacttttgtccacgcataggggagtgtggagttgctattgtgaaattattcaaatccagattagtattacataaggattttacctattcttgatatgtcatgcctaaaattgtaaggaaattgtattgaagagcttccctgtgcagagctcattggtgctggagtttgagcgatggttcttttgctctttgagatgtatgttgccttcgctgctgcaagctaatttttttcttccaaccacaatgataaagaaatagcaatttaattattatgtttttttgtcacttggttttagtgccatctatgaacatatgtctctcttcctccaactctccatggaatcaaactcctcacctgctagccacagctcaaagctggtgcattggttttctccctggtagaaaatacataattttcttattgcattttgttgtttgttgaccactgactaacatctccattgctgccgagaacaacatctaaggtttgcatgtgtactcgcaattcatccttgaaaatgtcttgatcagaagtctggtgtgcatactttcttgcggtatactgatcttaggaatttgattagagttttgatgcatgaaagtaaaagtgagatgaaggtttatgcatgaatatatttggtcatcttaatttgttttcagcattgttaatatgtatgtatgctgtcattttctcctgagaaaaactcgcatagtctcggtcgccatgtatcaagtatagatatatggtttttttttccaacagaagttttgcgtacattttgttcagtgcagttttcttatattctagctacttcttgcatgtacatcttattagcttggtttccctttagcacttgaactgtaattcagtaagaaaataatgccttgatagttattctcttttacttgcagtttcccttctagctgaaattgtgcaaagtttgatcattaattgtttgcattaaaatggtagcaatatcgcattgtataaattgtgcttgacccactaaatacgtttagctttcttggtaaggaagtagtgattcgacagagtccaaattgtcagcttagtatagtctatatgaaattgtcttagtaccataagaatttatgtggagtgcattgcatagaaatgattgcatagattcttctttgtttgctaatatatactgtcaaaacatgtcttgcatgttgtcacgtccagaaattcacgaaccggaatttctaagctgaatgtgcattaaacccctatccgggaccagccatggtacacaaacgataattgctgacacacagatccacgtcttacaaaaataggaaagattacaaatgcagcggaaaagataaaacgagctagacttaaaagcttgactcctgcagcgaggcgactctactccacagg

SEQ ID NO: 48158 - DNA, 557 bp, Oryza sativa
gtcccctgtgtcgggcgagtgacggcgctgagcctcactgaaggacaagctgtgatttagtttccgggcgaaggcgcgaaccaagttttggtcaagatagggtgggtccccatcctaaagaagagtaggtaggagtggtgcatgtggtatccccttgagatataaaaggaggaccttgcccaccgaatggggggttggttgattcgaactccggccacttggttccagagcctgaactctctctcgctctcgagctctctgtaactccttcatacacagatccaccaaaacacaggagtagggcattacgcttctcagcggcctgaacctgtctacgtcgcccgtgtcttgcgcgattcttctcgctgacatcctcagatcgacgagggcgaagaacctcacttagcgccccggtcgaaccggcaaaggggggcatgcgcggtctcccggtgaggagccccaagctccgtcatcaagcgcgccaggtagagggcgcgcgtgtcattcgaagccctcgtcctctttcgtgtgcgccaagcttctcccgctcagcccaa

SEQ ID NO: 48159 - DNA, 1501 bp, Oryza sativa
tcgtcggcgaggggggtgtagaaccaatcgcacttccagtcgtcccacttcttggggaggacgcagggaatgtagcgttgcagcacctgcccccgcggttggaagtagcagccaccgactaccgtcggcggcgacaccggctgtacggtgaagaaccaccggaacagctggagagatgggcgcaccccgatgaacatctcgcacaggtgcgcgaagatggccaacgtcattatcgcgttgggggtgaggtgcgccatctggagatcataaaactccagaacatccatgaagaaattagagaatggcgggaccagccccgccattgcgaaagagaggaagaagacggaccgccccgggtagtgtggcgccgggcgtccctcgcccagctcgaccacctcccggccggtggcagattccggcatgaattggcgcggcagcccggcctgcctctcgctcacgatgcaggaaggcggcagcacgctaccgtcaagcagtgcggagccccgtgccatgacgccggcggaggaggagcttgagagcgagtgagtgcggcaagggtagggcacaggaaacgaagagttagagctcaaatggcggaggcaaggggaagaatggcgagaggaaggaaacgaatctcttcctcggcgtctttatacccttgccaacgctattcccggctcctcgtttcccgcgcctactacctcgccccctcgtttctcgcgcccacgcctccactaacccaactcgtccgtttgcggcgcacgaggcagatgtgcggccgtagcagttgagatgggacagatcgtgcacgcattaatcgcgctcgccaaacgcgaagatcgccatcatcatgtctccaggcgaaacgaaccggctcgtcccgattcgcgcgctgctcgagtaatgtagcggtcttgaagagaccacttattattgtcgatcggttttcccttgccgatgtgcgcgatttgcgaccgctgggtttctgcccgcctgaagagaccggccccacctgtcaccagacctaaggagtggcgtcacgaccgagcgtttccctccaggggggcgatcgccctggcgtaacgccgggggctactgtcggtgacatgggaccgggggtatcatgactagaggattgggcagccgcggtcacccacgtggcccgaccccctcgggggggtcgggcccgagagtgacgtggccacccctccctctgtctccccgaggggtcgggccgctcccgtttcggccccgagggctggggcgccccgaccccctgtgggattggcaccacgtgtgtgggttaggtgagcacagcggcgctcacctaaccgcatttactgcgggttggacgagcgcgccacgccgcatttaatgcggcgcagcgcacgcttatccggtccgtgaccggtcgcagtgtgtgaccggtcacagaccggtcagatcgcgggttaggtggcaacaggcggcctgtcacacgcctcgccccgtcccgtcggaa

SEQ ID NO: 48160 - DNA, 1501 bp, Oryza sativa
acgatctcatccacggcgaccttgttcctcgtaatggccttcttctttgtaggggtggtcttctcctccgttgtcggttccgtaaccttgtgcagggtcttctcggcaggggatggaagcttcttccaggatgagatcttgccgccgctgcccggggaatcgccgccggtgtctgacgaaatgacacggcccgccgagaagtcgagggtgagttgcttgtgctccagcatcctccgcctgatgagcctctccttgagctcggtcaagctggaggtgctcttgcggccgagctcgctggagccgccggcgaccttgaaggggtagaggccgaggtcgctgagctggtgcaggctgaggacgtgctgcttgtcgtcggcggcgacgtatccgccgccttccttgcggaactggaggaggcgggtgcagcgcgtgaggatgaagaggacgcgggtgtgcgcctgcttgaggacgccggcggtgagctcctggcggcggtcgtcgaggccctggacgatgcactcgcacttgacccagagctcctcggggctcatctcggcgcaccgctgcgcgacgacgagcaggtcctcgagcgcgacgcgctcctcgtccccgtcggccttgtcgagcgcgccgacgaggtccccggcgaacaccccgagctcggcgtcgacctcctccttgagcctgatgaactttgtcctgatggcgccgatgaactcctccgggctgttcacgcacccgcgcggcttccgctgctgcagcgggtggaggagcggcccgcgaatgttgagctcgtgcgagaagctcttcacgtcgggcgcccgcttccgccgcccgctcgtcgcccgcaggatcgccctgaaccgcggcgagtccatctccctcccgctcgcatccagcatcaaccgccgcgccaacccaccgccgccgccgccgctgtccttctgctgcaccaaacaaaaccacccggcgttacatcgaacacctcatctgcatccaccaccaaccccgcgatcgcaaacacccaacacccatctcgtcaccttacctccatgatcgatcgcgatgcgacgcctccgagacgcccaagaagaagcaaatcaaaatcaaaatcaaatcaaatcaaacccgcggggggcttcgtctcgcgcacgtcgccgccgtgttcttcgcactaaaatagcaaacgccccatgcaaaaatgtggcgcactagtggcgatccgatcaaaaacaaaaaaaaaaaacgaaaaagaaaaataatttaacgaatttacagtctccccctccgcttcccgggtaattgcgactggcacgtgggccccacaaaccggtaaacggtcgagcggtttaacgtgttcctcgccgaggaatccgggtgggcccgcgaacccgtcatggtatatatggggttcggtcgcgcaaccgctttcccacctctctctctcgcatcctatctcggccgtcggttttccgccgcacgaatctcgaggagggaggga

SEQ ID NO: 48161 - DNA, 1501 bp, Oryza sativa
cccggctgtacagaactaatctccaaaccaggagctaagcaaattattaccaggtataacatccataattattgtgggaggtgtgggactaatcatgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaatcatgctatacaaaaaggtaaagccgttgcccacgctggcttgtggttgtcacggttaatgtttcacaacagtagctcgcgaaccggtccttaattgtcatgagcacgactctcaaaaccatgtgctcacaacccaccattatcaagttttagttggcaagtaatttattaaccaatcacgattgaccatcgtgagctaccattaaaccatcattaaataataatgaatcataagttatcccaatagtgtgctaatgtttctaagcatggctaagcaatcacatctaatatctagctgaaccaatatataaagctcaactagtcaaattataataacccaaggtatcaaggattaaagtaatcaatgcaaacaggccataacaaaagaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccgacgcactcgcgaaccttcgcaacgacggaaacgacaagctaacacgcaaaacaaggaaaagactaataaaaaccaaataaacaatacataaaaagtaaacaaacatgtagatcatatttttggatgaattatgagacttgaacggcctcattctgacttcaaatgaatttattatgaattttacaagattaaatctatttaaagcccatttaaaaagaattaaataaatttaattcaatttatggacaattttaatatgtagatctttattttacacaacttttgcaacttgaaccacattaaactgagttcaaatgaattagttatgaatttttaaggattaaatcggattaaaacctttaaattgattttaattgaattatgacgcaataatgaattatttttgaaaaggaaaagaaggattattgcgtcagcgggctagggtttcggtggaccgggcgcacggcggcggttcacgggaacggacggccgagatcgatccatccaaaacggacggccgagatcgaacggtccacgaccggctcacgggagacggggacga

SEQ ID NO: 48162 - DNA, 1501 bp, Oryza sativa
aaacattaaccgtgacaaccacaagccagcgtgggcaacggctttacctttttgtatagcatgattcattgcggagcaccagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcatgattagtcccacacctcccacaataattatggatgttatacctggtaataatttgcttagctcctggtttggagattagttctgtacagccgggtatggttgttcaggatggttgggcctgtgcagcatgggtgtgctgttcagtgttgattaaaatttctgattaattactccactgttttacttctcttaaatgttttgctaaatgctgcttttgcaagtgagcctatattatgccatcctttggtatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgtgggagtggagccggagcttcgctagattttattttccgctgcagttttcttcatgttgaggactaagtgcctcttaagtaagtatttattcgctttagttattgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaattttcctttcttccttctctagaattctctataaatcattttatcatcctcttccctcctgctttcaacttgagtagttctgaaactagttgttgaaactagaagatgttgatgtggtcaacttatggaggccagtcaagtggatcgaggaaggaccgaagtgccaagtgtcaagaaggaatgaagtttgcatcctaccttagaaccctatgccgccaaagtgtctttgaagaatagttagtaggatagaacgtttgttgcttgcttgtgtgtaggtatggttgcattcccatcattggagtagttcagtgatgagcatgtaattatactaggttgcttgcttaatcaacttgaacaatataatggtctacacacaccagatcagtgataacctagttaaggtcttgtctttagtgtaacccctctccttctatcttctctaatttgcaataga

SEQ ID NO: 48163 - DNA, 1036 bp, Oryza sativa
acaagaattaggatggactatatataaatagttcttttgaaattatgaataaacatattttatccacataactaaacaaaagaaatatttaacatgtagtagatgctatcaatattaatatcccgtgcagcgcacgggtcgacggctagtatataagaatcagtcatacatcaatccatctttatcactgtcgtttttttccagaacgtaaagacgatgaaaagtggcactggggcagtgatcaatagttacaccggataagtatcacgctgtccaaaatgacattgtgttcttactatgaatattcatattctctatgtgtttaaattcatgacactgttaactttattaattaagtgaaacttcaaaacttttaccatcaataactcttaaaataactttattccttccaatcccataggatacaatgaactaattactatacttgagatatacctattttttatataatttagtaacatttcctaataccacatatactaaagacatcaaattttataatagaaattttctatgcacccaggtacctctcaaagacagcaagatcatcctgactaaaaacagtagaaaagtatacatgaatcaatctgtatcactgtcaacttttctataacctaaagaaaaggaaaagtgacaatgatcaatggttacaccggataagaccaagttgcatgcgaatttttatcattattaattaatcacatattcacccatggaaacatttaagtcgaaactatatgacactattatgtattatcctactaatcatacgttgagagtatttttcatatttataaaaatgaaaaatatatatttcaaaataattatttgtaatattttttctactgtccaaatgcgtgagaaatcacatttgggaacataaccttttatatgaaaatattgggaactacactagacctcctttttaaaaaagcagccttttatgtaaacttattgtttgaacatctacttcccatgaaagaatttatgtgtttttttatactttttctttagt

SEQ ID NO: 48164 - DNA, 155 bp, Oryza sativa
tgaagaaatttcagggttgttctcagggggaatttttccttcttttttgagctaatattgattgttcacttcaccgatagtccgatttgcctttgttttaagcatattcttttgtgcaaattttggtaattctttaatatgtgatgataatattg

SEQ ID NO: 48165 - DNA, 1501 bp, Oryza sativa
cttccattgtaaggtggtgtacgagtcatggaatatacgaatacgctataccttcatatgtacaataaagctccatatacgataagaaaatcgataagagattatggaaataatttttacggcaagtacatagcagtgtactactcgaaaaaggattgagacggtaccatatcgtgcaacattcacatggatgatagaacactttcagaagcataagaacttaacatttgccttctacatcactacgttcagtcaaaaatttatgaacattgctgcgtatttcatggaagcttagcaagtaggtagtgattcgattttggcacaataaacaacctttttgttcctacgctaaggcaaatgcaagaagaaaaacaacacctttgtccgacccgtcctcctgctccaggcaccagagcacgaggcggccgtgggcatcggcctgcatgagaagaggcgccaccgcgccaccatgtcgaacaccccggcggtctccacggtgtggagcacccggagcctccgggacgcgtcctcaaaggatcctttatttttgagatctttcagatatgattcatatcagcgtgtcctgtctagtattgtggctaccgagaactaaacgcctacaatcgcatcttcctagggactgatgtagagaaaactcctattggccgaagccggtattgctcttattcatcataatcatggtggagcaggcagagtcattttacatgcatattaattcatatgattagtaaacgaagagcaaaccaggaaatcgatggcataaaaatctgaatccatgatcctacctggccaccgccatcgcgcgaatggaggatggctctctccccaaccgtcgtcttctcctcttcttcttcggccgccaccgtcggcgcagatctgggtagctcccaccccatctgccgcccatgttgtccgtagcgttttcctggcggtgacctccagattcctcttttctcctctggtctaagtctctaagaggattaccaagatattaacaataattcaacaggtaagtatcacaggaaggagcagtatctgccatgttaatgttggccatcagatcagaggagtgctagtagcctagtataagacgagaactgcagtactcccagctcctgttataacacaaatgccagtttccatcagaaatactaacatcaacaaaatgttagcatatgaacaggaaaaaataatggctactacagtacagtaacaacctacctagttcagcaactaataaagtgtcaagcttaaaagaacttttttggctttttgagaaaaggtgttcaccacttcaccaccaaaccaaacaggagtggtctggcaggctagtaaacagtgcaaaggtaaaagacctcgtgaagaaaaattgaattattccaatcagatctcgttgccatggagagaaaaattggtaacaggggaataaatttagatatatatatatcaagtgatcaaaaatcctgaattacatgagagc

SEQ ID NO: 48166 - DNA, 1501 bp, Oryza sativa
cgattgtgtgtgtgtgtgagagagatgcgcaaccaatttggattaagaggacgaattgaagaagatatgttttgtgcagtaataaattaaaatgagaaggtaaaagtactggaggaccaagaaactagggaaccatcaagactactcatccatccacataaataattatctatcacatagtcacaatgtacttatattttgcattaacccttctccttccttttctattccctcttctttttccggtgcttcggtcttctttgtcggtatccgatctgaccgaacactgagtttggaaaatttgacccagtaacctatcacaggtccaggaaacagaactaagcccatcagctatatactccccaccctattccatcctaatcctagcctccaacattagcagctcatgcatcagcacgcccccatgtgcccgtgtggccacttttaccaccgcatgccagtcgccgctactgcaccggattaagctcctttagcgtaacttccactaatttggtggccacatattttctcatcaccaaattattagagtagcagcaaaaaggctaatatactagtacatataatggtaaccacaaaaattaaatacagagagaaagaaaatacaaaaaaaaattgaatagaggacaaaaaggacatatgagcactctacctttaccaaagcacatttcacacgctcaaaaaaactccaaacttaagccttctctatcctgaaattaaaccatttcatacaatcatacttactatactatactataccaaaatataactcatatatataggaaaaccagggtaaaatcaaaagctaatcccaatataagtaacttccactaatttggtggctgtcttgggtccacatgtcaggcacggtgaacagtgacatcagaagatcctctcccgctgcaccacctctgccttcaccatgcttcccaccccccaccccacatcctcctagcagtcgtcaccgtctcctatcccaacagaggtggttgatgctgccaaggtcatgccaaatctggctggaggtgtcacctggtgaatttcctcccacgacgaagtttgctgaggcgaagttttggaggatgtggttgaaatcagcagcgagcttctcccggacagaggatgcagctcagcaccacgaaagtttcctatagctcatacatattttttctagtgtccatcagctgtgtcacgttttttgcggtgtctcacagccaattacacgtttttttgagtgtcatgtagtaaattttgccaattgaacttcataatgtcccgtaacatcagccccgaccggcctacatcaacacagatccaacggcctttcaacctcaagcacgggtcttaacacaaatccaatgcacaaaaatctgactgaaatctagtactaactagaaatatgacgacacaattagggtgtgtttggataatgagaaatgagggttgagattgggattggaaaataaatgaagggcttggatta

SEQ ID NO: 48167 - DNA, 1501 bp, Oryza sativa
cccgacccctcggggagacagagggaggggtggccacgtcaccctcgggcccgacccccccgaggggttcgggccacgtgggtgaccgcggctgcccaatccgctagtcatgataccccggttccatgtcaccgacaacagtagctagctctttcgaataacccttatgattacatacttatctttccttcctctcagatatagcttgaatcactattcaagtatatgtgtaatatacaaaatcacaaataaaacattgaaatagagtaaacacatctaatattgctattgctagtgttaggattattaggagagggcagtggaaaaataactttgcaaaactactccgatactttttagtttggtcttacctattcttgcagaaaagatatattctagacgatgttgcttcaaactccttcaagttttgctaaattctatgtgttcaaagcatttgtttacatatcctgaggtatcaaactagtcatccaccacagtttgatgcataatccattttacttaagttacgatttgggtcttacaccttatccctcacacatgattttcctttccttttttgcaagacctatgggcatggtttacccatatgtgtgatgcacgcaatgtatattaattatagccctttaatgtaatttcaatgctaatttgtctgtttatgttcttagtctcttaatttttacatagtttatcgagttttcaggtgacctttactatttattgttttattattttgttcgtaccctcaattttattaagattggtaacgaatctattgcctaggataatggtgttggtcctggagaggatctggaacaatttatcctaaaaattccccatgacaaattccatatgcatagcttaagtttattatcgaggaaaaaaacttgtaagttcatatttttccaaatgtattataccgttagtgttacccctgtatatctgttatatttttgttctgagaaggttgtttttgttgatttaatgcgtgcattttttttctgagctgatttgggaactaaactatgtaatttgtgcctcaagaaaaaagataacctatcaaataaacgccatcctccactgggtaaacaagtaaacaactggataagcatataaagcatatgggttcagtatgtcaccacaaccggtaagttttctcccttgctacaatactactattgcctgttacgtaattatgcatctctatcttatctgatgactacatacccattggttatcacatttcgtaagcaaattaactcaagaaaactttaaaagggttgttgtaaaagatcacgaggtctcaaatccacatcgataaaacaaagataccggcacaagttagagctggcatatgtatcccttacacatcatcacccagtgttctgcgcgctcgtcgacacaccaccagtaagcctcacgcttcaccaaaactgcctcgtgtcggcatcaataacaccaagatgacacaaaatgcacacca

SEQ ID NO: 48168 - DNA, 198 bp, Oryza sativa
ttgcttttctttgcctttcttttgcatttctttccccaaccaatctaaactctagggtggctctgataccattgttaggttgtctattggatcacctaggtttagatctagtcgggtggttctatttgcgatggatgattgaacaaaaatagagaataagggaaagggtttagggatgtgaccggttgacgcgttgga

SEQ ID NO: 48169 - DNA, 1501 bp, Oryza sativa
aaaagcacatttttgttccagtacttaaagaacataccatggttcaagcgactgagacattaaataacaaaagcacattttgttccagtacttaagaacaaagggctccaagaacaaaacacagattagtttcatagactatcatagagcatcatcatctactgccacttttgagttccatcagattggaagacaacactagatggaatctggagttggtttgttccttccaacctttcttggcctgggaatgtttggagttggcatagcactgttcaaggtttgcaaacaaaagactaattagcactagagtaattagcacataagatgtagttagtatttttagtttgaataaatttaaactaacctagaagatgtagtgcaactgtcctttttagcccttcctgccttttttggtggcatttggacagtgatggaagggtcattgcttccctgccctgaatccatttcaggggttgagttgctcttagtcctgcatgtaataaatcattagactgaaatgaatacacttatgatgtacaaagaaatgaaagtggcatacattgtattccttttcttctttgttgcaacctctcctccctggcagtttttatctctatgaccaaatcctccacattctttgcatttgtgctttgtattttgtccagattcatctgaagctttgattctgtttttccttggccttccacgcttcctccttagtctaggtttttgtaacttaaagccaggatccacaaattcccattggtgtttccctattatgggcctaaacactacagagtatgctagctgcaacttctctacagagaagtacttatccacatatgtgtgcattgatgcacctctgattgaagtaatgaaagcaatagcatgtgtacaaggtttgccacacatttgccatactctgcagctacatgtttggctatctaagtctactgcataccttagttccataccttggttatcagggatagtcacttcagctgtagttagtgtgaccctactaactttatgtttctttagccctatgctctgtttattgagatctttagtcacacttggcagtatgactccttccatcttacttgcaatttctgctctatgacagaacttggacactatcttttgcctaatcttatcgatcatgtctacaatctgcacatctttcaagtcctttatccaattattgaaggattctgacaagttattgttgatatagtccaccttggacaattctgagaatttcgctctactccacaacatagggtggttgtcattgaggaattggattgcctgtggtgattgcatcttgatggcatcataatgcttgttgaatccagccattgtataactcttagcagctggctacatgttctccgcatatactgctccatggaacttctttttgaagttcttccaaaggtgcctaaaacactccctatgctcagctatggggtagacacttctcactgcattttcc

SEQ ID NO: 48170 - DNA, 234 bp, Oryza sativa
aatttttccgttaggggccagggccgggggagaattttcacctgcggatgagcgagggtggggatcggaattaacccacgggtaacccgaaggggcatcggatgtgagttacttcctccgtttcataatgaaagtcattctagtatttttcacatttatattgatgttaatgaatttatatatatatatgtgtgtgtgtgtatgtatgtatgcatgtctgtctgtctgtttaga

SEQ ID NO: 48171 - DNA, 1501 bp, Oryza sativa
ctgatgcatttgaatcatttccatgcaaaccagaattcatatttgaatcttgtgggctactactttcaccagctgataagtccaactggtcatttcctcctgtccgattgctttcaatacatcgcacttccttgtaaagatctgaatcatcatgagagacctgagaactatcatctctgctgacgcttgggggcattccaacagatggagggcttctgactgaatgctttccttgaacctaaaatataaacaaaacaaacatgaccctgccggaacaacgagatgaaacaaaactaaatttcagaagtcatggcagagaatatacttgacggttcaggtcatgatcaccgacagattgcagcaaatcctgcaacctggattgagccaaatcacgttgtgacttcagttcttttatttctttctccatctgcaatggacatgacatgaaattttatggatgtgtgcaacagaaacaacaaactttttttgtcaagtagaatagtgtggaaatactcgtaatggacaaggcaaaagtggcagcaagtaagatagaccagatgcacacaaaaacaatagttttctgcaaattccagtatgagccgtggaggagaaaacagggaggtaagaaaagtgacaagtaactttacctttctgatttggttgtccttttccttcaataatgtttcgagactggaactctgaactggatgccgcaactcgctctccaatctagcaagttccttttgcaagtgcttaaccagtgctttatcagacatgaccacattaacctgagcatttgtaactacttcctttgcacaactcccaaatagcagagtatttcttgattgctcaatgtggctagtggcagggctcagtgtacaaataattgcagttcttgcattacctcccaaagatggctgtagtatgcgtgtaagctttgaatctctatacggtatgtgtgcattacttcccatgctgcattaatgaaaagatataactgatatcacttgggcgaaattccaagcaaacattactgtaaacatcccactttattgtacactatataaaatcccaaaagaaaatacatatgcataaagcatgcttaaatatgtcagcacacaaaaaattgtgcaaaacatgacatgtactacacaaaataaaatgatatatattatctgttatcaaacaaatgcaaccctattgcctttttatgttttacatatctaacaatatttttgcacaaattctgtgcacataatacatgctccaaatatatatctttcctagaattctctaaagcgacaagtgtgaaatcaaaacatatatggagctacatgactacagccatccttaaaaaatcatactctgtcaagcaacaaactattctctaaataagacaaccaaattttcctataatgtggattgaactaaataaaattgcacagtttcaagttgagattcggacctcagttttctaatgacagtgccaagggcaagcaaa

SEQ ID NO: 48172 - DNA, 1501 bp, Oryza sativa
agaacaaaaagttttgaaaaattccaaatactttgagaatctcaatctctcccaaaattaaataaacctaaatagatgtacttaaaaaacaatgctatgttttgttattttaatttttactatgtgattcaaattaacattgtacatttgtcaagtgatatttgaaaccataaaatatgatatgaaattatttgaaacattattatcacattaactattacatgtttgcgtcatttgtcatgatttatttagcactacaatataaccatcataagtcatcaatggcatatttaagttaatgaagctttgatattttatctatcagagattaagtttagctgtgtatatttgtgtaatattatttttattaaaatcatagtttaatcattagtgccgacacatcagtgtcggcgctaatgatttttccaattctactatgtactgtgcatatttcttttattttttgctttatatattttcgatcatatacgcacgttatgttttttccgggatagagattagcagcatgagatttttaatagatctaatccaaggtttaaaataacggggtaggtcaaccaatttaagtgaaatttgacggtccgatgcttttctttttttcctttgaatttctaggatttatataatttattagagcgccacgtgacagcgtaagagggtttgtaggaactttaacagacttttactgtataatagatttctagggtttctctctgagagccacatagcagcgtaagagtgcttgcagaaagtttaatatacttatggagtttacaatagatagatatagaagattgtttaagcaacattggtcggacatttattacggatcttaatttaattatatttatatatttatatttgtgaagtaatatattttgacttcatatcgtagaaaatcgtattttaaagaccatcgatttttatagatgtgtgttattttttggtcttttattatgtacatgcgtatgtttttttttcttccgacgaacattagtaaatatttgttgttttgtttacaatcatgtatatacggaagaacaatattagagtttgtatcttatcaactcgtaattacggcacaacgattgtagcgcttgtatgttataaacatgaggaaatatacttttttaagagaggtggcggtgagagaggagctgttggcgtcgtctcggcgtgggcggaaacgggcagcgctgatggaagggagaagccggcacgagggagctcggggcggcggtgagagaggagatggcggttgtggagaggagaagaaagatcggccgtggcgtcgtctcggctcgggcggacacaggtggcggcaatggaagggagaggccggcacgggggagctcagtgcggcagcggcggcggcggcgtaggcacgcgacgatgcggccgaggcgagacggtgtgtcggcgcggccgtcctcctcccccagtcgccgcggtctccctccctcccgtcagcgccgccgtc

SEQ ID NO: 48173 - DNA, 239 bp, Oryza sativa
aatacaccaactgtgtattgtctgctgatctgacgagctcaatcagtagacagaagtttagttcggagcatttggctaacgtgtttcctaaaccatcattgatttgccgaatttagaaaacaattatcacaccaaaatgaactagtatactgaaccatccagagatgccatgcctatctcttgggcatcatcaagaggcagttcgctgattcctgaaaatattttctgaaactttcagc

SEQ ID NO: 48174 - DNA, 248 bp, Oryza sativa
acttgtcaaaaaaaagttgccaacacattgctcgtttgaccccttccacatacaaaccgaagatatgatcgatctgactattttgttaaagccatataacggtgttaactgaatcccaaaataccacttttgtccatatttcttcaaagcttttagactttgttcgtttccccaggttcccaactccgcctctcgtttttcacacgcacgctgtttaaactgctaaaaggagcgttttttatttcaga

SEQ ID NO: 48175 - DNA, 1501 bp, Oryza sativa
ggtagctgatctcggtggtcagactagagatctaatctcggtcagaccgacggcaccactcggtcagaccgacagatcaatctcggtcagaccgacttccgtcaatttcgagggtaacttttatttccgctaaaagttttcggtttttgggtataccaaccattcacccctctctggttggcttagttattgtgatttgatcctacaaactgcaccttggtcatgctcatctcgataatgccgttgcattggtgtcctttatatacccaaagcgaaagggtattcaggaaaatgggactaaagtgaatatgtttgaaaagggtgtccagagtgaaaatatgctaaaccaaaacgaaactttggttaaaaactaaaattaatctctatttctttcttgattaatatgaatgctagttgtaaatacgatttcataaattttgaggttttcatttgcactaaataagaaaatatgcagcaccaacaattacaggtccggaacatattgaggagctacacaaatcctgaattgctcattcggaatcactggtcattcgatcggaatattagtcttgtggattcatttccttgggtcatgttacacattatgcaggattagactctgttttacagttttgactattatagatatattatatttcagaatttgaaagcaagaaacaaattaagtgtgatggtttatgcatgaaagccggtttctgaatgagattacctagctgcctacaaggtggaagttttacatgggtgtcgcagggcggtgggtaggtggagtcgtccgtacggctgcggctgtagatgacgtcgttgcagtggttgccgccgcagaagctgatggtgccgcagggcggcggcctgcggagtccggcggcgtgcggcaggcgcacggcgaagacctccgccatgtggcgagtgtggcggaggccgagcagttggtcgtacgcggccagatcgtcggcggtcggggcgtcaccgtaccccgtcgccgccgccatcaatgaatccagacgcaaacggaaggaatccaaaaatcaaaaccagcaagcaaagtgcaaagaggaggaagcttgatcgaaccttgcgaccaccgtcctattccgtggaaggggatcgaccggatatcggcggagttcacaaggggagcgtgtggccagcccatctcaacccaattaaggcccagccttacaccaagtacggtggtgtgaaggaataagtccattttgcctccctcatctcttgcgtttgtgtgccctcaaccggaaaaccgggtataatgcctcctccttctctgaaaaccagagcaaatcacctccctcggtagttttgctgacgatttcatccgacgtggcgtgttgacccgattgacaagctgactcagcatggagggacccacatgtcagtgtgtagctctctctcccccttatctctctacccggcctttctctctctccctcatctcttgcgcgtgggaacggcgatggggagc

SEQ ID NO: 48176 - DNA, 1501 bp, Oryza sativa
agtggttaggaagggggaggtcggggagacggtgttggcgacggtgaaccagctcaccgccaccacgctcgtcatcggtctccacgacaagagcatgtggcgtgtcggaattttatttgccgtggccgcagcggcgggctgtatcgcggggtggtcggcgcttgagctgctggagcatggcgacgacgactggattccgaccttccccagctcaaggctcagcctcgtggtcgccatctccgccttgtcctcctgctcgccctcgccgccgcctcctgccgacatagcacaaacgaaaatcaagcccaaggcgttcgatgtgcatgtgatagacggcggtaggcaaggtcgtcgcgcggatttactactactcacctgcgtagcatgcggaggcggcgaggcctcgtgttgtccggttgtggcgccggccatgtccgcgagagccatggcggcgtcgagctgagcggattgaacgccatggcagcgtcgagtcttggagcatcctgggcgcggtgagtggattgagggtgatggtggcggcgtattggggaggcacatcggagcggggaagggatgacccagtcgcggggggagaggagcggggaatcgacggcggcgtcgagggcgtggacctggccgaccccctcgtagcctgcaacgacggcggggaggggagggcgaacggggtagacgccctcgacgcggttgaggtcggaggggttgatgggggcggccagcatccgcacgcacacatcgcggttgccgatctccgccggcggcagctcagccaccctgaggactttgtcgggcgggccgtggtggtcgtagaggacggctatggcgggcggggacatcgaggcgcctcgcccttgccgtcgtcgttagtcgcttcgtcgttgacgccacggcggtggcattgcctctgcccgtcccggcgcaggtggaggcgacttccgaccgacacttccgaccgcctacgccgctccccatcgccgttcccacgcgcaagagatgagggagagagagaaaggccgggtagagagataagggggagagagagctacacactgacatgtgggtccctccatgctgagtcagcttgtcaatcgggtcaacacgccacgtcggatgaaatcgtcagcaaaactaccgagggaggtgatttgctctggttttcagagaaggaggaggcattatacccggttttccggttgagggcacacaaacgcaagagatgagggaggcaaaatggacttattccttcacaccaccgtacttggtgtaaggctgggccttaattgggttgagatgggctggccacacgctccccttgtgaactccgccgatatccggtcgatccccttccacggaataggacggtggtcgcaaggttcgatcaagcttcctcctctttgcactttgcttgctggttttgatttttggattccttccgtttgcgtctggattcattgatggcggcggcgacggggtacggtgacgc

SEQ ID NO: 48177 - DNA, 1501 bp, Oryza sativa
tatttatccggtctacgggtatcacctgtcgacaaaagtatacaagtaatttatatcaatcataaaagtaacttagcacaaaatggaagtaagttgttacaacattagaagtaaattcgttgtaaggagaaaaatatggtctgcctaaaaattaaatttaaagtccataaattatagaattgactaaaaacaataataaaaataacaacttagagcattatgaatgtataagaagtaacttagtcaaatctaaaagtaatttttatatatatgataaaagtaacttacgtatataataaaagcaatttacaaatataaatatttttcatcgtaatataatcatgtaagatcttttctgaagatttaattgcaacgaatacaatgatgtaatcgaatagtagattggataagtaatttgacagaaaactttataagaaggggaaaaagacatgcatgtctaacagcaaaaaaaaggcatggatgtgtagtaagcttctccaccgctccgatccatcgcgcgataagacaatatcaagaggcctcgccgattagtttttgcgatctctgtccgaagagtgccacaaacagagtaaatcagtaccattagccgtctggacacttgaggctttactagaagcagagcatggctgaagctgtgaaacatcatgtctcatatgaaaagaagctcttgagtctaatatccaatgtgagtctacaacacttgctgaaaaggaacaaccagcaccttgagtgtcagaacatgaggatgaataatatgcctgtaatggaggagcaatgttgaagttaatccatggcgccatcaccatttctgctcctatttctactccaagcacgtgactctgttttgtggagatcatggcgcatgtatcagctctgatgcatgcacgttcatgtgggagctagtttttcgctttggttgttagggagtgtgtgcgcttcgtctgttcttcgatcgtgggatggcgcggtcaagctcaggagacatggcgaagtgccggagttgtaggaggaggtatggcgaaaatcacggtcatgggttggcacgatccgataggtcgtagacatgtattttgcctatttaaagttcctaatgcattaaaaaacgctgccaagttttcagcagcacaaaaatttctcttttgcatactctgttcttgatcgtgaatttggtcgaacaccttcggggttcgccaacagttgctatcagagcctcgttggctcgctggtgccatgtcggagcataccccaccgcggccatcctgctcgccgccgccaacaccgccgcgctcacgctctcccctcgttcgcccgtcacaaacaccgccatgccacaatcctgctgagtccccgccgtgccgtgggcgcgggcgtggcgagcgacagcccttcgctgcccagccacgcgtcgtcagggagtcgagcgccgccgtccactacccggtcctaacgaggaccaactacgaggaatgtgcgctcttca

SEQ ID NO: 48178 - DNA, 1501 bp, Oryza sativa
tgatttaaattattgcattgtcgctttatttaaattcccgcgttatcactgttttatttagccatgcctatttacctttgttatgaccttattattattgttattgttattattaccttgttcaccctagattaaacaaaaccccaactagtggacactctactcatggtaccactagcatgattttaggtagatgcttcgctgtttaattaggtaacattaggtggttttacaactctagactttgggataatctcatcacctggacacttcggaattgttggattattgtggaattggattcacaccgccccctctattcaaaatccccaaaatggttttaggctgggctcggggtgcatggttttgatagtagcacctcggccatataaggaccggtcttcgagcctctgttgctaagcactaccgtacttccacatgtctagtgggtaaggcttagtttgtggctcagtctggttataaacaaaagtacacggattggagatggatgaagtcgggggtcgatggacattctccagggcaaatgaaggctacaggagctgcggcccggtagtcgagatgtcatagcacagggttggtgccctgctgctaggggctcagtcctgcctgcctgtcccggaggttccggccgtaggcgggattgggtcggtactcttgtctatggctaggatgggttggaaactatgtcacgtcttccgtctgtataccgtggtgttatgtggcacgtggttgcacgtgaggaagatgtgtcttgtgggtaaagatgtacacctctgatcagagtataatctattcgaatagccgcgccctcggttatgggcaagccaagcaatgtacccaagttagtgttttaattcttaaaacctgcttaacaactaaaatgtgaaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgtttactgcaaaacttaaccccgatattattatccccttgtacccccttgcattaatcatgcatctccggtgtgacttgctgagtactgtggttgtactcattcttgctctatctttcttcccccttcagtaagagaagctttggagaagatgtcttaggtggagtcctggcttataccccagttgagcgcctgtgaagatggagccgtaggcccgctagtccgctgctgtttatttttggttgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacactctacatc

SEQ ID NO: 48179 - DNA, 598 bp, Oryza sativa
aacccatttttgtgctttgtttctgcttgttatttggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggacactctactcatggtaccactagcatgattttaggtagatgcttcgctgtttaattaggtaacattaggtggttttacaactctagactttgggataatctcatcacctggacacttcggaattgttggattattgtggaattggattcacaccgccccctctattcaaaatccccaaaatggttttaggctgggctcggggtgcatggttttgatagtagcacctcggccatataaggaccggt

SEQ ID NO: 48180 - DNA, 1501 bp, Oryza sativa
  unsure (1)..(1501): unsure at all n locations
ccatgccttttttttgctgttagacatgcatgtctttttccccttcttataaagttttctgtcaaattacttatccaatctactattcgattacatcattgtattcgttgcaattaaatcttcagaaaagatcttacatgattatattacgatgaaaaatatttatatttgtaaattgcttttattatatacgtaagttacttttatcatatatataaaaattacttttagatttgactaagttacttcttatacattcataatgctctaagttgttatttttattattgtttttagtcaattctataatttatggactttaaatttaatttttaggcagaccatatttttctccttacaacgaatttacttctaatgttgtaacaacttacttccattttgtgctaagttacttttatgattgatataaattacttgtatacttttgtcgacaggtgatacccgtagaccggataaatagggtattggggtacgttggtatgaggatctgcacaatacgacatcaagcaaacacagagatagggattatactggtttaggccccttagaaggtaatagccctacgtccagtttatatgatattgatatagaaaatcacagattacaaagagaacaactgaactcggcaataccggtgagatcgtagtcgatagtttcgactagatgacctggcgagatgacttcgcatgcttcggcttcgtaggctatggtggatttgctggtagaaagattcgatgcccgtaacccctcaggaggttctccttttataccacagatcaccttgacctncaagtaagactcgaagatgttggaccccgtacagtatagagaacaggaacctctncgagtaggactctgttgtctcccaactgatcaagataattttcataatagccgtaatcttccttaccgcatactgaaatattccatatacatgaaggtataccatacttgcatattgtgtagatcgtaggataggccttatccgtaaccctgatagtagcccccgacttcaaattaaatgagctttgttgtttacttccaacttcacttgtcgtccgcgactacccagatgcgacgttatcgtactcacttgatcgttctcagtgcaaactgaggagacatggagttttcgacaacgccacatgaagttcaacggtccacaagtgaatttaactagaagtctaaacagctgccagcaacggtccttagaaatttccggcggcaatctctctcctttcattcaaatacgaaccgcctgttagtgggcttatataaagagattttgggatttatttggagtctgcacgcctagaaactttccagcttccagcgcattctctctctcggttcatccgcctcccaaaaaccctagctttcttcctccttctccggcgaacttccggtgaccatggatcttggcaagacaatcaccgacaccgccgcaatgaaggagctgcaggtggagggattacttctc

SEQ ID NO: 48181 - DNA, 1501 bp, Oryza sativa
ctcaactgcggcgggtgggttgggagtttgctcgaccatgtcaaggctccgcttgttgcattgtaccgccagcttcgcgtttccttgaacagtgattgtcccttttggtcctggcatcttgagcaattgatacgcgtagtgggacgctgccataaacttcgcgagtgcggtccttcctaagatgggtttgtatgccgtatcaaattcagcgacatcaaaggtgacctgctctgttcggaagttatcggcctgtccaaacgtgacgggtagcgtgatcttgcccaatggcttgaagggttgatctgatggggtcaactcgcttcgtgggattcccatcgcgtccaatgtgccagcgaagagaagattgatggagctgtcgccgtcgatgagaacccgtgcgactttgatgttccgtatggtgggctcgaccacgatcggatatctgccgggtagggttgtagtttttgggtggtctgcctccgagaactctatcttgtgctgagaccaattcatcctggcagcaactccttgagatgtagagtgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaaccaaaaataaacagcagcggactagcgggcctacggctccatcttcacaggcgctcaactggggtataagccaggactccacctaagacatcttctccaaagcttctcttactgaagggggaagaaagatagagcaagaatgagtacaaccacagtactcagcaagtcacaccggagatgcatgattaatgcaagggggtacaaggggataataatatcggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccatttcacattttagttgttaagcaggttttaagaattaaaacactaacttgggtacattgcttggcttgcccataaccgagggcgcggctattcgaatagattatactctgatcagaggtgtacatctttacccacaagacacatcttcctcacgtgcaaccacgtgccacataacaccacggtatacagacggaagacgtgacatagtttccaacccatcctagccatagacaagagtaccgacccaatcccgcctacggccggaacctccgggacaggcaggcaggactgagcccctagcagcagggcaccaaccctgtgctatgacatctcgactaccgggccgcagctcctgtagccttcatttgccctggaga

SEQ ID NO: 48182 - DNA, 230 bp, Oryza sativa
gaaacataattcaaaggcaaagttatcgacccttgcatcgaatagcagaagtagttagcacccggagagcaggaaagctaatatgaggcagttggtggcaagttaaaagtaaatgacaagcatggtaatctcatgatgacaagcatggtatcctagtaatgacaagctggtgtcgacgcatgacatgaagttggtaacttcaatgaggttgactccaaagatatgaatta

SEQ ID NO: 48183 - DNA, 1501 bp, Oryza sativa
acaaatacatcgtttaataatttataaaatcatcaaatgattaatcatcctagtatataatataccgcctaaagtccacagccgtgcctaacccgtttaacctcaagctaagaaattaagttaaaaactaccatgtataagacaaacggcaaggagaggagaggtccaacagaggtagtaaacaggtatgtgtgcgtacgtacggtactatgaatgggagaagattttgttttttaatatatctatttggtccaccaatttaagttatctataattattagttgatctaatgtactcaaataatgaatcacgaagcatttatagaatatccatgtgtcagattaagaatgtgtttataagatgtttaattaacttaatatataatagaaataaaaggacggagggagagctggccagacctagtagatcaaagtctatttgtgagttttttccataaaaagggttccaatttttgttatttggggataaaaaaagcaagcgaaaaggagtacagaaaacgtacgttgtatgtcgtacgtgcatattccacacagagacagagacagggatggagggatgctttttttaacggagatctaaccatctaaaataataggtccaccgatttaaataaaaatttatggtcagatttttctattttattacgatgccacatggtggtatgagagcgtttatagggtgctacgtgacgatacgggagtgtttataggaaataaacttttataatataagagaagatagatagatagatagatagatttatgagtgcaactgttgttaaaattctacacatataagaatagtacatgatatatatgccaaattcccaatatatgatctgcatatgcactgagtatgtggctaacacatattatagaatctatcttataattgtggtaaactcttgtttaacggagacttgactggatttgcgcaccttgggagttatctattgacttgatctaaatcgtgctggcccggtacctactgtatacctcacatgccgagccgttgacattgacatgatactctacagctgaagcttttttgagttatgttgggaagaatcactaacaaaaacaacttaatttttgtgatataaggtgaaatcctgaaatatatgttccacaagaactgtgcgactgattaagaaactttcgtatacattgatggccaaattataaaaaggaaattatatattgaagagattaatggcctcaaagattggaagtgttcactgcatgcatggaataattaatgatttttacccacaaatgatgaagggtggttgcctacttgcgaagtggacatgcaagttgattaactaggactgatattaacaaattagaccttgtctcatgtgttgctagttagtcaatataaataaaatggcctttccttggctgtcctttgccagttaatttgatagttgccccttaacaactaaatagcgaacctctgagcagatggccttaatatc

SEQ ID NO: 48184 - DNA, 1501 bp, Oryza sativa
gtaaaaaaaaaaaaagaaaaggcaaacaatcagcccaaagaacttgaatcgactactagttaataactagaaacgttattttctgcccccaggacgtaatgtgactgtgagaccttaatcttttccacacccaggacgtaatgtgactgtgagacctgaatcttttgtacatccaagttgtagggatcagatgtttacagggctttagtcagagacgggatgcctaaccatctgccaaaaaaaatgtgtttgaccatcggaaaaatgatttttatagcagtgacgcagccatacaggacgcacaggagacagacagatgattcgtccgttagagcactacttccatgactcctaggctcctagccaagcacacggcgggtgatgggtgataataagctatctatttatttcagcttactactaataatttaaattataataattctaaggtcttatttgattcagcttagagttattaggagtaaattgaaacaaatagatatcttattatgatatattattacaatgtataaacacatagcttatttaatcaactgtaaatgtgctttttagattaattggttggctaaacaactaataatccagagaaacaaacaactaacaacttatattctatatcggcttattataatctagcttatagtaatctgacttaataatttagattataataatcttaacctgcaacaaatgtcacgaccgcgagggcctgtgccatgtcgcggagaagctggcgggccggaggaaggaggccaggtgcgttccgccgcctatcccagactgcaggtggatatctcctattcgagcgtatcaagggccattgcacctcgatcgtccttgttccactatgttggcaccgtcccgaagccttgcactcatgctctggccccagcaccgtagtgtgcggtgtgccctccatgtccgtggccatagttcatcttcctcttcatctcatcatctgccggatttatccttgttagacggttgtggaaaatgacagagtgcactgtcaggacagggacgactctgcgtgtagatcgaggaggacggagaagatcagaagaggaacaaggacgccaaggaaggaatcggccgaggccgggagcaaaccattgtggcctttctgttgttgcgcgtgggcttgcatgtggtgattagtcgctaaatcgctgggctcgttgttggggccttggggatgggcaatgtggagtcaagggagatatatctgactcacccagtttttagcttggtgccagcgctgtagatggccatagagtcagaggcccgatggcctggtgatttggtccggcctaggcacggcctggcccgacagccgtgccgtgcctggctgctacctcggtacgctgggtcagcacaaagttcagggatgcgaaacaaagaatagagaggaaaaataaacgtattatatggcacaacccaaagaataggaacgtaaaatagacttatttcaaaaaaggca

SEQ ID NO: 48185 - DNA, 1501 bp, Oryza sativa
ggttggcgatgtaggttgccggatccgtccttggccgcagcttcctcgggcatgtccccttgctcagcctccggcatctgttgtcgctacccaccgagtctgttgtcggttgcctccgaagatagatatcagttacttctgtggacaacagacatcttcctggaggtgatgtcacaatatcctttgcatccgtgccataggatggactctctcattgaaaacctagagatagtgatattcaagatgtcgcagccttcttgaaggcgttgtattggaggttccctattattgtgatatccttgtggtgtcttcatcggatcggattcgtttggtggtggtaaaatctggactaatgactgatatacagttcagctaatctccattatttcttccgctttggtttgacgccatatgataatggtgataggtacaaaatttaattataatacaagtatcgactattcatttaaaagattatgcttttctgctttgaggaagacaagaaccagctcggttatacacactctagccaaccatgcatggagatctatatttttaagggtggttttcttagcggttttattgtttctaaccaagttataattttgtattttttttacttattcatccagcaattctgtaataattggttgtagtttagtaaaggccagaatcaattccattataaaaaagtaactcttatttagacaatgttttgtaatttatagtcgcacatcatgaattggagttgaatggactatttgctatggttttctttagagaagctatgattcacatttttcaataattatatatatgtgaatttttctcacatactttggctaacaatcacacgaatagtccctacatggcaatttctacagtttctgccctatccaccgtccaatctcatcggacggttcttagttgccttctcggcccatcaggcccagcacccaaaccgctgtgctcccttcgtggcggcgacgccgacgaggcgtacgcgtcttctccgccgccgccgccgccgccgccgtccgtccgtccgtccggtcggccagccggcaacggccacccgtgagcgacatccgcgaccggccagaaccgcttcctttggtagtccgtgcccgacgccaacaagcggaggaggtgtccccttgaacctttctaccacttgaatcttgcaatctttttcttttccccttgcaatacgattctccgttcaattgtccccgcctcggattcttgtatctcgacccgtcgattggatcttgtttcattttcatacgaattgtccatcggattggacgcgtgcgctaaggtagtttgtagtacaattttccccctctccattcggagaaaggccgttcatagtttcttctgtttatctggaatcaggagattcatgaattgcgatttcgcgttcatatttctggaaatgaagttaatgcaattgtggttatgcttctattgttggtaccgtgtttgatcagatatccca

SEQ ID NO: 48186 - DNA, 1501 bp, Oryza sativa
aaccaaacacaccttagctagagagctaaacaaatttgattgtcatctagaacatagataaaaacatcaaaagaatacaaaggctcatttcttgttttattgttgagaaaaaaaatcatacggctcttttctttttttgagaaaagaaaatccaaggctcatttttaatgtggtgtacctgtaccttaaaacgttaacatccagcttgacatatacaccctctccgtcctagaaaatctagctcaggaattggttttttttttttctgaaacaagagaacatatatactagtatataagcatactcatagatcgatattactggctatagctcgtacaaagaaactcgatccctctggtttaataattcttgatgttttaaataatgatacaattttcaaaatatatcttttaccttgttttttattataatatatatacaataaataaatgtatatttacttttattgatgtactttcaaagataaatctatatatgttgttctagttcctttaaacaaaataattttaaagttattgatagtcaaatgaagttacaaaagtttaacctcaacccctgtctaaactgttaagtactataaaacaggagagagtacaatttacggtttttgataactgcaaattaatcattgtgtagatcagaaatcagaggatggcggtgagagttgagaacgtagagttcaacgtgaggacaggcaactaccctgaattcatgaacaaccttcgcgacaggctcgcggagcatcctgacctcgacgacgtctacgccggctgtcccgtactcgcgatgcaacgatgcccaaaacagccggcgaggtggatgtacatcaacctggtgggcaacggcgacgacagagcaaccttagccgtccgggatgacaatgtcaacctcatcggcttcaggaacctgaaaggacaatggttccacatgggcttctcggggatgagcaagccgattctccctgagccatccacatttctgggatgcgacggcagctacccaagcttacttggtggtcgcgatgaagacgacgttaagaatatgttggttaatgatattgacctgcgacaggtcgtcctgctggatgccgtccataagctgtcgggctacgaacaaccacctgatccatatggcgctgcagacgatgacaccaaactggatctggtgcacctgaccgtcgtcttctgcgagggcgcgaggatggctctgcactacgacgccgtgaacgatggccaaatcagcctcaacgagcggcaagtagattacttgcgtaactggtggcttatgtcacgggcgctactccaggacgagacaacaccatggccccgcaggcttagtagcgagaccggtatcaacgacgatgagcaggctcgccgtgtagtgctactggtgctcaacactagcactaccgtgcacgttcacggcgcggcggagcgccgcccactggtggagaaactctttgtagtcccggctcgtaacc

SEQ ID NO: 48187 - DNA, 1501 bp, Oryza sativa
gcatgggcaattgctgaacttctagtatagcttttccctttccgatgtacccaagtaagggtgggtgtgatgaagtttggatggactgggcagcggtctatgcggcttccggattcattgtagcacaagaggggattgcccaccttggttttaaaggtacgggtgaaacctgcaatgtggtgcacttggttaggggagttatgcgaagggacttgttgcaatcactcgcatggtgacatgcctgcggaagcacggtgacatgccggtggattgcgtcttgtgggtatagttgtacacttctagccagagtaaaactattcgaatggacatgcttgcggttatgggcgatcgaccagcttcaccatgtttagtctcactctattatttaacttgacttaatgaattggtatagttcaggtggttggctggacctgtttatcgtggtgtagcattgttaagtggacattaatcttgtcttaattaattaactgttttattgttttcaactacaaatgtttacaactgcattcaagcaaatagccacaaaccctcctttgtctcctcttgcatgcctacatcattagcgtggcttgctgagtaagttggttgtactcagtcttgctattattcttcctttttagaattggtagaaaaaccaagacttataccccagtcgagttttacctatgaagtggagttgaagcctgctaggatcgtatttttctgttgttgctttcttttcagcgtgggaactaagtgtctcttccgtaagtatttacgttttatttatgttctgatctgtatattaatatttctgaacataaatttatacacaaaatagtctgaaaatttggttaaattttggattcacaacattataattcaatgctattcacctatatgtagccatgccattataatgttacacgtattcaatatttgccattacttgctatttcgatgcaattctaaattttttaccaaatttcttaatctctttaaattaaaaatacaaaaagataactactagtttctcgtcttcataacaaaatgaaatttccagttttgaaaaacaaattttctaattgctgcaaacgcattttctgttttatagttctaataaaaaagaaaatccaatcatttagaaacccatcattaattgatgcacattgctgacttcctgctgcctactaaattggacctagtgctactccaccaaaccaaagcatagagccaaacatggcttggctggctatggacatatcactatctagcactaccatgccatgtcctcacagagtcaaactctactcctttcatcattgtctcttgtgtcacatggatatacactttcgatggaaattccaacattgcggtcgcatgatcttgtcgtccatcttatcgtccactcccttttccaaattttgcatgtgatacactggattggaatctgttgctccatataaataagtgactctgagagtagcaaagccaaagcaac

SEQ ID NO: 48188 - DNA, 1501 bp, Oryza sativa
attttaattaatctctaattgtgttctacatggactcttctttcaatatcttttattccgaatttcaataatttctaaatgcatttctactcaagctcctctcttctttttctctgattaatgtgagattttgtagcctccatagggaactaaatataatacacacgatggatttaaatatgttatcttttacccactctcgaagctttttttatttttagtcttgcgttggagtactttcatcgttgaaaatagatgttttttcacaggtggccagcgtactggggccacctatgataaatcttttacataggcgacccgtgcctcccaccatagatcaaacttattgcaagcgggcattctcatggatcgcttatgatcctgtacttgggtgatcggggttttctgtgaaaattattcttttatgcactatgactaaaaaaccatataccgttctaatggaatatatagctaggtcaacatgattttcagatttgatacctccagtaacatatttccagaccgtcagtatgatacttgtggtatcagatctggtacgttcagtatcagacatgatgccccgtaggtatcagatctgatacctaagtatcatgctaacatcattgtgatacctacggtatcagacatgataccctgcatgtcaatgtcatcatgatatcagctttttggttggaatggtataccgttgtatagtatttctgttaaaaattaacatatgtggagcataaaattcattctcatccaacctgtggatcttctccttctctgacatgattgttgattccggacgtctgcctcatcttcttcagccttttggccttgagcatgtcggccacacgttgacaggctagatctatcaggcccttgacgcccatgacattggctgcgctgatcaagcgccgcagcgtgtcgttgtcgaccttgatgaacaccctgtcgaacttcttgagctcgtcctcgtgcattgctttcatgtcgccggtgccagagctcaaggtggcgtgcttcatgcagtaccgcttggcgatgacgttgtcggcgacgttagggatgggaatcccgttgtcaccagcgtggtggtcactgttgttcgtattgttcaccactgtctatgacagtcttgccaccgcctcctccacttcaaagtgttcttcgtcggagctgatcaactcaaccatcttgccaccatccgtcgccatgcatcgccattgatttggctctcaagttttcttcaaatctaacccaacaggctgatggatatagatggcgatgctttgactcttggaagtgttatatatattgtttggcgatatcgatcgataacacactgatgaattttgtgttatcttttgcgatttctactagtatactaggaaaaaatgcttgtgcgttgcaattggaggtaaagatcaatggagaatgagtttattctttcacagatatctgatatatgtcaatacttattatccagtagaagccg

SEQ ID NO: 48189 - DNA, 947 bp, Oryza sativa
  unsure (1)..(947): unsure at all n locations
agtaattgataggtggtgggtcatagtagtggggatcaattttagatatagtgggatgatatggttataaataagtaaatagtaatgatatattttcaaaccatgcaatttacaatcacaactgtgacaaaatatgtcatcaanctaaacaacccttgagagaatttgctacgtacaactgtacaagacacgttaaaattagcttttatttgaggacggtataaaatcgtcgctttgatagtggatacgtactttagattcttatttcaggacagtatttctttgtaacagtgtacaaccacaccattgctttatcatttcttaccatattccaaagagaaacttcacatgtcgaccctcgcacattttctcggttcaaacacatgcatcattactattaacatgtgtaatagtaaacctttcctcctccaaaaccttaaattcactgcaagaaaacaaaacagcatgtccttcgcggtcgaagtatagcctgatagccgtcaaggtaaattattccgttgaccgaccgccaagtctagagagtcagggatattcagatttcttggtagctaaccgtaaactagtactggatggaatgtaaactagtactacgattctagataggacccacgaatctagatgttgtagcactagctccaaaaaattgtgcgtgataaatgaaccaagtactaatgatgttaaatgaaactattgaatgtgttaaactattagatttgttatagatgatgcgtcaatagctaacatatgggtaactattaaacttgttcttatggtccatgatgataaacgagggctgctatacgtacgatatgttttgtacgatagttgtacgatgaaacacttctccagtgtttagtaagagctgtaagtttggtcccacatatatggatggatttaccttgtattgctcggcccatatgcatata

SEQ ID NO: 48190 - DNA, 1501 bp, Oryza sativa
cgaaaggcctaaaagagtataatatggttctatgtgataatttttaaattaaaatataattaatatgttaatattagagataagatggatgtgccacgttttaaatagtcatctataactataacgatataacgataagaataaatagtttgtttttctatatcttattcgtatgtacctatgtacgtacgtattttttctgtcaattagtgtatgtgtttttttttgcctttttcttgggtacatacggatatatgcatttttttccttttttcttgcagcttttttttttatccgctgcaggagaggtggaagaaaagcgtacgtacacaaatggctcgatgggtggggagtggggattagtaggttgatgggcttattaggcccgttattttcaattttaattattatatatatggtataaaaaggaggaggaaaaaatatagtacgtactccctccgtactcgtagaggaagtcgtttaggacaatgtttataattaagtcaaaccttaggaatataaatcatgaataactctcaagttattgagtttggaaatgtaaaaattatatgaatagatttatcttgaaaaatagtttcataaaagtatacatatatcacttttcaataaataattttatagaaacatgaagtcaaagttgtgttttggagaccgtgtcgctgtcctaaacggctttctttacgagtacggaggaagtacactgctacggagggatcgtactatacgtaagttggacggagggagattttgtttcctcgtaaagataaaaatctaaccattcaaaactaatgaactaatgggtccaccaatttaaataaaaatcgacggttagatttttttattttattagagtgacctgtggtgacttgagagtgtttatatgatgacacatggcagcttaagcatttgtaggaaatttaatagactttagcatataataatagatagattacggttacgtgtcaggaagaacccacctacaataattccagatataccttgttctagctgtagatattacacgccgtatatgctatgcaatttttaagtgacgatgagacttgaacgattcaatacttgggatgtgttttagttgctgctgttgtcgtatgtcaatcttctataactacctctttctaaaaaccaggttcagttccatgccaattccgatcaaaatacgttaattccatgaaaccaaccggcttacagataaagtgcagagtccaatcgagattatgttgcatatgcaaccaattctactacgaatcctgattgatgtggtttcttcatacacaaggagatacgcaacgtattccgcttagatacctagccgaattcgtgaaataaatagagaccactaactaacctgattgccgcgcgcaatcacctttaattacagccttccaggaggagaggaattaacctttcttctccatcaatctcagcgtcgtccgtgttcgaccgatcaatggcggcaccc

SEQ ID NO: 48191 - DNA, 1501 bp, Oryza sativa
aaacttgggttaaaaactaaaagtaatctattgctttcttgattaatatgcatgcatgaatgctagttgcaaatacgatttcataaattttgagtttttcatttgcactataataagaaaacaaacaatttatatgcagcaccaataatgagtggtctgaaacatatcatggagctacacaaatcctgaattgctcattcgccttcactagtcatccgatttgtggattaattgtcttgggtttagactctgttttactccatttatgtacagttttggctattatagatatatatttcagaattgaaagtatagaacaaattaaggttgtgtttagttcgtgtgacaatttttttaagtatacgtacacacatttgaagtattaaacatagactaataacaaaacaaattacagatctgtaaactgctagacgaatttgttaagcctaattaatccgtcattagcaaatattcactgtagcatcacattatcaaatcatggcgtaattaggctcaaaagatttatcttacaatttacatgtaaactgtgcaatcggtttttttcatccacacttaatgtttcatgcatgtgttcaaatatttaatgtgatggaaaagttagaattttgacgaaaaaaaattaaatctaaacacggccctaagtgtgatggtttatgcatgaaagctggtttctgaatcagattacctagctggtttctgggtgtagtggcaggtcggtggtaggtggagtcgtcagtacggctgcggctatagatgacgtcgttgtagaagctgatggtgccgcagggcggcggcgtccggcaggcgcacggcgaagatctccgccatgtggcgagtggagcagttggtcgtacgcggccagatcgtcggcggtcggggcgtcaccgtaccccgtcgccgccgccatcaatgaatccagacgcaaacggaaggaatccaaaaatcaaaaccagcaagcaaagtgcaaagaggaggaagcttgatggaatcttgtggagtacctaccaccttcctattccgaagaaggggaactagagtgactactcgaccgtggatgtctggatgtcgggcgagttcacaaggggtgtggccagcccatctcaacccaattaaggcccagccttcttacacaaagtacggtggtgtgaatcgaaaaggaataagttcactttgactcccttaaattaggggccgaatgtaatttgtatccctgcattacaataccagatatcttgacccccataactattaaaacatgtgtaattttacttccttgatggttttgaaaggcggtctcgttggcgttgcgcctacgtgacagtgttgacctgatcatctcacgtggcatttgacatgacgcttgagctaatatggcatactctctccttcccttcttccttctccctcccccccctctctctctcccttatctctctttctctttctctcccctttctattcaccttcatccttcccaagg

SEQ ID NO: 48192 - DNA, 334 bp, Oryza sativa
  unsure (1)..(334): unsure at all n locations
gatcatgcagnatactaaggctagagttgatgcacgtggttgatgnagattccatatggcatacgatgnagttattgtgtgcgtatggaatgcgnagtcgattttgnaaggagtccaaatttggtacgattggttatctaaagtttctatcttgtactagagggtttcctaaggtgtttaggactcctagtatgagtttggttcatggctttaggctgcctacctcgggtataaatagagggggagcgtgaggcttcccggtatcgcttttgagagcaattgagttgagttttgagttagggtttcgagtttagtcgaaatttttgtaaggagt

SEQ ID NO: 48193 - DNA, 697 bp, Oryza sativa
  unsure (1)..(697): unsure at all n locations
acggcttagattgaccactcgataacaccgggcgaattntagctcggtacccnnnnnnnnnnnnnnnnnnnnnnnnnnnnnnnnnnnnnnnnnnnnnnnnnnnnnnnnnnnnnnnnnnnnnnnnnnnnnnnnacttgtacagtataaagtcgaccaagaacacaaaagattgcagcatacaattgggaaataaggggggataattggatcacacacctgggtccttgatttgtttctcaaatctttctacccaatgatcaaactaacctagctagctcctcttcttgatctttctcttcttaacatctgttacgagcaaagcgatcacctgtttgttcacaaaaattgtttgatcaacatgaatagagattataaaagaaagaagagcacagatgcgctagttccagatatatagaatgttaggaaagttaatctctcggctaaggaaatcgggagaaaatcacgcgttatcgttttccacccgttaaccagcgtgattagctaaatcaaatcacgattaaatttccttaattgcacgcgcaataatcggtagcgctttcaacgtttccttttggagcagcccccgattccctcagcgcaaaataaaaggggaggccggcccgtgagaaagatgacgatctcactcacggttccaatctccccgacatcccaaaaccctaatttcccgattctcagt

SEQ ID NO: 48194 - DNA, 1501 bp, Oryza sativa
catcatcttttttatctggtgaagataacaaagcagtggcaattttagtacatccaaaacccatggagtttgcaaatgaagcagctggagtaacagtgtaatccagtgaatgtttgtgaaaacaaaaactatcttccagtgattaagggtcagtttggttcgtgaccaatgttggccttaccaaaatttggcatgtcaaattttggcaagttttggcatgccaaattttggtaaggccaacatatgtttggattgaagccaaattaaactaatttggctattgaaatggcctatgttatataggcatgccaaaatttggcctcaatccaaacatacacaattattgttgaggttgccaaaaaattggcaagcctaatttaggcctcaaaccaaactggccctaaagaacatagataaatgtacacattgcaatcagattctccagtacctcttttgaattcattccgatgatgtctctcagatcacttagagcaagtctaatagtacagcccactaccagctccaattcatttatagccaatctaatagccaattcatacaatagttacttactataatattagtatatggtcccacctgtcatacacacagtgtgtcttgaagtccgtactgcagctggctacaaatctgtagcccgctgctcttctctctcatcgtttatatcattaaaatatgtttatagccggttaatagcctgctattgtacctgctcttatctgcaaaagcaaaggaatcagctctgggttgcattgtcatgtaataacttctggtcgcttgggtctaattaatgcctactcccttgttgatctagagtgctcacctctttaaatagctctgccgctctggtgactcctcacgaagctcaagtatgtagtttgcccttttttctccgattccctaaacatgtatcagtgggttaatagtaagaaagaagcaatctgggctgccacgatatggttcggagcaaacctttaagctttttaattgtgtaaaattaaaggtgttttttattgttattctatgatgaacgattggcattggagatattagttttgatatttggaatttattcacgaagtggttttggagatgattggatttcacaggtgatctacaggtactgctggatgtggtccggtcagaccggcatgtatcacgcggtcagaccggcgcagcccgcggtttgaccggccgactctgtgtcggtttcggtttcgggttgtttgtttagatatccgtgattgtttcatgattatggcttctagatggatactatgcgtatgtaatactgttgtttgctactaatgagtcaagttggggatagtttggtctcggaatatggtttcttttgtttgttctatgtgtaggtgactcaagatgccgggagagtatttgcggtgatggatcgggagtcggctcggggataagacgacatccgtagtggtcagagatcatgcgggatactaaggctagaattcaa

SEQ ID NO: 48195 - DNA, 1501 bp, Oryza sativa
agcaagaaaaaaaaacataattctaagacagttatactcttaagaccgcaatgtagcattgaagcttttacacataaaactattttagtggagcacttaacccgtaagatagtattgaatcaatatactcccttcgttatagaaaaacatagctcattttacatcataatgatatttttattctttcaaaatttttatatttatcttcatacaagtcatattaaacacaccaagagacagataattataattcaattcagtaaattctatcctttaaagtaacttccatgggtttctctacaacctgcatgtataagcctctaaggtggcaatataaaataagtagcctttcttataataatattattaaaagttattttttcctaatatattattattttacgattcatgttggctaggtcttttccttaaaaagaagcgctatataatatatgtatatttgatcaattaaaaagagggctagcaggatggtaaaaaaattaaatttacaagcaataaaagtttctcgagtcttcttaaggaaaaaaaacttaacaatgaacattcaattaaaaatgaaaaataccctattttactttcaacttactttgttagaagtattttcgaaataaaataatatggatgcccgttagaagtattttcgaaataaaataatatggatgcccgcgcggatgcgcgggctaccttcttagttatatgctaattgtctttcacttaaattggcgggtccaatattataaaccattagattcgattaatctgaaaacaaaccatacactacatgaacggtaccacctatcctccttccccgtaggaaatagaatccaacttttaatctacccttaatttagttgtcacccccatcatgagttcgttagaagattcaatcacaggaactttgagtcccttgctcttagcgattttcacttgtaaccatattgcaaggtatatgtgcagatggtatgcatgataattagctaggagtagtttattactttgttgatacaaaagcaattcaaaacagttatcaaattagtctttcttttattcaaaagtcgatgaatggttttttatatatattaagaaaaatatataacccatgaatcattttaaaatgacattgtccaatcttcagtttgcccttaacctatatataggagataattggatcacacacctgggtccttgatttgtttctcaaatctttctacccaatgatcagactacctagctagctcctcttcttgatctttgtcttcttaacatctgttacgagcaaagcgatcacctgtttgttcacaaaaatcgtttgatcaacatgaatagagattaggaaagaaagaagagtacagatagagtaccaaatttgtctcccgaattcaaacaaaaagaactaacagaaatttggaagagtacaacccccaatttcagttacttcttttcctaggtagaatgaagggctgatgaactcgcttttggg

SEQ ID NO: 48196 - DNA, 454 bp, Oryza sativa
  unsure (1)..(454): unsure at all n locations
agagtttgaacgccagctggnnnnnnnnnnnnnnnnnnnnnnnnnnnnnnnnnnnnnnnnnnnnnnnnnnnnnnnnnnnnnncttggggataagacgacgtccgtggtggtcagagatcatgcgggatactaaggctagagttgatgtacgtggttgatggagattccatatggcatacgatggagttattgtgtgcgtatgggatgcggagtcgaatttggaagcagtccaaatttggtacgattggttatctaaagtttctttcttgtactagagggtttcctaaggtgtttaggactcctagtatgagtttggttcgtggctttaggctgcctaccttgggtataaatagagggggagcgtgaggcttcccgatatcgtttttgagagcaattgagttgagttttgagttagggtttcgagtttagtcgaaatttttgtaaggagtgctgt

SEQ ID NO: 48197 - DNA, 1501 bp, Oryza sativa
taacaaaggatggcataatagggtttcatttgcaaaagcagcatttagcaaacatttgagaatttaataaaacagttaggtaattaagcaatattaatccaacactatacaacataccctgttgtataggcccaaccattctgaacaaccataccggctgtacagttctatctccaaaccaggaatataccattccaaaccaggagctaatcaaattattaccaattatagcatcatttactatggtgagaagggtgagactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgctccgcaatgaactatgctatacaaaagataaagccgttgcccatgctggcttgtgattggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcatgaaaccatcatgaaatattagtgagtcattagttatcccgaatgtgtgctaatgtttctaagcatggctaagcaactataaacaacatctagctgaaccaatccaatatataaggtccatgctagtcaaattataacccataggaaaataaagtcatcttcggccataattaaatgggaaaggttcaccacccaatgacattcgaaaacaatgcataagttgaaaacaaaacaatagctttaaacgggttcaacatgctcaaagggttgtttgggatctgtgtgacttgccttgctggccttggaattcttcaaactcttctccggcgaaaacggactctccggaaacgacggaatctaagcagaaaagagcaaaatcaccaaaacagcacataaacaagcatgaacagtacatatggatatttttaatgtgtagatctcaattttagaaaaatttagagacttgaaccaaataaatcggagctaagatgaattagttatgaatttttaaagattaaatcggattaaaacacttaaatcggttaaaattgaattatgacgcaataatgaattatttttgaaaaggaaaaggggatttattgcgtcagcgggctagggtttggtggaccgggcgcacgggcggcggttcacgcgaacggacggccgagatcaaaccaatccaagatggacggccgagatcgatcgggtccacggcggctcacgacgaacggtcccga

SEQ ID NO: 48198 - DNA, 589 bp, Oryza sativa
tttgttcctgcgtgttatatggagtttattagagtaaaagcttttttttttccgttggtcgtgtagacgctgcagcttcggaagatccgctcttcgtggaagtagaagccgacgtttgggaaagcgagcaaggcaagtcacatcatccttgaacatattggatcccagtttgtaaaattatgttgatttaaattattgcattatcgctttatttaaattcccgcgttatcactgttttatttagccatgcctatttacctttgttatgaccatattattattgctattgttattattaccttgttcaccctagaataaataaaaccccaactagtgggtactctattcatggttccactagtatgaatttaggtagatgcttcgctgattaattaggcaacattaggtggttttataactttagactttgggaattctcatatcatttggatactatggaatgtttggcttatggtggaattggacatacccctctcttcctctttcaaagcccctaaaacctgttttcggtggggtttgggtgcatgccagttgtgggaagtagcaccccggccactataaggattaa

SEQ ID NO: 48199 - DNA, 1501 bp, Oryza sativa
ttattaaaattaggaattgagttccgaaaaatccgagaaaattccagagagtataattaaccatggagaatttaataaaacttaaatccagccatgctttgtatttaggaaattttatttcccacatttaacttcacttgtaaattaatgaacatttaatataaattataataataatttattaaataatttataaatcctaagacgaaaataaggatgtgacagtgggcctagtgggggtgcgcgcgtggggcaaggggaagcgaccgattttccccctcccctggtcgaccgatcctaagaattttcgcttactttattatccaaagtactttaagtataacttttctttttttatatttgcacaaattttttgaataagacgagtggtcaaacgttacaagaaaatagtgaatatccgttatattaggggacagaggtgatatgtattttaaaaacgaagatagtataatataaaacagagggaatagtaaacaacacataacaaatgactaaatatcttgtcaatcattaaatagtattaagaaaaagattttatatttattccgatcaaacttcttccctactagcctggaaattcttctaagataaaaggaaatggttcagttctcgaaggcccattcgttctccttgcggatctcctcctcctcctctggtgtgaagtcgttgacgatcccgaacgtgtccctgatctcctgtaccgtcttgcccttgatcaagtcagccgtgtgttgacacgcaagatcaagtagagacggtacgttcaagtagttggcggccaagatcaggccgaacagcatcgtgttgtcgacatcgatgaagctggcatcgaagctcttcagctcctgatccttcacggcgacgtcctcggcagcggcggcggcggcggcggcgtgtttcttgcagtagtcgagcaccttggcgaggacgttggaggcgacgttggggagagggacgccgttctccgtgcagtcgtcctcgatcatgttgctcactagcttcgacatgctcgcctccgcctccgtcacctggaagtgctgcccgtccgagctgatcagaaggatcttgctgtcgccggcgtcggctccgtcgtttgctgccgccattgatgttggtttgtttctcgtcgaacacgcggggccgggggattgctgttgagcttgaacacggacggacgggacgaactcgctcgctagttgcgcggtgagctcaactgttgaaacgacgtttattggtgcttggcgagctgtttggtgctctttgtatttattgcgagaaccaggccgagcaactccgattcgtactccaaatccaatctgattctaattagttttcgattgcttctgcgttactttgccataacgccaacacagcttaattagctactcctactcagtttaatcgtacccctgtaggagttatttttggagagattaattaattagtttgttttctttcggtatatcttatcttattttaa

SEQ ID NO: 48200 - DNA, 918 bp, Oryza sativa
ccgggccggcccacggcgccccgacgctgccgccactgcacgccactgtcgcgcgcgcccgatacgtggacgacctttgaacgaacgcgaacgaacatgcacgaaacgcgaacgaacatgcacgaaatgcaaacgagcatgaatgatatgattacgaaacattaacaaacgcggacgaacgtaatgaaacgttaacgaacgcgaacgaacgtgaacgatacgatcacgaaacgcgaacgaatgtgcacgaaacgcttacaaacgtgaatgcacttgtactaaaagtgttagaacgaacgtgtttctacttatacgatttactggtaatacatatatgattatatatgtaacttggcccgtttagactaatacatttcctggtaatgttgcagagaagacgtcggcgtcgtccctcaagccgaagtggtagctagccatcgaaggaatttgcgcaggcaagtgatgtaattaaataagtgattgttagagatttaatataagattgttagacttagcatatataaatgattattacaattttaatatgagattagtagccatttaatataagattattagacttagcatatatatatatatatatatatatatatatatatatatatatatatatgactattacaattctaatataagattattagacttagcatatatatatatatgactattacaattgtaatataagattattagagattaaatataagattgttggagatttaatatacgattgttagacttagcatatataaatgattattacaattttaatatgagattagtagccatttaatataagattataagagatttaatataagattagcagagtttcaatattacggttagcaaatacatcctatatacctaacaaatattttttgtatgcataga

SEQ ID NO: 48201 - DNA, 1501 bp, Oryza sativa
ctcctctcgaactttatctccttctgtagaatcctccgcctccgcttctctctctcgtcgctctctccgtctttaccgtctctccttcgccactccccagcggcggcgcgccttctccctctcccagcgacggcagcgcgccatccactcccttcctcccagatccgactggatgaggggagggcagcggcgtggaggcggcgctcccctccccttactttctccccgctcctggatcaggctgtaggaggggagcgatggtgggggcagccaccgcatgcgacggaggtggcgctcctccctccctagctcccagatccggctggaggagggagcgatagtggcaaaggcggcgctccctcccctccctcccagatctggccgaagggggagggcagcatcggctctagcgacggtggcgcgccttctccactctccgactcctcggcgagcagcaggtgcgacgatcttaccatggatgagcagcgggagcggcggtggcctcggcctcaactagcaacaggagtgacaccgtccagtggcattggggcagcgggagcgacgtcctctaccttgacaagcagcgggagcggcagcatccacgtccttagctagcaacaggagtgacgctgtccagtggcgtcggagcagcgggaacagtatcgtcttcgtcctcgacgagcaaggaggagcgggagcggcgatagactcggcctcaggcccagcggcagtggcggtgtccccgacgagcagtggcctcgacatctggcgagctcagcattctgttagtatttaatttgttgtgatttcattgatgtagacattgttctttgattagtcttttttgctcgtcaacttttttttctggaaccgagttggacccaatgaactatatggactaacaaaaatttgtttggaagcatacctagggcgatttttgatttttgatttttggatttgtttttgtctgttctttttctgatattttctgatctgattgtcatggagacggataacgcgtacgcgggctcacatattacggacgaaaatcgtgtgtgaatgatgtgacgaaaggaaaaatacgaatagttatataagattaaaataagataagatataccgaaagaaaacaaactaattaattaatctctccaaaaataactcctacaggggtacgattaaactgagtaggagtagctaattaagctgtgttggcgttatggcaaagtaacgcagaagcaatcgaaaactaattagaatcagattggatttggagtacgaatcggagttgctcggcctggttctcgcaataaatacaaagagcaccaaacagctcgccaagcaccaataaacgtcgtttcaacagttgagctcaccgcgcaactagcgagcgagttcgtcccgtccgtccgtgttcaagctcaacagcaatcccccggccccgcgtgttcgacgagaaacaaaccaacatcaatggcggcagcaaacgacggagccgacg

SEQ ID NO: 48202 - DNA, 704 bp, Oryza sativa
cctctgatcagagtataatctattcgaatagccgcgccctcggttatgggcaagccaagcaatgtacccaggttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcctgagggttcacggccttgattaataattttgtgtagctctagggtcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctctatctttctcccccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaaatattatcgatgtaataaagatgtgtcttttatatcatgtttgtttggtgtacccctgcttttcctgggacggggattaatacattagcgttcgggaaaatgcaattttctcggtcgcgacagc

SEQ ID NO: 48203 - DNA, 157 bp, Oryza sativa
gcatctattaatgtatacaaaaaatttgtctatattttttattcatatctactcggcttcaaatattttcccagtatattgagatcgtgttcctttgctggaggagttgggaacacatctggcagatgatggcgtactgtacaaaacaagaagacaa

SEQ ID NO: 48204 - DNA, 1501 bp, Oryza sativa
gtcaaaagccaagatgtaaaaggctaattagtagtattatgttttattcatggattcatctaagtttagaagtccatgttgcaagtcgacaatgaactgttcaaaagtagggttgtagtgttaaaaggagggttgatgaccaaagtaatcaatagaggtgtagcaaaaaaaaaaagagaaagataagataatatgccacttggagttgtccatttcaatccatatattcaactcaccagtcagcttcaatgccgagtcaaacctttccaatataagagtgtcatgacccgagagggaaatacccgacaatccttgatgatgaagaattatggtgttgaagttcctccacatgctccacttgaacgcttagcacttgcagcacaagtatggtcttgtagtttgcggtatcgatgactcctaaaatctccccatcatcaatttccatctcaggaacattggtttcacatagaaggttagcagcaagagaatattcttgctcaacatcactagaacttgcatatccaccatcatccgtagcgatgtatgcatgctgacttgtacaatccttcatgacatgtcacatacccttgcattggtgtcgtatgatccgattgtttgccccgtagaagctactgacgaggtacttttcgtgggtacctacactttagtagacttgtaaaatcaaagatgtttttgattattattctgtgatgaacaattgggcattggatattattggttttattatttggaatttattcacgaagtggttttggagatgattggatttcataggtgaatatacaggtagtgctggatttgggtccggtcagaccgggcacgggttgccggtcggaccggcgtgtattgcgcggtcagaccggcgcagcccactgtctgaccggccgacgctgtgtcggtttcagtttcgggttgtttatttggatatccatgattatttcataattatgacttctagatggatactatacgtatgtaatactattgtttgctgctaatgagtcaagttggagatagcttggtctcggaatatggtttctttgtttgttccatgtgtaggtgattcgatgtctctggagagtatttgcggtgatggaccgggagtcggcttggggataagacgacgtccgtggtggtcagagatcatgcgggatactaaggctagagttgatgtacgtggttgatggagattccatatggcatacgatggagttattgtgtgcgtatgggatgcggagtcgaatttggaagcagtccaaatttggtacgattggttatctaaagtttctttcttgtactagagggtttcctaaggtgtttaggactcctagtatgagtttggttcgtggctttaggctgcctaccttgggtataaatagagggggagcgtgaggcttcccgatatcgtttttgagagcaattgagttgagttttgagttagggtttcgagtttagtcgaaatttttgtaaggagtgctgt

SEQ ID NO: 48205 - DNA, 1501 bp, Oryza sativa
tacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttctccgaggagtaggcttcgtccgtgccgtcgaggatgcctgtggagtggtgttcccgctgccgttcaagtcaaggcttagctccagtttcttttgtttttccgctgcatttctgtcagacctttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaaaacctaagagccctctgaatcctttttcattgcatatgttcttcgcaattggatttgttccgggaaaatggggatctgttcttgtggttcaagggaaaaatcttggtcgctcgtttaaagtgagtttttcaaaacgagtcagtctagggttttagtaaattattgggatttattcgtcagtcagttgggatttgatgggtgaaatgcattcggtcctagctcggtatcatgggttgcaaggtatttatgctttgttcgttattattattatgtatctaatttcccattattttatcgttatgtgagtctgtcttatttattcgcgctcatgtaaaatgatctatgcataaaattttgctcttatttgattcctttatttgagtcctttattgctttatttaaatttggatttgagcatgcattgatcctactcctttgtcttctctagatggccggtcacccacccaaccaccgcggagaaggcatgatcgacttcgtggcagagctggcacgca

SEQ ID NO: 48206 - DNA, 207 bp, Oryza sativa
tcttgagctagagatttctgtgggacataaaaaacaagagagaattcatcaggcaagatgattataagaaggtacaattaaacacattaagcgaataaaatgagtcagtgaattaaaaaaaaacaggttaaccttaatcccagtgctgtgggccataagtttatccttgggatcttccgcttgctcaaattacaaatgcacttcagg

SEQ ID NO: 48207 - DNA, 1501 bp, Oryza sativa
tgtacatgctcttagtcaagggacagcttgtcattggataaagaaaaagacccaaactcgggtatttgttgaagtcatgagacatgtgacagctcaccaataatcatctcaaaacaagggacaagcaataaaacaagtgtgacaaactgacaatatgcatgtgacacacggacacacggtatacaatgcattgcttcttttctttaatgtcctcaagcatgtgcatcaccatatttcgttaagagtagttaatggtgttaaaatttaaatatgtcgttacatatttaccctcaatcttttttaaggctttcgattctacctatatatgttttgacatgaattttgcccctgttaaaacatcaattttactcattccatttagtaaataaggacaagcataagcttgacatgaattttaacactaataaatactccttccgtttctaaatattcgataacgttaactttttaccatatatttgattgttcgtcttattcaaaaacttttgtgaaatatataaaactatatgtatacatataattatatttaacaatgaatcaaataatagaaaaattaataattacttaaattttttgaataagatgaaccgtcaaacatatttaaaaaagtcaacggcatcaaatatttagaaacggagggagtactcttaacaaaaatgagaataattataagcttcagttaaagaattaaggggaaaattataattgagtttgaaaacagggtaagaacgcagatgcacccttttatagagatagtagcaacgatccctaatttgtacccttctgaatctccaaatattaaccacagcataaactatcaacccacatcaatgcaactgggactgcagcacaaataggcccatcacccagccaccctcctcacgccgtgcaaccacacgatagaatcgctcgccttagacacatcgcgcgcaagtgcaccactaacacgcgagagcccatcacgcacggcgacaccaccctgcacgcacaaaccccatacccatacggcgaagaacgaacttgctactccaaggatatgaatacgagccggctatgttctttaccacatcacagagtgcattcttctatctgattgtgctaatttatgtgccaccttatttgtatcctctgctgaattgacatagtcttacctccggtcacaaacatattaagtgaattgatactactcccttcgtaccaaaatatactagcaacgtgtcctcattcaaattcttagtactagctggtatctaatttactactccctccatccaaaaaaaaaaacaatcctgggtttaaatctgaacacggtttgaatctggacacacattatatccagattcaaacctaggattgggttttttttggacgaagggagtacagagtaatactactagggctgtgtttagttggatccaaagtttgtattttggttgagattagagatgatgtgactgaaaaattatgtgtgtatgacaga

SEQ ID NO: 48208 - DNA, 1501 bp, Oryza sativa
  unsure (1)..(1501): unsure at all n locations
gaaagcatttcatcagcttcatcaaggacaaacatcttgatgtaatcaggacggagggactgcctacgcagcatgtcaaacacacgaccaggtgttccaacaacaacatgcactccacttgcaagaatcctttggtcctcacgaacagaagtacctccaacacaagcatgaaccttcacacccagatagtcaccaagtgcgcgcatgactttctcaatttgctgtgcaagctcacgagtaggagcaaggaccaaggcctggcactcaaccacagcatagtcaagttgctgcaaaattccagaacagaaggtggcagtctttnnnnnnnnnnnnnnnnnnnnntgaatcacatcaagacccttgcagaaagggacaatacccctttgctgaatggctgaaggcttctcgaaacctataaaacaaaaaaaaaggtctgatgaataacagttcaaatggcaaacacacaaaaaaaaagcacgaaagattataaacctaccataggcatagatgcctctgagaaggttctcttggagacccatgtcatcaaaactctcatgaacttcatcataagatgtgaagaactcctcggtttcaccttggttcctgcattaaaagactacccagtaagcggtagatcctgtacaggaaatagacagacattgccgtacacaatgatggctgagataaaacgtatcagtataagattccttacagaagctcctgcattttagaatcatagtgcttagcatcaaactgggatccctctggtgccattcccgccatgactgtggtaataagataatatgttagccaaaagaacagaaagtaggacagaggagaacatgcgtgatggagatatctgctagttccagttagcaacaagataagcgcataacagaaaagtaaattaactaggcacatgaactgggaaaacaaagcaatatatgaagaagatacatcgcaaacggtatgggtgatgtttcacagagctacatattacacatttgttctacatattaaataacatcacttgcttgaaaaatacattacagctgaacatcaactataaccatgcacattctaaagacttagattatgccactacatgaaactaggagcataacatcagttccctagccatacaaccgactatattaacaataattactatttgacacttaacgtaaaaacagaagcaagaggttatccgcaggcaacaacacattcaattaaagcattcaatcccatgcttttagattgctacctagaacaaatacgtctactcaagcattcattgcaagtagcataacatcattaataagctggacatggcgtcctaagattctgccacgtaacaaatgcataatcgcagcaaggtgacaatatacaatacaccccacactaacccttatagcttcaacaccaaaaaccggcacgagccacagcaccaatagatagaactcgactctgcgagcttgctaccttcacaataatattttaa

SEQ ID NO: 48209 - DNA, 1501 bp, Oryza sativa
ttgtatttgctcttaagaaaaagtaatagcaatatataattctcatacagagaaccatatagagtggagagacacccaaaaaagaaaaataaaataacaagaggcaggctaggaggaatccttgtttgagacggcccacggcccatcgaggcccacagtcggagaaaccctaccgcgtcctctccctcccttaaaaggcgcctctcgccgccgtcgccgaaaccctcttgtttctctctcctgctccccccccaacgccgccgccaccgccgccgccgccgccgccgaatccgagacccccatctcggattcacctctcccgcctccggcctccgtcaccgtctccccacgcgcgtcaggtcgagatcccccacccctcccaccccccgatgattctgttgctcttttccgctccggctcgtcccgatctgtgcgctttttttttttttgggttgctcgtgagatgtcgcgtggatctggctctcgcgcttgggctggatctgtggtagtgataaacaggtctagccgtagcttgtgcgcggtggaggcgaactctaggtttaggtttaggtttttgtttcctggaggaaaagttgggtggatttttttttctattattattatgtttgatgctgtagtggtcttagtttggtagattcttgggtttgtaggatgctcagtgtttgtatttttgtctgagatgattgtgggggattcgtcatgctcagttctgtgcttagtgatgctatactagatgttttttttgtcactgtttatgtttattaaaatattattgtgaaggtagcaagctcgcagagtcgagttctatctattggtgctgtggctcgtgccggtttttggtgttgaagctataagggttagtgtggggtgtattgtatattgtcaccttgctgcgattatgcatttgttacgtggcagaatcttaggacgccatgtccagcttattaatgatgttatgctacttgcaatgaatgcttgagtagacgtatttgttctaggtagcaatctaaaagcatgggattgaatgctttaattgaatgtgttgttgcctgcggataacctcttgcttctgtttttacgttaagtgtcaaatagtaattattgttaatatagtcggttgtatggctagggaactgatgttatgctcctagtttcatgtagtggcataatctaagtctttagaatgtgcatggttatagttgatgttcagctgtaatgtatttttcaagcaagtgatgttatttaatatgtagaacaaatgtgtaatatgtagctctgtgaaacatcacccataccgtttgcgatgtatcttcttcatatattgctttgttttcccagttcatgtgcctagttaatttacttttctgttatgcgcttatcttgttgctaactggaactagcagatatctccatcacgcatgttctcctctgtcctactttctgttcttttggctaacatattatcttattaccacagtca

SEQ ID NO: 48210 - DNA, 1501 bp, Oryza sativa
tttggtaggaaaggtgttgccattaactttgtgacccgtgacgatgagaggatgctgtttgacatccagaggttctacaatgtggtgattgaggagctgccggccaacgtcgctgaccttctgtgatcaagttcagaagagttatgttaaggggcctgataaggattgtttttgtctgaagtatcactgtcttatctggggggggggggagtgataaaggtgggggttctgttttaaaagtcactgtggtcgtagacaatttccaaatttttatgccatgttatgggaatttttgtagttgctaggctgtgctatgtgctggtgaggagggaggagtcttttacttttattatatctattgttaaaactatgtatgaccgaatgatgttatttatttgtgtcatggttgactatttgccatatgtattctgccaccggtcctgctactgccactggtatctcgagtgaaaactgtttgctcctcggtgcaataagccagataacatgtcacctaccggaatgccgttgatgtctagtgatgttttatctgttgatatgcatgtttggttggatacttgcctggacgattataataattttttgagatgttggcttcattttggtgagtgaaaacattggccagttctcttcacaagggaaacaggttttctgtccatatttcgactgaaatggtacaccgtcaatcgcttgctgtaatctgaagcattgtaaattattggaagcatagatgtcaaggtacaggtaatctgtatcctgttagatcagcgccatctctacattctactctgtaaataaatggttgcatgagttgaggtcccagtaatagctgagaaacggaaataatagtaactgactcttttttactcatcatcgctgccaaatgaactgacgaaagtatccggaattttagttagttttctgaacatttctcaatcttagctagatgggaaaattgacctttagtttttctgcacctacctatcatcactgctaaatggagagacgctaaccatgaaaacatccaaacatttagcttgttggaaaattcaccttaacttttctgcactcgtagaacattcagcataccctgccaaatggagcaagctaaccatgaaaggcatccagaatttcagcagtttttctccctgaatttctgaatcttagctagtttggattcaccttagcttttctacaccaccagaatttttcccctccaacttaacaacatttggatgacctccttcggtcatcccgacaaaaaaacaccaccagaatttccaatgtattatcctagagtcccgctccggtgctttctacttggaatagaaagcaatctgagccgttcatcatatttaattgtagggttgtgatctatttctactcccaccagagttagtggtagtagaaatgtgcaagggtatattcgttcagggataataattcgtgcaggggtattatcataatttatcagtatctaact

SEQ ID NO: 48211 - DNA, 1281 bp, Oryza sativa
tagatctcgccaagaactcggtaatcccaagccctgggtgagtgagatccagcttcgcaagaaggtgataagagtgattctgctcttgctacgcttgtcagttaaaggccccttttttttgggtttttgggtggtttctgcttgatgcggagatgggaaaggagggatttttagggcctctctcctgtgattcttgcctgcgttggtgtgattatgggtgttgtgtgtttgtgttcttgcgaggatttgtgatttgggagtgttgctaatattgtggagttgggggttttttggtgaggcaagaagggggaaggaacagttttttgttctgttcttgaaattattttctatctttttcttcggttagtgtttctttcaagtagttttagccctttgcttgcgcggaagcacgggaatttactgatttttcagtgaatgcttggaatctttaagtggttttgagaggtttcttgctataaaatacatgtgaacaggaaaaatgtgagatgttaggtttgctttttgttcagattggatagctcgaactagttcggttggtggtaattggtgaggttttaggggtttaagggggttgctttctcatgtgcaaaggggaatgtgggataatcatctgaaacacgcaggcagcgtgcataccttaaaatgcaagttacacatgttttataaaccagcaagaaacaaaagcaaagttgtttgttatatgtgctacatagtgtaagctataggctcaagatttcgtcttactgtggcttaatctgtgggctgaagatctgcaactcttcttgcagagttttctgtgcaatgatcaaaccctagattaatcctttgctttgtctgctagaacattagtcaatggtcaatgacagttttaggcatacattttcttccttttcacctaaggaataaggtctgctctcgaaaacaaaggagttgcatcttattcatctgagtcaccacaacttctgtaaaagaaccttgttccattatcgagcatatgcccataactttcatagaaagaaacacgagaattatagacaaatgctgagttgacatcatttttaggattaaagctgtttcataatctatacatttcccttatcattcggtccatattgttaaccagaatatgaaaaatgctgattgaaatcattaagctgcaattctcattccccatgtttttcaggttttgggggttcttgggcagttctgccaggagagtgacactggatgattgcataaatgaagcttgctgaatgtaga

SEQ ID NO: 48212 - DNA, 1501 bp, Oryza sativa
atcggcgtcactcatacgtgcaaaaccactttaaactattttttctcttaaattacttatccaaatcatgatccgattgcaccattaactttcttgcaattaaatcttcaaaacaagatcacacatacatatattccgatgaaaaaaaattagcttattattgtattatttttaaatgttgcacgatgtttcaccaagtatatcggaattttcactaagtagatcgaaaatatttcaatcgtttaaatcgggtgttgtttcaccttatataaaaacaatgaaacaatgtttcagcaaatagcgaaaaaaaatttcatttcgctgcaacattaaatctatatatagtgaaacattctgagtagactaggtgaaacatttatggtggaacaaaaaatgaaacgaattccccgaattcccttaatagagggtttccaaaatatatgggtgatttgttgcaaaagaatgtcccgttcactgtaacattagatctatacatagtgaaacattgtgagtacattaggtgaaacattttttgtgcaacaaaaaatgaaacgaattcccttaatagagggtttcaaaaatatgtgggtgatctgttgtaaaagaatattttaatccactgcaatattagatctatacatagtgaaacattgtaagtaactaggtgaaacattttttacggaacaaggggagggacaggtgtgtgggtgtcacgcctccgaacttatttgtgcataaaatcctcgtccaggaatcagccgaggtacacaaactgacaattaaatatacaaatccatcataataacatcgttacaacttacaaaagaaaagaaaaacaacagcggaattaacggtctagcgatggcttcagctccacttccacaggcagatcaattagggtataaaccaaatgtcttctccttctggatcatttttcttcaactgaggttgattaattattgcaaggtgagtacatgaaatactccgcaagccacacagcaaatatgcaagtgcacaaagataccaaaggatggcataatataagtttatttgcaaaagcagcatttagctaacatttgggagtagtaaaacaataaagtaattaatcatcaatattaatcaatcactgaacagcacacccatgctgcttaggcccaaccatcctgaacaaccatagccggctatacagatctaactccaaaccaggagctaagcaaattattaccagttatagaatcaataattattgtgagaggtatgagactaatcacgaaaaacattgctcaactcacccatgaccgcggggacgtctattcgaatagttttactctggccagagttgtatcactgtacccacaagatagcctcaacatcatgtctaccatgtgtcgcgatactgcaaagtacccgaatagaggctatgacaacaccctctacacaacacaactcaccacactgcaccgttcctagatcataatcaccccctcaataaccagaggca

SEQ ID NO: 48213 - DNA, 503 bp, Oryza sativa
tactaaccgggactaaatatcatagggccctgacacagcctgacatggaatcaaccgggactaaagatgaactttagtcccggttggaaactccaaccgggactaaagatgatttttagtcccggttggtaacaacaaccggggactaaagatcttcctcttattaaccgggactaaaaatcatttttagtcccggtttttaatggaaccgggactattgtggatatgggtcaaccgaccaaagatggtttctctaccagtggaatcataataggaaacggaaggagcggagtacctacttagcacttttatgattcagccatttaggtgcacttaggtggtttatgcattcttaatcactcggtgcattagttgcttgctttgtaatagtgttcgagtcacggttattttatttttattttgctaagtctgggtttagaataaatcaagtctcggtttaagcttcgtcgatcgatttgattgtttgctcttcctggattagg

SEQ ID NO: 48214 - DNA, 227 bp, Oryza sativa
ttggcagttgagacccttattatggacatttattgccatttggaggaaacgtcatggattgcggggtgatttcagataagttcttcccgtggtgacatgtgggacaagggcacagataattgatgctgaattgtagagatcttatttatggaaaatataaggaagatatgcctttcgcgtaatatgagggcacaatctgacccttggttttcgattatctacttagg

SEQ ID NO: 48215 - DNA, 987 bp, Oryza sativa
acctatgtgcttgttaagatgttgcattataaatcgtatgaaatcatgaattttgattgttgattcaagcttaattgtaaaatctttgattcatggttatactttaatgcatgcttgttctgttatagatggattaatcttctttttattgcaacacatgacttgatatgctatatgtatgctaagctcttgaacattaatgaatataattcctatgcttgatgaaatcattgtcaaaagggggagaagtaatgtgaaaatttttggatttttttttgagaagcaaggtgattttttggagagttgaagagcatgtttttttgttcaattgggtatttctttcttttcaaaagggggagaagtttttttttggatttttgagcacgatgtgaacatttgtacgaagtgtgctttttaccaccaaataccaaaacatttttgtgagtttgccaatgtgttcatcaagggggagattgtaaaaccaaaggtgtttttgattattactctgtgatgaacaattgggcattggagattattggttttgttatttggaatttattcacgaagtggttttgaagatgattggatttcacaggtgaatctgcaggatttaatgtggaccggtcagaccgggctttggtagccggtcagaccggcgtgtaatgcccggtcagaccggcgcagcccgcggtctgaccggccgacactgtgtcggtttcggtttcgggttgtttatttggatatccgagtttattccatgattatgagttctagatggatactatacgtatgtaatactattgtttgctactaatgagtcaagttggagatagcttggtctcggaatatggtttttttgtttgttccatgtgtaggtgactcgatgtctcgggagagtatttgcggtgatggaccgggagtcggcttggggataagacgacgtccgtggtgatcagagatcatgcgggatacttaggctagagttga

SEQ ID NO: 48216 - DNA, 601 bp, Oryza sativa
tttaccaggattgtacagtcctaatgtatgccttaagtttatttttgttttggtctttttgggcaagtgacaattgtatttattctcagaaacaaagttgtctggcatgatattatgagttttgataatatttcctaaagtagcggaaaatttaaaacactacaaccctccaggatggaccctggaaatttgtgatttgtgcatctcacaaatggtggttcttcctacttttgatttttcatcagtcaagtattcaacaataggcaccactttgcaaatggtgtctgcatttgatggttaattgactaattcttatagttgattcccctgaaatatgctgattagatcgcttcgttaagatcgtaccttttaattgtgcttatcagctgctattgttttttctgatattcctgtagattgtagctgcataatattttattccgttgtggccaacagtattttttttcttgactaacatacactgttcggcacttctatttcttgactaacatgctattcgccatggtcacagtgatgctttatttagtgtgtgtgaaagacatgaagacatatttggttatgtaactcttgatcttgcatg

SEQ ID NO: 48217 - DNA, 220 bp, Oryza sativa
taaatttggtaatttcatggatttcattggattttatgtaggcttattatttattattgtgttgtgaattgtcacatgattcctgatattcttttcctgaaacttcagtagtattttcatatttcaaaaataaattcaacacattgcatttctggtgttgtagtatcatctgcataatatttttctataggagttttaatttttttatattatttacagg

SEQ ID NO: 48218 - DNA, 429 bp, Oryza sativa
taatagatgtatagtactaataagacaggaataataaataaattttgaatgagaacaattaaagggactataactgcatgtgccattagcttggtttaattaaaagagagagaggagaacagttctactttttcaatatttttagagggcttctatgggtaaccatttggcataacctagggtcaaggaggctctcataccaacttgtcacgcccggaatttctatccaaaattccaaatgcttatatgtgtgtaaaccctcgtccaggaatcagccgaggcacacaataacaaattgataatagagtaaaattattactctaattaataaagcgaatataatgtcattacagaggtagatagttcctctcaaccaataaagatctaagcaacggaaaataaaataaacggcgcagacgactccatccc

SEQ ID NO: 48219 - DNA, 810 bp, Oryza sativa
acaacccaccattatcatgttttagttggcacatgaattaattaaccaatcacgattgaccatcgtgaactataattaagccatcattaaataatagtgaatcataagtatcccctttatatgagctagtgtctctaagcatggctaagcatcctattcactttagctaaaaccatataatgttctagctaatccaattattaaccaagtgacaaagaatagataatcaatatcaaaagggctatacaaaggcaataggttattcccacccagtgacaatcaaaaataaatgcaatagttgaatagaaacaatagctttaaacgggatcaacatgctcaaagggttgtttgggatctatgtgacttgccttgctggccttggaactcttcaaagtcttctcctgcaaaatcggactctccgagaacgtcggaatctaagcagaaaagagcaaaatcaccaaaacagcacataaacaagcatgaacagtacatgtggatatttttaacatgtagatctcaattttagaaaaatttagaaacttaaaccaactaaaaccgagctaagatgaattagttatgaatttttaaagattaaatcggattaaatcatttatatagattttaattgaattatgacgcaataatgaattatttttgaaaagaaaaaaggtattgcgtcagcggcgcgggttcacggtggaccgggtgcacggcgacggtctacaaaaacgaacggccgagatctaatcgattcaaaacgaacggccgagatcgatctaatccatcgcggtccacgggaaacggcgtcga

SEQ ID NO: 48220 - DNA, 872 bp, Oryza sativa
  unsure (1)..(872): unsure at all n locations
aatctatatacaatgatttaatccgatttaatctttaaaaattcataactaattcatcttagctcgggtttagttgggtcaagctttctaattttttctaaaattgaggatctacatgttaaaaatatccacatggtattgttcatggcttggtttatgtggctgttttgggggattttggctcttttctggcttaggattccggacgttcccgggggaggtccgattttgcaaggagaagactttggaaggagttataagcggctagcaaggncaaggtcatatcaggattctccataacaaccctttgaggcatggttggattcctcgtttaaaggctttattatttctattcaacctattgcgatttcattttctggaatgtctactggggtggggaataacccctattggctttgtatagcccttttgatattgattatctattctttgtcacttggttaataattggattagctagaacattatatggttttagctaaagtgaataggatgcttagccatgcttagagacactagctcatataaaggggatacttatgattcactattatttaatgatggcttaattatagttcacgatggtcaatcgtgattggttaattaattcatgtgccaactaaaacatgataatggtgggttgtgagcgcatggttttgatggtcgtgctcatgacaattaaggaccggttcacgattttcggttgtaaaacattaaccgtgccaaccacaagccagcatgggcaacgactttactttctgtatagtatggttgatagtagagcacgagactgtgaagtggctgagataagcccacgagggtcgttggggagttcatgccttgtttacaag

SEQ ID NO: 48221 - DNA, 1431 bp, Oryza sativa
ccctcccagagggcggtaggcgactatttccgtcaattttcaaaatggaaaattatttttgtaaaacttttaataaaaaaattataaataaaaaaaattctctcaattagtctgaaggcaacagtgttttctggcagatgaaaagcaaataaaatagtactacctctatattttaatgtatgatgccgttgactttttatccgacgtttgactattcgtcttattcaaaaaatttatacaattatcatttattttattgtgactcgattcatcatcaaatgttctttaagcatgatataaatactttcatatttgcacgaaaattttgaataaaacgaatgatcaaacgttggtcgtatagtcaacggcgtcatacattaaaatacacggagggagggagtatatgacagtatatataacacaattcaagtttaaaattcaaacatgtacctgctagctacctgtcctcaattttctattcttttatatggacagatataggtcatggagagggtagtaatcccaagatcacacaaatcattacacttttgctgatgaacaccagagtgatccaagaaagaggagcatatgcaagcaaagccaaaggacatgagggcatgcactgctgtcaaagtgccaatcatcatggagaagctgctctctgcttaacctagatctacccatctgctattgtggccataaagccgggaatgcgcatgattttgtagacaaaatgcaggcatagtttgaaaaatgtctcgcttgatcctgaaccagctggtgataagcatccacaccaccattttttaaaaaggacaattctatgcttatgaatcggtgatgtttgtgttgcatcaccgacaagccaacacagctctcagatgtgcaatcatgagctgattttttttttttgctttagttaatttttcttgtttactagtaagagttagattatctctataaaaatcgctttactacagcttcttgaatgttccatgtttccgaatttcagagaaaaggctaggattcatgatggcaccacctttcacagaacaatcagatgtgccactgcaatatgcttaactactggtagccatgtatttattccaatcccaaacatgatgcagctttagcacccaagctgtccaattagcatgttccatgaatcgttgtattgaagttgtttaaaatgtactcatgtgctccttgggatttgttcttatgaaaggcctgcactttctcaaccaaatcatcttctttttttatgttttatttggaatattcacaagtactctatcgtctatccttaacactcccaaccatgacactcactatccaaagaattcaagagacgaattagtattaaagttgctagcaccactaggcttcatgtgctgtggctacataattttgtttataattgatttcagg

SEQ ID NO: 48222 - DNA, 529 bp, Oryza sativa
aaaaaaaattaataattatttaaattttttatataagacgaacggtcaaacatatttaaaaaaattaacggcgtcaaatatttaggaacggagggagtatattttaaaacggtgggagtactgttttgtttgcgtgacatgcctcagaaggtgctgggccacactgctgcagaaatgcaggagacaacagctaacagttcatagggagaaaaagtgcagtgtggtagcagaggttgtttcaggcaaccactgatattcctagaaactaattgtgtctatttatctgtatgcactgttaacatcattcagtaatacatatcttgctagatgcatgaatgtgacggatgcaactctgaaataaagatggggcggagatgtttgataaagataatcgagcacaatacataccatatcatatttgtattgaaataggataaataatagaatgtaatcaataaattaagacacaaaaggacattcaacataaaaaaagtagagtacaatttcggagtcgcattgcaaccacagg

SEQ ID NO: 48223 - DNA, 783 bp, Oryza sativa
cggatgggagggagaccggagcctcggccatggccagctccttcctcgccgccaccctggaggaaggcactgtactcgtggaggtgagggaactcctggcccgacgacgcctgggtgttgaggtccagcgtgtccacgccggtgcggggaacggatccgtgggaagggccggacgccgacggctgcgagggccaaatgttgccggcggcggacgaaatgggatcttgggagaagaaatcgaagccgttggggtccatctccgcgcggattcggtgcacagcgatgcgtcgacgacggatctgatggccggcaacgcgggtggggtgagttgccagtgtggatgcctctcggtggatctgaaggaaggggcagcgcgattcgagggagagggcggcgcgggtgaagggccgggcggcggcgtgggtggggggagggggaggagaagctagggccgggcggcggcgcgggtgtggggagggggaggcgaagctgggccgggcggcggcgagggttctagagagtgagcgggggcgacagcgagcgggggcgaaatgcgatgggttttgccgcaacgggatcggcacaagtgggggaaagtgggaatcggtggggcccacagcaaaatagccccaattagcacccggtgggggtgataattttttggggtgggctatttgcaaatagccctaaaatagccctcctgtttggatccccttgagctattttggggttaaaaggggtgggctaaaaaatatccctaggatccaaacaccgccatagaac

SEQ ID NO: 48224 - DNA, 1501 bp, Oryza sativa
gcagatgcagaactgggacttaagagtactatacgattcggtaagagagcaatgctcatgccaaacaaggctgtggtaaattaatgatgtatcaccagacgatggattcggtgatactattatcgtcaatgaaaacattatcttattttctattcattacaaatagttaaatctccttatctcagcattaatgctaatctcaaagtattgatcgtgtaatatctttgaaacggaaacatttgatatgaacctcattggttttgtaaggggaaatacggtcgacctctcattgacaggaataaaagcaattaagtttgatgttatgtaaaactagattataagttctttaatgtaaaattttgtgattatgcacccccaatttttggttttggatgtatagatttagttatgatcaattcttatttacgtgagcattaggctttaatagtgtataaactgggtccatccagtctatgtatacttccgcgcggcaaagccgcggttattttctagtataatcctattgtagattcaccaacccgtcaagacaattattgttcgttgtaagactggcattcaacatgcgttggaacctctcggtaaaggtttgaaccatcctctcgatcgcaacagtcatatctctgttcatagctccacatttgtcttcgagtactttgacaagttcctccctaagcacacagtccttaaattcatcgttggtgcatgtcatggttagtagaaaatagaagataacacaaagatattatccctatcaactactaggtgatgagagaaagacacttgcactcaagcatcttaccacaggcatacacgtagcaagagatgcaaccagtggacagaagaatcacggtaggaagtatagtgctactatgcctttttggtggttatcagttgagttattttatcttggacctccttgcatcattgtacaggaagtacagccattagtaggcatgaaaattcgagctgcattatgtggagattatgggtaccatatacccacagggctacgttaattacctgactggatatcgggggtaactcatagtaacaaaatatgtaaagataaggactcgggtatcatgttaacttgtatatcaagaaagtatctcgtagtcttagtcagttacaattgtaaaatatttatagaacttagaccataagggataaggtcttttatcttgtaatcccgactccttcgcctatataaggaagggtcgggggccccctaagggcagaatcacatccaagatcgttagatcaataccacaatcggcggaattacttctcatcgagaaggcctaaacctgtattacttctcatcgagaaggcctaaacctgtataaatcctttgtctcataacccattcactttcatagcttcttcgccacccccttttgtaatgccgaaatctagtttcgatagttggcgcgccaggtaggggttgcgtcaagtttttcgccgactagtgcgatgggat

SEQ ID NO: 48225 - DNA, 700 bp, Oryza sativa
cctatttgagatagaattgtatttaataaaaccatatctttagttcctataggctatactctcacaaaacaaagttcctgtccatttttagttatggatctataatatagacccgccctaatttctagactttatttaaaaaaaatagtagatacataggtgatagatttgccttgaaccactagatacagtaaatgtagctttggcatggtgcatctctcccgacatggaactcttttttattttataaaggaagcttttattaatctcagacgattacatcaagttgatagaaccatactaagaaaattcccggcctctgcataactaggatgcacacagccaaaacatacaaacccacaaaagagtttgtaacaagagaaggaaagcagtaaaaatcagggagcaccaatcttcaggctagaccgccacccatgtccctggtaaaacattccctgaccacctgctccaaaatcttagcgtttagtttgattttgtttgcgtttatgatcatacagcagtgctcaattggctatggacaaggtcgttggaatattgaggggagcagctggtcttgctgctgacgccaatgcgttccgggaattcttcaactgggtcacaccacacgtcttagctgccgtatgttctcaacagcagcagcaacagcaagtgggttcagcagggacaggatcagcatcag

SEQ ID NO: 48226 - DNA, 1038 bp, Oryza sativa
  unsure (1)..(1038): unsure at all n locations
aggggcctggatgacgtagcnnnnnnnnnnnnnnnnnnnnnnnnnnnnnnnnnnnnnnnnntatatatatatacatgtatatatatatatatacatgtatatatatatacatgtatatatatatatatatacatgtatatatatatatatatacatgtatatatatatatatatacatgtatatatatatatatatatatatatatatatatatatatatatatatatatatgttacttcgcatttatcctaatacattttttttatcttgcagaaaagacatgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 48227 - DNA, 1501 bp, Oryza sativa
tgtatgacaatatagcaattctttagagtataatacccaggattattgaagttccacagcacccgctctaaacatttgtaaaagggaagaaaatgaaaaggcaaagcaacagtttgcaatactttctagaaaaattatgcatattaaagtatacctgtgcaccttttctccaatctctcttaacaatttcaggtagcatatgatcagaatatctgcctgctccatgtggaccaggatcgtcaaaactgaagaaaaagcagttggcgtgtcagtggagaaactataatgtctgttagcaatcatgaatgaaaggggcactggagatcctgaatcaaacatctgttcaactttaagtgtgtctacacatgtaataacattcagggtttaaaggcgtccacttaccagtcaacaaagctgatatttgtttccataagatagctatatacataatcaaagttatgaagtggtacacagctgtaatgagaacaaagtattagggtatggatctaagatatgattaaggataagaacaaaagaaaatgattaacctctcagagagcaagacaaaatgctggttatcaggatcttgcagtgcattagccaaaagcctcctctctgcatcaatcattgaaattgtgccccagactacctacaagaaaagtttctgttgttattgttgggaaccagtttttccagtggataacgggagcttagtgctccttagggcatacgctcttttggtactgtttaaaacctacttgctattatatgttgttttatgaagatttttgtagaatctaaatggaagttacaattaaatttggtttcaaactagaacagaaatcactgccgttgtctaggaaaaatattcaaaaggaatgtttaaccaaggatctgactatgattctgtacctatcagcgattaggcaagacaccaactattttggggggcaaaatgtactagagaaagtgagaaaacgtattgttgcaaaaatgaggtcacctctaaatcaaatctagcaaattaccttttcacttcgaatatctctgccattaaatatcggactagcgtgaacaggcctttctcttgatgcatgtacatatatggtatatctgtcttcatgcccctgaaagtacacccaagtatctggattcagtaccatccacgtgcacctcagcaagtgagcatatcttataactttcatgagattggcatgaagctcttccagaaaataaaacgtgaacaaaaatcaataacatgcattcctgataagaagaaattagtgctacttataattattacataatgcaagattaatcatcaatgagtaaaaagtgcaattaagatctttattacaatagcgtaaatatcataccatgaagaacttttcccaaagcttctcgaatggcaatgaactgggtgtcaagaacatgaaagcaatttttggattctttgactgaactggctgtgccaaaatgatatctcttatgacaatacgag

SEQ ID NO: 48228 - DNA, 1501 bp, Oryza sativa
gagaatctattctgtgtaccactgagttcgttcgagttctcaatgatttgccatcaacattgcctctttgtttaatatactggcgactttataaattgttctacaatataccattaggttgagtcatcttttcaaaaatatccttatgaacatataaggttaataattgatttatctcattaggagtgtaaaaaaacttttatggggcctccttatgcacacaacatggaaatttaaatttgtataggagtttcaacttttttacaattctattttttctaaaaaagatactttataacttatctgttatacagtatataaaaatactttattattattatttttaatataaatcatctttcatacactacagaagatatttttatgctatcatctcatgtataagcaaattctctctcatataccacataataatatttgtttagaaaaaactaaatataccagaaaaaaatttaaaacctatgtacaaacttccatgttgtgtaaggaggccacataaaaattttcatattttttgaaacttataacgagataaatcaattgtttatcttgtatatctctaagggtattttgagtatttttaaaaggaggtccagtctaatgacatatcgtagaacaattgctaaagtcgccagtacatcatagaaagagacaatatcgatggcaaatagttgaactcgaacaaactcggtggtatataatagattctctcaattttttttcccacgcgagggcattcccgttagttattaagcaaatattaaaggtctatcacatctctcatccgcaaattctaaaaacatctttagaatgcatgattcaacactggaacataatcgaaatgtaccaataaaatgttatgcgtgttgaattacggagtgttacagaaaccaaaccatagaaaagtttccaaactaatgtttgaatgatacattagaaaaaacaggcaggaactaaggcataacctcattctttttaataaaactttttatggattggcttattataaactaccagtaacatgccatgtacggattagacaaatataaatatagatacctttttataataagtgtaatagggacaaaacattggatctgatgcatatgcatacttacgcttgtgagcgtgttgcacgcggtgggaggaagagaaacggaagatttccatccaaattaattaatccctatagtggaaatggaaggatttaatttatccctatacaggaggggacacggaaggcagtagagaaattgcgaaataatatatagggatcaatcctttatgccaaaggatttcataggattttttttcttactttacaaatcccaccagatattcttcccttttttctttgtttcaaaggagacctgggattataaatttaatttgttgttttgcacgatgtatgttttacaagcaaaaaggtagatttaatattcaacttttagttttggggcatctacaaatttgctactga

SEQ ID NO: 48229 - DNA, 1501 bp, Oryza sativa
aaacaaggtacggaactagtacgtccaactgccttcgctgcccggacatgtcagcggcgattttctggtgatatatgcttcggtggctcggtggagttgagattctgcagcaatgatggtggggcagcatgatggtttgtgtgcaatgtgatgacggcgtagcgttgtagacttttggcgagataagctacgacagctcaacggaggtggtatcctacgacgatgacatggcggcaatgattgcgttgaagacagtaatctaaaagaaaaatcattttcaagtttgctaaaagggtattatgtacatgcaaatatctcgtgtcatctctccttcatgcatactgctcagtaaggaagcatatataacatgtatataaagagaggatctgacaaaaaggctgcatgcagcaaagtcatagcaagaggttcgattttttttcaagagatcggacgactggattgaagcattttctgcctagctgtctgtctctgcttgcgatcgaacggcctgaaaaaactgacgatggcaagtgtgggtggctgcatgcatgcgcgcgcgcggctagcaacgcggggcgaggtgagccaaccacgccaactccgaccattcctcccgtcgcctccctctcttgacaccatctcaacctccatcccctccatgacttgtgttttgccatcgcgcgcttttgcccaccgcttctctcctcctcctctccccccttccctttccctcccggcgtgtggtggtcggaggttgccattcattggccgcccccaccaccgcacccgccggtgaggagggacaccgccatcacattcttgctatatccaacgacctccattgattaactacgtgcgtgtgagaaactaatcaaccggccggcgtgctggctttcctcatcttcaagatgcaccggtggttcattgccagctgcggagacatacgtgcggcggcggcgcgctcatcccgccgccgaggaggtacgccacgcatgcattccgatgatctgaatcggtggtttgcgaaaattcttcaaatcggaccgcatgcatcggatgcccgcgcttccgcgccgtccccatcacacgtgccgttgcaacaaatcacccatatattacagaaacggtttattaaggggatctgtttcatttttttttctaccaacaatgtttcagcaagtatactcatgttgtttcactatgtatagatcaaatgttgcagtgaattgaaacatcatttcactatttgctgaaacattgtttttatatatagtgaaacagctttaaaaaccgctgtttcatacgttgtagcaaaatgtctcatgagatgatttggttatgtttcagcattttaaacgatcgaaacatttccgatctacttaatgaaacaatttcgatccgcttagtgaaacaccgtccgtttttttaaaaaaagatcgagcgcccgatttataggtgcctcgggtcgtttgtttgattattgccatgtgtgtatgtgaat

SEQ ID NO: 48230 - DNA, 1501 bp, Oryza sativa
ttgtcacgacattagaagtaaattcgttgtagggataaaatatgactttttagttaattccataatttgtgctgattaatttaatttctagatagagtcatatttttatctctacaacggatttacttcaaatgacatgccaaagttacattcgttttgttctaagttacttctataatatatatataaattacttttagacttacagaatttacttttataatttaaaaagtaacttaatgaaatctaaaagtaatttagacatatcataaaagtaatttgtaatttttcatcaaaatataattatgtgagatcttgttgtaaatatttaattgcaatgaacacaacggtgtaatcggattataaatcggataagtaatttaagagaaacttctctaagaaagaaaaaaaatacatagatattgagtgtactagtagcttttttttttaaagaagtgtgtctctctttagtactatccagctagcactctcggtgtagtcgcgtccttttcttattattaatgaatgtgtaataatagtcagcagtcgtgagatatttttctcttgttaagaaaacgaaagacacaatagtgtgagagggatgtaatcatgtagttggaaaaaaattagagaagaacaagagaggtgagatgaggtgaggtagtataatatagggtaagtgattttgacattctaatttgtttcatgatatatggggttttataatctcgagacatatttttatttcttatctattaatttgtgtactagtttattttcccatatgttaactatttcctattttatccctcgacctattactcctctcgtcccaatatataccaatctactatggatccgactatgaatataaacataccatatcatgaatctaatcacaggtatgtctagattcataaatctaggataagtctgggtctaatctcgtcctaaattgctacatagtgaaatgaagggaatatcttttttttatgccccaagttattttagtactttattaatttatgtaaaaattggtactccatcatcccatgttaagtgtagttattagtttctgtgtttaatatggtattattattattattattattattattattattattattgaatgataaaatatgaatagtactttatgtacgacttatttttttaaattttttaaataaaatagacaatcaaatgttaagcatagtaatctataactgaatttaaaataaaacggggagtacgtattattggggagagagatagagagagacagggggagtggactgttatgagaggcgaatagtcggagtggtggcagttgaagcaagcgtccctccaaaacgagagcaaaaaggcgcaaccaccaacgctacgggatcccatccatttttcttccctttccgatccaaaagcttccttcccttccgccaccacaccatgccacccgccggagacgccgcccacgcgccgccgccgccgcaccgccgcc

SEQ ID NO: 48231 - DNA, 591 bp, Oryza sativa
gaccaaacacgacctgtttaatgctgcagacccccatccaaagaattttataacggcattgtggatgcccttaatctataaaggaggctccagtccaacagatagagggttctaactcttagcagctagcactcttgcaagattctcatctcattgtaactcattctcaatcgctcatagtccatatacagaagtaggtagtattacatatctatgtagcatgaacatgtataattcctcgtgttcattactctgggattgggacctggactcaaattgccaaatctccaagggagagtatatacacttccccgctagagaagtttcacactatgataaatgtaattgcattctctatttggttagcaaataataatagggagtagtctagaaccaactaatatacatcttcacatgtcccagtcgtgacaaactttggaggcatctatctagacgggtatatgagccttttccctcttttataaaagtgaaaaagtttgtttgcaaatgcactaataaccatctactagctagcactagtcgggacgggttgatatacagagaaggcatatagtagcttggtagccgaca

SEQ ID NO: 48232 - DNA, 1501 bp, Oryza sativa
atataaaaaaagactaaaaaatcataactttttctaatctttggataggataaatcaattatgaaacttgtatgcctatataagagtattttagagcaaatgtaaatgctggaattgtttatattttaggactgataaatggagtaattaacaaaaattaactgacccagaggcacaagacaagtgcttaacatttttctcatttgtgaaaaacatacatgctatttgttaattccacaccggcctaactatttcttttccagtatgcaacccttggtagttgcatgcatatacagcagcttcgatatgatcagctgcttgcatgattatatgcatacgcgcatgcacgcttgcattgtgcaatatcattacatccgtacgtagatgaagcacgtcatggagaaaaatatataagcttatttatacagtcaaactaatcatgctctacctctagatcattattagctaggtcaagtccatcactaaatagtaattaattattaataaaagctaagctaaattacatatactagctgcttgcatgttgtatatgtgttttgcacgcatcaaattgttaatggttatactgatcattagctagctttaggacgcaaattaaactaagatagttaggatacttagctacgtagctggtggacacaactaccgtacagagtggcccttgcaactgcaaatgcaatcactgtcctggctagctaagcaaatcagaagggttgttcactaagctaatcccctacgtgctgcttttcaatctttcatacagggaaaaaagacagctagcatatatgtacagaaaaggacagaatttttaatatagtggcatgtgtatgattaattttacttaattacagtagtactgtgtgtccttcccttagtaccactactccattcgttacaaaatataaggatttctatgtgttttcaaaacatatctagacaaaaagatatacatatacatttttaaaagatgtgcagaaattattttgtagtagatgtagtaatatctctactattataaaaattgaatatgttttttcggtattttggtacattattcgtgtatgagtcggttatttaagttcgtttgcttttgaaaatactatccgtatttgatctgtttaaaaaaactcgcatgctaacttgagacgatcggacttctaactacagctcatgattttctaaaaatatatatatccaagcgaactctcacagtaaattttatcgtaactaaaccatataacaataataagattaaaatagagttcacccgttgcaacgcacgggtatttttttctagtttagaataaaatttagaaaactgtaattacttggataaaacttcactttactataattttaactttgtagtacaccacaagattataacaataacaaacgattttgtcagaaattaaactgtaactttatctcatatgtgtgtatgatatgtgaatctaatataaaacggtatgagcattgc

SEQ ID NO: 48233 - DNA, 1501 bp, Oryza sativa
tcaaggataaatttccatctttatatgctatagtccgaagtaaatcatccactattgccactgttatgggatctgttccgcttaatgtttcttttagaagagctttagttggtcagaatcttgtatattggcatgaattgtgtgcttctattgtacatattcaattaaatccttcttctgactgttttagatggaattatcatcagaatgataggttctcagtaaggtcaatgtatctagctttaattaacaacggttatattgagagaaacaaatatacatggaaatttaagatgccgcttaagattaagatctttatgtggtacttgcttaagggagttgtgttaaccaaggataatttggcgagacggaattggaatggtagcttaagatgttgcttttgtatgaaaaatgaaactattcaacatctcttcatagattgtcattatgcaaaattcatatggagagcagtttagttttttttggttttaatcttccaactaatatatctcatatatttgatgggtggcttttgggggttgataagaaaaagagtaaactgatactggttagagcttctgccatttgttgggctctatggttgagtaaaaatgatttggtttttaataaatcaccatctatttcatatatgcaggtaattttcagggcaatgcactagctccggttttgggcacagctacaaaggtgtgaggatgatggggagttcctaaagattgcatgccgcaagttggagtcaatggttatgcaattatttgccaattatggatggaggttcacaaatagacttcaataaatgtgttctccttattttgacttggtttcctctgtttttgtttggtgtgtcctatttagctgaactacgctcttttctagattgctataatgtaataattggctgtagctctttttgagcaaaggccgggatgttaaattccattatctaaaaaaatctattaaaaacagagatgatattaagcacgagtaacttcaccttacattgactgcacacgtcgatcctaattaaaataacattttctttcttaccagagtgaagactaccgtaccggctaaaatcaactgagtttatttaatctcatatttaaaaaattaaccccctatcaaattacaactataaaacactcacccccttagcttcccaacctcctaatcatacgagtttggttgccatttgacaccaccacgtataggaattgaagtgatcgagaaaagctgagaccacgtcgtcgtcgtcgtggtggttgtgcttctccaccaccaccaatccgaaagatccaaagaatcaaattaagagcttagctagcgatctcgatcgatcgatcgagcagccgccatggccgccaccaactcatgatacgaccagaatcgccgccgatcgacgacgaccaagaaacgtagtgcggtgtggtgtttgatcttgctgcggcctcgccggccggcggcgatgatggtgatgggctac

SEQ ID NO: 48234 - DNA, 1501 bp, Oryza sativa
tacaagtcattttaattattttttaatcaaacttatttaagtttggtcaaacttatagataaacatagcagcattttcaacataaaataaatctctatctctactattataaaaattgaagatatttttgccggtattttggtacgttattcgtgtttgagtcggtttttaagttcattcgcttttggaaatacaaatccgtgtttgagttagaaatataaaaggagtcgtataagaaatctctttaaaaaaactcatgctaacttgagatgaaatacagactcctaattgcagctcatgatttccttaaaaaaatattcaagcgaattaacacagtgaattttagcttacctaaaccgtataacaattataatatcaaaatagcatttacctgttgcaacatacgaatatttttttagtcgtattaaaaatataatccttattacatttaatgaaactaatttggtgttttaaatgctgctaataaacttgatcaaacttaaaataaaaaaaatcaaaacaactaataatatgaaaggatagggtactaggcaaacaaaagtttccaaattctaatccaagccagtcaggtcaggtccattaaaaaactttggaatacggacatggtcgcgtcactttcggcccggcccaaacgaaaccagtccgcctcggtctcttcttcttcttcttcccaatttgcatccctacttccacgggaagcatcaccgaatcggcgagcgagagcgactcctccgatcctcatcgctccctccgccttgccgccggcgccgcgcccccgccggaatcctcattcgcttcgcctcgcttctcttctccgaggtgaacttccctcgatcgatcccttgtgccaagcgcgagtattagggttaggtctctctcttgatccggtggtcgattatttgctctgcatgcgctgtgtagattaattaattgtcctcttggcctcgatcccccatgattggtgatgtagttagggcgcgtgatattcttttgtctgttttttacccggtatctatatccaaccagatatatgtgatatttttaaatcgaaaacttagcccctcaaataatccaatctaaaatttactcctatggagatttgcacttaggactttggagtgctactctacgtgccctttcgctctgaacataagtgggatttggtagctaatagtaagtattttggaattaggaagcattagtaggattcgaacccattgttaaagaaacctattcaccactcactatttgtgaccataatagcattgcattgcaagttatgtaaaccaatggttaaattacattattctggactctatctattagcatgctacaacttggctgcacaggatggtagatgctagatagtgtgccatgtagtattacatttgtataatataagcactactctaattgtaccaaattatcaatctttgttctttgcttatatctcacagatttggatatagtattacactgt

SEQ ID NO: 48235 - DNA, 1501 bp, Oryza sativa
cagggagacgacctccttccccacgccactccttcaatctcgaagtggtgagcatcgatctgtaactggtgggcttgctgcacatgattcgtggtccgtggacgcatcgctcttccttttctttcttttataagatagaatccggatcggtgttgaagagggttgtgataccggattttttttcgtctatatgctccgatctgaatctgatagatgctatgattgttttgggcaaatgaatgagccaaaatgcaatttgcgatgctatcttctgaatttgaattaaaactctagggtgtttgagcaagtctacctagagagattttggatttttggatttttctgtttttttatccggctatgacactgagttggccgcagcttaagaagacggaaacgcatacgcggtctcaccgactacggacgaaaatcgcgtggacggatgaaaatcaattacagacgaaaatcgtcgcgtggacgaaaatcacgtggacggatgaaaatcgattacagacgaaaatcgtcacgtggacagacaaaaatcgacgtgtgatgattagaaaattgcagttttttaagtagtgctctctatattttaatatgacgccgttaactctatattttaatacgacgccgttaactttttgacaaacgtttgatctttcgtcttatttaaaaaatttatgtaattataatttattttattgtaacttgatttatcatcaaatattttttaagcatgatataagtatttttatatttgcataaaaattttgaataagacgagtggtcaaatgttgattataaagtcaatggcgtcatacattaaaatacggaggaagtagttaataagatatataagattataagttaagatttttttttgtttgtcaatatttggctagattctatgggaattattgattttcataatccgagtagaaggaagtatgttcggaaaactagaggttgtggtattcagaaatgtaaaatcaaaggtgtttttgattattattcagtgatgaacaattgggcattggagattattggtgttgttatttggaatttattcacgaagtggttttggggatgattggatttcataggtgaatctacaggttatcattttatgtggaccggtcagaccgggcaggtgttgccggtcagactggcggtgatcgagtggtcggaccatccagcccgcggtctgaccggccgactctgtgtcggtttcggcttcgggttgtttatttggatatccgtgattatttcatgattatgacttctagatggatactatacgtatgtaatactgttgtttgttactaataagtcaagattgagatagcttggtctctgaatatggtttctttgtttgttcatgtgtagatgactcgatgtctcggaagagtatttgcggtgatggaccgggagtcggcttggggataagacgatgtccgtggtgatcagagatcatgcgggatactaaggctagagttga

SEQ ID NO: 48236 - DNA, 565 bp, Oryza sativa
aagattgcaagctggaggacaaggtggatcgtttggagaaggaattagccgcattgaagggagaagcaccaccgcagaaggccagggttcgtcttaccgcaaggaagagagctctttttgtccctcgctaccagttggcacctaaggttcgtgtggtggaagaagaagaagctaccccagccccagtgaatcttcccgtcattaatataagtgatgatgaaggagaagagtcaaagcgcacccattcgaaggttgagtggggagctacccaagatgatgagatcgagccttcaatcaactccgatgcccggaagacctagaacgccttgttaagtctttgccttagatcgttgtgttagtttgcttgtttaagtttggttgtgtgtgtgggtctcgcttgtagtttacatcattggtgggatataaatgcatgcgtttgtttgctttcgagtgttaggaagcttgtgagttagtggtgtaagagctttcagttataatgtaataatgaaactcagttaagatcaataaaagttaagttagtaaaaaattaattccctgtcctaag

SEQ ID NO: 48237 - DNA, 1501 bp, Oryza sativa
gcttatgctttagacttcggtggaagttgggataagaatctgccttacgcagaattctcgtacaacaacagttatcaagccagtcttcaaatggctccttatgaagcgttgtatggtcggaagtgccgcactccgctattctgggatcagacgggtgaacgtcaggttttcaggactgatattctgagggaagtagaagagaaagtaaagatcattcaaaaaagattgcgtatagctcagtctcgtcataagagctatgctgataatcgccgtagggatctgagttttgaggaaggagatcatgtgtaccttcgtgtcacgcctcttcgaggggttcatcgttttcacaccaaaggaaaattggcaccgtgttttgcgggaccttacatgattgtcagtagaagaggagaggttgcttatcagttggagttacctcaatcattggcaggtgtttataatgtgttccatgtgtcacaattgaaaaagtgtttaagggtacccactgaagaagctaatcttgagcaaatagaaatccaaaaggatctgacatatgttgagaaaccaatccgtatcctggagacagatgagataaggaccaagaatcgggttattcgtttctgcaaggtccaatggagtaatcacacagaggaagaagctacctgggagcgagaagatgaattaaagtcagctcatccgcatcttttcgacagttcttccgaatctcgaggacgagattctgtttaaggggggtaggtgtgtcacaccctaaaaatcccaaaaatataaattgttgtttaattggaattattagaaataattttaaaagcctagaagcaaagatctaattttaaataataaattccaatataaaagtggcccagataaattttaattaaatacacctcttgattctatagttcctagatttttctgagatttattttagccaaggaagtatttttaataaatggaattgcatttcatgaataatttaaattgaaaaaggtttttaaattccaccttttggctttgggccgaaagtcggcccaaaaccgccctttctctctccccggcccaactcagcccgcagccgagccgccgctcgcgcgcgctccctcccgctgacaggtggggcccacctgtcggggtcgtcgtcttcctcccaccgcacggccgcaccctagccgccgccgccgcccttccaattcagccgcgcctttccatctccggtcgaattgattgaggggaaacgatcttctcgatctcctctatcttttctcttttggaagcatcgtctattctcctttggaaatcaccgaattcgatcttgaatcggattcgtttttcccctccgaaccctaatctttccttcccgtcgccggccgccgtgggccttcgtcgccgccctctagcccctatttaaggacccccgggacctcctctctctgccgccaccctcgccttagcccgccgccgtctgtagcgctgcctccgcgtgagc

SEQ ID NO: 48238 - DNA, 1501 bp, Oryza sativa
ctaaaccaggaattatccattccaaaccaggagctaagcaaattattaccaggtaacatccatagttatggtgagaggtgtgggactaatcacgaaaaacattgctcaactcgcccataaccgcggccacggctattcgaatagttttactctggccagaggtgtaccactgtacccacaagacacggccccacatcatgtcaccatgtgcctcagtaccaccacggtacctcggaaaggggctgtgacaataccccttgcataacacaatccaccgcagcgcaccattcctggatcataatcacccccttataaaacaaggtatggactccccagcgacccccgtgggcttatctccgccacttctcaacctggtgctccgcaatgaatcatgttatacaaaaggtaaagccgttgcccacgctggcttgtggttggcacggttaatttttcacaacagtagctcgcgaaccggtccttaattgtcatgagcacgactctcaaaaccatgtgctcacaacccaccattatcaagttttagttggcaagtaattaattaaccaatcacgattgaccatggtgagctaccattaaatataaccataagtgatagtgaaacattagttatcccaattgtgtgctaatgtttctaagcatggctaagcaatcatatctaatatctagctgaaccaatatataaagcccaactagtcaagttataataacccaaggtatcaaggaataaggtaatcaatgcaaacaggccataacaaaggaataggttcacaccatccagtgacatttgaaaataaatgcacagttgaaataaatagagaatttaaatataggatcaacatgctcaaaggattgtgtttaggatctgtgtgacttgccttgcaataatcggtcttcaattaatcttcttgaatacttccggcgcacttgcgaaccttcgcaacgacggaaacgacaagctaacacgcaaaacgaagaaaaagactaataaaaaccaaataaacagtacataaaaagtaaacaaacatgtagatcataaatttagatgaattatgagacttgaacggcctcattccgatttcaaatgaatttattataaattttacaagattataatctaattaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacctttatatggattttaattgaattatgacgcaataatgaattatttttgaaaaggaaaagaaggtttattgcgtcagcggctagggtttgcggtggaccgggtgcacggcaacagttcacgggaacggacggccgagatcaaccctatccaaaacggacggccgagatcgaacggtccacgaccggctcacggcggacgaccctga

SEQ ID NO: 48239 - DNA, 250 bp, Oryza sativa
tttttcccattagtttatcgactgtctagctttctccttgttagtttgtgtgtttaggttgcttgtttggggtcagtcaacggtccatatcatgtgcctatgatatggctgtcttaataaggatttttgcttgctcttttaagtgttttaattcagatcagaacaattgcagtttaaattcctttgtaataaagcttagttcctgagcatctgtttttcttcttttcccccgtctgcttttccctgtaga

SEQ ID NO: 48240 - DNA, 1051 bp, Oryza sativa
atcctgatgaagatggtgaagctgttgatcaaaaggaatatagaagtatgattggatcttttttgtatctaactgcttctaggccagacatacactttgctgtgtgtttgtgcgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgaatttggtggttgtagaattaataggaaaagtactagtggaacatgtcattttcttggtacatcattgattgcatggtcttctaagaaacaatctaatattgctccatcaactgctgaatctgaatatgttgctgctgctagctgttgttcacagattctttggcttttatctactttgaaagattatggtcttacttttgagaaagtacctctcttttgtgataatactagtgctatcaatattgctaagaatcctattcaacactcacgcaccaagcacattgatattcgttttcactttttgagggatcatgttgagaaaggagatgttgagttgcagtttttggacacaaagttgcaaattgctgatattttcactaaacctttggattctaatcgctttgcttttcttcgtggtgaattgggcgtcattcatccttttggcatggtttgaggggtagtttgtacctcatggttttatcaagcaaaaatatgataatgaaaaaattgagaaaagagagctttgtttatgcatatggtattttcttgtgcatgctagcaatactttgaaggtttatttgtctctagcatagcttgtatgtattctagtcttttcatgagatttagattttgcttttaagggagatgatgcattacacttaaattctatacttgaattaagaaaatatgcaatgttgatgctagcatatggtttgatttataaatgctctatatatatgctctattgacttgttattcctcaaatacctttaattgctcattgtgaaaaagagaata

SEQ ID NO: 48241 - DNA, 1501 bp, Oryza sativa
catctctcttctacccgctccaacaatttgaagctagtaaacttgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtgttattgattgtatgatttgaagaaaatcaacatctgcccctagaggcacccgaaccccccttatatatgggaaggagtccgtgttacaaaagataatctatatccctaacggaatatacaaatacaggtaaaatacagtcgtaaccgactaagtctcaaggtgtttccttgatgtacaagttaagaaacaaacccgagatacaaataagatattctatatatattcggtatcctatatccagtccaaatatcatcgccatgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcataatcatgcatcatatgacaaaagcatatgcggcgcctaaagaggcattctagccgactgctttttagccataacaaaagaaatccgagtggttaacactctaaaaggttcacgaatgaacacacttgacaggcatccgaataaaaactctaaagattacccaccaagtattataaaaattatggtaataaataagtctaatagcctaggccatgactatttaccataatgaaaacaggcatataacataccagggaaacgactatggtaaaaacaagtcattccaagttaacccagacagcttttgtagcctaaaaaagcttacaaaaacagcataacgcctttctgtcgggcaccttttaatttgcattgcaataattccaaagaattatatgaccgcgtaaaaaggattttatcagcatcgggcaacactattgtgcacataaattgccaaagcaaaaaatgcctaagtccctaaggaacacaatgggccacgctgttaaaagtattgggctgaggtactgttcaggcctaggcccatttgcacctccgatacccttaacaagaaatccgagatccaagcgacgcttcgtcttccccgccggaacgctcgccattttccccactccccgctacagtaaagagctgcgccggcgaactagggttcaccaatccacccaaatccaccttcaaaacgtgatcaaaatccttctcgtgatccaccgcctcaattcctcatctctcccaagccatccctcgaatcaaatcagcgcatttgagaaaaatcga

SEQ ID NO: 48242 - DNA, 373 bp, Oryza sativa
tatcatcttaatggcttttttggattaatgtgtgattcttcattcttccacgcaagattggctactggacatcgaggaatataaatattaatgaatcgcttgtttacgaggaatgactagtagcatatttaaatggataataagtagaatcacttatccttaatttatgtgtcaaagataaaatattactatcaaaaatagatggagagagtattatcattagtgttaagtgttaaataaaggtagttgaggccttaagttaagggggtgtgcacgctagcgcgccagctagccacccccaccgcgagtccgcaactacccaaccccacagcaccgcgtgcccgcgtgcgatggcattcgcgccgcgcgtagg

SEQ ID NO: 48243 - DNA, 195 bp, Oryza sativa
acctgcagctgatgggatcagctaggcccgggtggccatttgaaaggtgttggcccgggtggccgtttaaaaagcttttggccgggtgccaaccttgtttcaaaatctaaagactgatacattgcacatactccgaccggacgagacgcactgcctcgtccgtgtcgtttgagaagcactcacttagttgctttt

SEQ ID NO: 48244 - DNA, 622 bp, Oryza sativa
tgcttggagtccacgcgctccacgccgtcgaggtggtgcctgaactccgggcagatgcacgcgctgccggcgtacgccgcgtcgacgtgcacccacgcggcgaacctcgccgcgacgtcggccacggcgcccaccgggtcgacggcgttggacgacgtggtgcccaccgtggcgcacacgtaggtgggcaccagcccggcgtcggcgtcggcctgcatcgcctccagcagcctcgccgggtcgaggccgtagtcggtctcggccccggtggggatcgaccggatgttcgccggatcaaacccggcgaggcggcacgccttgaagaacgtggagtgcgtctggtcggcggcgtacacggcgagccggtggagtcccgccacgccgtcgctgccgctccgccgcagcgcggcgtcgcgcgcggcaacgagcgtgacgagcatcgcctcgctggtcgtccccagaataaccccaccgccggtgccacgcccctcgccggtgcggttcatgaagctcgtcggcaggttgagcatctgcgcgagccagtccagcgcgagcacctccatctcggtggccgccggcgacgcctgccacgtgaacccgaccgtgttcatcgccgacgcga

SEQ ID NO: 48245 - DNA, 342 bp, Oryza sativa
  unsure (1)..(342): unsure at all n locations
tggctccattttattttatttttttatttttgctgcgtgtgcgtggtgaacaaacagtcgaatcaaccatgatcacgggcggggtgttcagggtgaaccaccagtccaccgccacaccccgccctgcgnccngcgcttngtgatgtttaggttcttggatgcaagcacgtagtggaagcagtgtgccatcgagcactcaaaagtcacaaactagagacacccaaagtcacactaggaagaaatctagtagtatgagcggttctgttcaggtttcagatggcacgcttggcactagatgggggtgagacacttctgctagtttggtatctggaaaaagaaaaa

SEQ ID NO: 48246 - DNA, 1501 bp, Oryza sativa
agagcggatcatctcatcgaggctatcatgacaagaggctaggttaccggcaatgaattcgagcatgcacgatcgacacaggattctaagagtcatcacccagtgtgtcggtgctcttctttctagttcaaagttggattgaagccaccccctcatgtgtgccgcctaagagcatccccagcggacccctcatccggtactccatccaaaacatagcgcactggaggagaaaacggtgctccagtagatatggcatcgaggcctccaaaaatagacgatacgccaaatcgaagagagttcggccaaatatagtgattctctctcatcaacgccatatctcaacgtccgcgctctcgtccccatccgaagttctggatcaacctcccctccatcgtcatcgtcgcccaccggccgccgatgtcgctgccgcgcctaccggctgtcgtcatcgctgccacttccgatcccaccacccacatgcgccgcctacccacctcagcatccggcgttgtctcctgcgcgacacccacgcccgtcgctcaccgccgccgcttccccgcccacccgccttagcatccaccgcctttgcctatgcggctccgctcccgccggccatcttggccacttccacgcccgtcggccgcttgcgccgcctgcccacctcagcatccgtcgtcgctgtctgcgcacctctgctcctacgggccacctcgactgctctgcagacttgtattagagaaaagagcatagaagatagagaataacagagaaaaggagataaaatatgaaatatagtcgttcaaatataatataagtgcacggtagttggtaaatattactaaaatatagaaaggtgtgatatggagaatataatatggatgatcagttgaagtgggaaggaatatgaaggagggttttttttttaccatctatataggcatatggaggatcaaatttggattagttgttgggatgcttcttcagataataagggaggagagaggaaggagataatgtggatgaaagtgcaatattttcatttttctctcctcaatacggaggtgttgacagaaatcctgatggcaatggcacaatttgagtttcagcagatttaatgaacagtgatgggattttttttcacatgacaaatttataaatggcgttatcaaatttacccttaggaataacttttttctgttccagaggtttaattgctcggtgggcccaacatccggtgagcagctttgggcccaacgttcacctttgggcttcgcaccgtggctgggccgacttttaagcacgcggtcgcatcatatagggttttcgaagctcgccggcggcgagcaccacccagaccccaggtgaggttgtgagcgttgcggtggccggcgagatggagatggcggaggttgaccggaagagcgatggcaagatggcggcgactggtaaggtttcgtcgtcgggggcgacggcgcggcggcggagtcgaggaagggtgctc

SEQ ID NO: 48247 - DNA, 1501 bp, Oryza sativa
caaataattgcataaccattgactccaacttgcggcatgcaatctttaggaactccccatcatcctcacacctttgtagctgtgcccaaaaccggagctagtgcattgccctgaaaattacctgcatatatgaaatagatggtgatttattaaaaaccaaatcatttttactcaaccatagagcccaacaaatggcagaagctctaaccagtatcagtttactctttttcttatcaacccccaaaagccacccatcaaatatatgagatatattagttggaagattaaaaccaaaaaaaactaaactgctctccatatgaattttgcataatgacaatctatgaagagatgttgaatagtttcatttttcatacaaaagcaacatcttaagctaccattccaattccgtctcgccaaattatccttggttaacacaactcccttaagcaagtaccacataaagatcttaatcttaagcggcatcttaaatttccatgtatatttgtttctctcaatataaccgttgttaattaaagctagatacattgaccttactgagaacctatcattctgatgataattccatctaaaacagtcagaagaaggatttaattgaatatgtacaatagaagcacacaattcatgccaatatacaagattctgaccaactaaagctcttctaaaagaaacattaagcggaacagatcccataacagtggcaatagtggatgatttacttcggactatagcatataaagatggaaatttatccttgaaagccaagttacctagccatttatcttcccaaaatcttatttgttccccatcattcacaatccaagagcctatatctaaaaaagtacttttgactttcataagccctgaccaaaaaagggaatcaccttgtttcttgtccacttgggttatagacttgttataaagatatttccttttcaataagttctgccaaacccctttctcatttattagcttgtacaaccacttactcaaaagacatttattttgtaattccaaattatgaatcccaccgttaaattttttttatcacgcgtttgatcattcgtcttattaaaaaaattacgtatttataatttattttgctgagggttgttttatcactcaaagtacttaaagcatgatttatatcatatatatttttgaataagacgaataatcaaacatgtgtttaaaagttaacggcgttatctattaaaaaacagatagagtataatttaaaatgtaatctttattgttcatatgaaaaatttattgaaaaaactttattatagtattacacttgtatatttgattattgttttcaaataccttttttaaggaaactatgacagtagctctaccggatatattgaggaggagtaaagttcaaaaaaataataagaaagaagtttagaggctcaaggggattagaggataatcacaagtccacttagttaaaaagaaaaaagggacacccttcagg

SEQ ID NO: 48248 - DNA, 1501 bp, Oryza sativa
cagatacttaaggattcatattcaggaaatcctgacactgaaaatctgcttatccagaaaactgaaagaagagctacgcatgagtatgtgccaagaacattttgtatttgcaagggcctgtgaatggaaccatgttttatcatgtgattacccagaagaaaatgtcaaaagatgaaagcagtgaagttcctccgacaatgtcactaggcttacactgaaatgccatgtttgaaaatttagcatcatcaggtccaattaacccaaattctagaatcaggcaaatggttcactgaagacagcagagtgaacccaatggcgtgcctcagtcacaatcgatgccgggagaagctcctcaacaacaccatcaaccagattgtgtgcatatacatttgtgatggatttctctatcaaacctcgtggattgaaaggagccatcttcctcttctttccgtttccaagatcgatcgttctgctctcaccccacagccggtcagggcagaacgtgtacactttcctcccacctttctcctcccttaaacgggaggatctaccacggcagaggaaccagctgaacccatccagatcgccggcgtccaatggcgacggcgccattgctatatccagcttgaagaacttgaactcgcagaactgatcatcgtgacggcgacatgagactaggatgacctcctcttcttcctcttcctcgccaccgccttcgccagaggcggtgacgaggaagtgatcctcttgccagttccaccccggcgagggcaccggcgtcctccaggccgtctccgtcatgtcgaacacggagatcctcccacggtagtcggcgcagaccacctgcttcccgcgcaacgccgcgtccacgatgaatgtgaacgcggcgcggcgccgcccgtggcgagcttgctgcgggggggaggtgttcgtgttcttgtaggttgtccagtacacgtcgccggggcaggatggtgggataatcggaggccgtctcgacgcaggccaccaccagtggctccccatgggagttgatgtggaagacgaagaggccaccggcgacggagcggaacaccggcaggtccacccgccggccgttgccggcgtggacaggaagacggttcgcagtgttttctctcgccgggggctatggcggtagttctggaccatgagcagccacccgcggttctcgaacgccaatgtcgcggcgtccaggaagaaggcggccatgtcggttgctccacgggtctgcttggtggatggatcgaacaggaaacatttgttgctgttgcattccagagttaacaatgccaatggtagcttggattgcttggaacaagaagtggtacttgttggagaagcatctggctccatggtgaatcttaattggtactagctagttcctccagatctgagataagcaaagggcagaggttgatcatttggtacaatgaaaactctacttatattacatacagtgtaatactatatccaaatctgt

SEQ ID NO: 48249 - DNA, 1501 bp, Oryza sativa
aaaaaaaactgtgatattgtttagctactgtgtaccaatggacaataatcttgtgtgcacaagatatattcccaaagaatagataaaatatgcatgtggcagccagctaacatgggtttgaattaccagcaattcttacccaactgataaatccattttggatggcatcaagatgaattgtcatagttactctgataagtcggaggacatatccggtgaaaagagctaagtgttgaaaactcatgaaaatcatacctaaaagtttcgtaaattcatgaaaaaaatactagagagaggtgcagatataaaatacattctcaccaaatctcaactccaaactcaacttcgtttaagaggaaaaaaatttcagatgaatagtgtcatgttactattcacctgaaatttgtctttttttttactcctaaataaagttgagtttgaacttgatatttagtgagaatatatttcatatctacactatctctagtatttttttttatgaatttataaaacttttaggtatgattttcacgactttccaacacttaagctcattttcaccggatatgtccctaataagtcggggcatttgcaattggaaagagggaaagaaacaatatgaagagaggaccccagcagttgagtgaaatccgacaggccatcccaaaatcttagttaattttctcaagataattatatttataagagaatatccctaaaatatacgctatactactcagtcatggttgagctagattaccaaggtcgaccttaatcaagctcgaacgaagcctactcaaaagctcgggggtgaaatagactcgtgtcgagtttcaacaaacgagctcgctcaagctcggctcgttaacgtccctaaattcagccatattttaaggtttgacatttaaaggttcacactaacattctagtaagagagaggattagagccgaatgggcctaaatgaaccgagcaagccagcaaagactttaggaataagttcactttgactcccttaaaagtgacccaaatctaatccgtgaccctcaaccacaaaactagatatctttgaccccctaaattgttaaaaccggtgcaagttgactccctgggtggttttggagagtggtttcactgacgtggcgattatgtggtggtgttgacttcgtcttcttccaacgtggtgttgactagcacttatatggcattagaattaaaaaaatatatgcgggacccatttttcattcaccaaaataaatattatgggccccactaacatgtggaccccacatgttagtctctctttgaccccttcttcctccctctctccccctctctcctcgggagggacgcgccgtcgcagccgtgggcggtgaaggcagctgcagactcaacgctggcactcacggtgagggggcagttgaggcggagccgcaccatcctgctgcggcaccagtgggatgacgacagggagcggcgctgatgaggctgccgacggcaagc

SEQ ID NO: 48250 - DNA, 1501 bp, Oryza sativa
gatctcatttaaaacctagactataggtttatatgataatgttggtttaataccaccgctctggtgttggttaaataaaatgaaccacatggtgggctgtgggtgcacggttttgctagtcgcacccatggcagttaaggaccggttcgcaggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttctccgaggagtaggcttcgtccgtgccgtcgaggatgcctgtggagtggtgttcccgctgccgttcaagtcaaggcttagctccagtttcttttgtttttccgctgcatttctgtcagacctttataatgtttgtaagacgtggatctgtatgtcaacattgtcgtttgtgtaccccggctggtcctggacgggggttttaatacacattctgcttggaattctattcgggaatttctgggcgtgacaccacgtcagcgaaaccgccctccaaaaccatcgagggagtcaaattgtaccagttttaatagttgaggggtcgagatatccggtattgcgattgaaggatgcaaattagattcggtcactagttaagggagtcaaagtgatcttattccaaaactttaataagtacaacttttaagaggggagtttgcttcaattaggctttaggctctaaccaattaggcccggcccatgaaacatcagttcgaaagggcgcgccaaatctggcgctgaccgtgctgcactgccctgcactcctgaaaggcaaagcttaatttggacggttcgtgtaaacctgaactgaacagctctagaactgctatactttgtgagaaatatgattgcacttata

SEQ ID NO: 48251 - DNA, 1501 bp, Oryza sativa
acaacctggaggtcgaggaagtaaaggactgccatgctgaaccacctcaccaccacaaccattgctgccatgaacctcatgatcaggtcaagaatgatactcatccagtccaggagcactcgatctcgatcgaagaatcatcagaccaccatgagcatcaccacaacgaagaacacaaagccgaagattgcggacatcatccgaagccgaaagattgtgctccacctccaactgactgcatcagcagaaactgttgcagcaataccagcaaaggtaaagacatttgctcgagcttgcacagggatcatcataccagccaggccagccggtgctgcaggagctatgtgaaatgctccaggcccagcaggagttgctgcagccacagcatagtgaagctgcctgagatcgtagtggagtagtaggaaattcagcaatgtctgcacatatcatcagaaaatatagcaacctcgtcatcggcgaaatgtagaaaaagccgatgctgctatgcgtttgatctttttttttttagtcgtgctgcttttgcttcagctaaagaaaaaaatgttgtttgtagaggtgtctggttttgagacgaagcaggtgtttgaatcatgaaatgtataagcctgctttgtggttttctttcccggttgtgatcgaggcatcatctcctgtaagaatctgagaaggtgcatgaaatctgccatttctgggagcgggaggactagctggtgctgggattaacttgcttccaaaaactctttagattttgaaacatttgaccaacaattagtcaaatataaattaaattctattcgatgaaaacaatgttatttgattgcctcttgaatttgctctcctatgactatatgattttgttactacaaaccttgtaccgtgtaaaattaatagttaaacattagttttgaaaaccgtgcaaagattcagggttttttagtttcacaaatatgaggaattgctggttttatttaagaaaagtttaaggttaatttgagattactacttgagtttactcgatctagaaatatcacaagatcacatctagtgaaacaactatcgacaagtagtattctaaaattctttatatttgtagacagatactctaatggaaatggttgagtttttttcagcggaatcgaatcaacgaagcaatataatggttcgttccctacaaactattctatataaaagttcttcaaaaaatcaaataaactcatttttttaaatttatattagttagtatataattaatcgtgcattaataagctttcttgttttgtgtgggactgaaaaccttatcctacttggccaaaggaatgcaccctagtccaacatctatgctagcgttggtctgcatttttgataatggaaaccaatctagcatatatatatctaaatgtgggggtagggggggggagtgggggtatgggtgtgtttcacgctaaaattggaagttgggttgaaattggaacgatgtgac

SEQ ID NO: 48252 - DNA, 191 bp, Oryza sativa
aatagttcagtgtcctgtagtgtaattatgtgacaaaacatgctggcatttaatccatctatatagtagtagtatgatgtactgtatgaatgagcatatggtagatctgccaagctcatctattgctcacatcgatagaatttgagacaatgcactgaagtgccaccagtatctgttcttctgaatgcagg

SEQ ID NO: 48253 - DNA, 195 bp, Oryza sativa
taggatttaaattctacgttttgtatcggtgcccacgaatttaaggcatgtatttagtgggtatgcatgcgcccgcactatggggggtgtttggtacctccaacagatttaaatcatgtcaagaggatgtgcatgtgtgtgtggcctaagtgtaatgtgtgttgagtgtccaacaaactatctcaaaaacaagaa

SEQ ID NO: 48254 - DNA, 1501 bp, Oryza sativa
tagctagtctgaacgaaaattagtgcaatctaatcttgtctcttgatgtatgcaatttggagcagccgcacgccagcaccagctatccctaactagcctgtatatgacgatatgaatgagagaaactaaaaataccgtagcatcaggttcgaagtagtagaatgattcgtctcttgatggtgtagaatgattcgaagtagtcaccagattcggatgaacagaagacatctgagagtaaaacaacgatccccttcgtctcgatgaaatattttgccggcggcgcgccgcgcatggaaccacaagaggagctgaagaggcgtagcatatcagcgccgtgattaacgagatcagctgaagaggcggtaccagatgggctgttatgcaaaacagaagtggaggaggcgggcgtgtattcgtaaaattgccacgctaggagacttggccgtaggatgtcgatcgaacggatccggacgcatgtgtacacgagtgcagctttactcccgtgtgcacaggatatgctgcctaatatcataaaaatcaggatacggcttttggtactccctagcacgattccttagctttgcgaaattctctctgatagtatttctaaaccaatcctccgcagtttcaggctttggtggatctggtggtggacttggtggcctaaaaggtggttgttgcggcacaatattgttatattggccatacctagtatcgggaggatatcccctattaatatcattgtaggcattagggatacgtggaatagtatgactaacagtattaacaggtgatgaataataattaaaatcagtactgctagtcgtggtataaaaacctggagaaactcccaggaaaccggtctgaccggcccatggccctgtctgaccggtgatcagtggtgcggtcagaccggccacaggaggtccgatctggctaaatagggcacggtctgaccggctatggacggtctgaccggctatggtaggtacggtctgaacggcataggatgcggttagaccagtgtcatgaccggtcataccgttagctaggttttgcatatagccgattcctgtgtaatcggctgtataatcacccattgacgcccccccatagcattataagcatattgtataggagcaaaactagaaatagcatatgcatctacataatgatcattaaccttttgaatagcaaagtatgggttggatgaatcggaggttaccttcggtgaaactacaacttgaggtagcgggacgtttcctttcacgacgccttgatcggtcctaatgtattgtgtagtaacattgttgagctcgttcccgctcgttatagttaatgaagaaatttcttgattaaatctggtcatacagatcatagccgaaatcgctgaccgaatagattaatatacggtcttgatatgttattgtgtttagccaattttattaaaactagcctttgttgatttttctggacgtaacagtaacttcggtactgtagc

SEQ ID NO: 48255 - DNA, 1501 bp, Oryza sativa
tagctagtcagttagtggccaagttcagtttgtggaagtccacatataaagattcaaagtgtagacctagaaggtgtattaatcagtgaccaactgctatagttacatcacaatatatcccagaaaggtactgtaaattataggacaacaagagattatatgaactgatgcaaacatattgctgcagaaacctcagctccctgtcggcatttccttagacaacaagagattatatgaacagtaaattgtaggcatttccttttttttttcctggggttgccatcatctccttgtctatggtgctttactttttgcaaaacctcagctcctcaagtgcacctgaaattgagaaaacatgtaatgttatactgtatcaagatgcaatgcagtagataaaatttagggacatctctcttatacagtcaaataaaatttaactggacaataaatctctaggatgtaccaggcgctagttgaagacccaaagttcatgacatagccgaaaaaatatactgtaacatgcagagataaagatatattaagaagatgataaatcccaatgctttcatggtagttttgcagtaagtatatatatagatacatacatattacagattgtgaagtatcccacctccacaagggtcatttacagtaagtttaataatcgtcagttataccatgttccatagtccataatataattgagttgtcaaactaatacataatatatactgtagatatgaccatgcatattaatgatagaaagcaaatagtctgaaacactaataaaggtcttcagataagttgaaatgatagcatgctagcatattgctggttaaaaatggctaggaatagagagcacaataaacatatcccaccatgatcaagcaccaacttcaatcagatcggtcaaccttgttttttcattattttacctcttgtgaaactctaggcactctgcgcacagcacgggcgcaggtggcggaggggcacagggctgccggcggcggcgcacggcgggctgggcgcaggtggcggcggggcaaggcacaggcgcaggcgacggctggtggcacaggagcggatttctttccctctcgttcccttcttcccaacctatccagaatattcttgaccgtttgctctcttttactgagcctcttttacacgctgcatccaacggcaggggctgaattttggttgcatccaacggctcatataaaacatatgacgtggcttaatattatttgagaaagcttgttgctttcacatatttagatatattgtccatcaagcaagctgctgacagcttgagagtaaggatgaatgacaacacacagctcatacaggagaactgagaaagcatcacctatagaaacaacaccatgcctgaaattgcacgttactcatcctcgctctggctacagttttttataagaaaaagtacgaatgacaccccccgaactatcgtgttcgtccgaattaccctcctgaaccacaa

SEQ ID NO: 48256 - DNA, 822 bp, Oryza sativa
cgggcctccgggcccattagcccatttttctttttttttcgcgatttgttttttcctttttcttttgcgatttttttccggttttttttcgttttttctgattacttttttttaatctttagcacacttatttttttcaaaatgttttgagttgaaagtttttaaatcttaacttgaaaatttttaaatccgatttgaaagtattcaaatctcgagttgaaagtttttgaatttgggctgaaagttttcaaatctcgagtcgaaagttttcaaatctgagtcgaaagttttcgaattggagtcgaaagttttcgaatctgagtcgaaagttttcaaatctcaagttgaaagttttcatattttttcaaatcttaacttaaaaattttcaaatctgtacttgaaagttttcaaatctcgagttgaaagttttcaaatatgagttgaaagtttttaaatatgagttgaaagttttcaaaatttgtattacacatttaaattttgatttgaaaattttcaaattgagttttgaaagtttttaaaatttgacttcaaaagttttcaaatctaacttgaaagttttcaatcggttagtatgaaaaatcttccggaaaaaaaaaatcatatcttaattaccgtcattatctactaatcacttaattaattaggctaaacaatcggaaacgctcgccgccaacgcgtacgtgcgcgttagcttttccagcctgccgccgccgcctcccgctggagctgccctgcttccctgctcgcgccgcgacggagaggaaagagagctggggtctgctcacaccgcagcatatacc

SEQ ID NO: 48257 - DNA, 300 bp, Oryza sativa
agatcagggcttgctacagcatgaagagctcgggtatgggggctcgcacaccggtgctgtttggtgggcaacggagacgacggcctccttcctttcttctgtagaggctgtttttctttttccttttttcatgttcaaaatgcttgtatgctgtgttcacttccatgcatgttaattgaatctagtgaactctgaataagcatttgaatcgatgctcgaaaatttggatgtggatttgaatctgtacatgctgtgaaaatctgattttggggatatttttggtgtaatttttatcgcagg

SEQ ID NO: 48258 - DNA, 1501 bp, Oryza sativa
accacatcagcaagaccgccatccaaaaccgctgagagagtcaaattgtaccggttttaagagttgggggttcaatatttccggttttatagtttagggtcacggattagatttcaatcacttttgagtgccaccaagtgaacttagggtgtgtttggttgggctatggcttttaaaaaaccagctgtgggctgtgacttttttaaaagtagctttggaaaagtagctgtgaagaagccaaaagcttgtttggttacactcaagtggcttttgaaaaagcttctccccttgcgagtgaaccccacatgtcatctacataagtatcttctccgtcctcttgacacagacaaaggaaggcagaggaagggagcagacgcgggcggcagcgacggctcggctacagacgtgggcgacggcagcggtggaggcagatgcagcgacggcggcggcagacgcgggtggcggcggctaggctgcagatgcgggcggtggcggtggtggaggaaaacgtggcgactggtttgggtaaaaattctctaaactaaaatcagcccaaataaaataggcccatccaccgtgcgaagcgcaaaacagaaattggaccttacctttagtaaagttcattagcgtccctcaactatgggtcaagttttattcgtgtcccccaaccacaaaccgagtaaatcagtgcaaattgaatacctctctgcaactatcaaaatcaatgcaaattgagtacctctccacaactatcaaatctgtgcaaagtacctctcctatatgactttttttgcttggccttcgtgtcatttagtgcctacgtggctgttgggtagtacactagcactacaagaattttgttttttaagaaaaaatattgcatattggtccatcttttttaccatagtttcaacttaaactaggggcaggagttagaacaaccttttctcgctttgtactacataaattatacgttttttccttttgggtctcttcttccacctctagctccctctctcttctctccaccccatcccttctcaatatcaccaaagccaagtaatgtctaacctcggacctcgcaggcacaggcaccgcacagaacctcgacctcgagcctagccagtgcccacgcttgaccttaacctttgtcgtttcaacctcaagctctgttggtgccacactacattgctgttagcctcgatgtcgcgttcagcctgatcaacttcccgcaggcacaatcttcagctttgagccatgctcagcctacatcgagttccatttttgtcatactccaactcaagcttgagcttgacctcccaacaacttgggaggtgaaacaacatgtaaatttaggtggtccaaaatgaaaagattgctttaccctagtccaaattgaaagaagggtaaagaaatatggaccaaagtgcaatttctttatctttactgcaccctccgtccataatatacaacctagtacatgaggttactaggctattat

SEQ ID NO: 48259 - DNA, 1501 bp, Oryza sativa
tacatgaaccttaatttgttgaagtttatatgtatggtgcctggtttggaggttaacgtaattgtcatgcttgcaaaggcatgaagttgatttatcaagaaggatcgtatgtgatgggtgtaaatataatggtctttaatttatagggagcgaaattaaaacatatatatacacctagttatatagacgcagagatcctctatagtactgctaatgcagtagtagaggctgacctgtgggtcaggcaatccccataagtcctatataggagtatatcctttctttttaaacttgagttaatttatttaatttgtggatatatgaaaccaatagccaaaggccttgcatgcattctctaggaaaacaatattccagacctgactatgtacggagactcaaccgtggtaggagtaccatgtataaccacatttaattaaataaataaataaatttgttggaatgatattgatcgctgcaataaatgcagaaggtagattgtctatgagttcgtttcatgctgggcatatttacaataaacaatgtagcaacgccatattgcaacaagtttaaagagtggttatataattaattaatatgacatctatacctttaaaagaaatttaagtatttcggtatctgtaagacgtctcaatgtcatggtcggtgaatctgacaatggagtattcccttcattttttttaaaaaaagctaattaacctaactagggatgagatattaatttcccattctttaagttttttttaatggatgaagaattagtatggaggagctagcgatcaaaattaaagcgacgatgggacaatgcaatgagaagcggtgtgttgtatgagtgggatgacaagaagcagtgattgttgtgatggcgcatcttatagtggggcatacaatagctaacaataatgggtgtggattttcgtccctcgagagaacatccttgttgtttgcatgtcatctaaataattattaaaaaattttaaaaaaattaacaacatagattaatataaaatatatcactttacaaacatgcaagaccaaatttaacttttacaagttgcaacaaaaagaacaaattaaactgaaaatagttatcatatgttcgcagctatatttgttatttttgttacaacttgtagaagttgaatttaaacttgcatgtttttggattgatatatttcatattaatatatgttaccaatttttttaaaaaaaatttatgactatttagttgttatgcacgaaacgaggggatatctcctcaaagtatgatctatcactttcccaacaataattagctaggctctgttcgctgctggaggttcccaaccaggaagagtgcgtacggaaaatggagcggtccattagcgtgtgattaattaagtattagttattttttaaaaaaataaatcaatatgattttttaagcaacttttatagagaaacagtttttaaaaaatgaaccgtttaacagtttgggaaacgt

SEQ ID NO: 48260 - DNA, 1501 bp, Oryza sativa
ggttaattaatggataatgagcttgatggatgtccaaagattagtaaagcacactagcactctgcttaaccatttcaaccaatatccactaaaagtgacagtactttgcctaaggcactaacttaaaatatttgagaatattttacttttaattgagatatcctttttaagtcaacagagtcaactgccttgaaaaagtcattagtaaaaggcaaaagcgcgtgtccaagtcaatccatacatatccatcatctttaattttgtgcttagtgttagaccatagttttaggccatcgttatagctcatatcaaccctacctaggtagctagtaatccattctcccattaattaatttctatgtgcaaaatttatacccagaagtagttattgttcctagagtttactaaagataatgacctcattcatctaatgatgattataaaccttattaccaatgaaaaaaataataatttgtaagtaaatcatatatgcttgtgtccttaacaatccaaaattctgaaaatcaattgtaagaaataaagtttgatgaaaaaataaaattaactttaaaatacagttttaaaatgtaaattttgatgatggtttataagttgtagccttataggacgaatgatgggagtataaatcatcaggacaatcaaccatagcatccaactaactaaaacaacgggaggttctactactaaactagccactaataatgcaatcatgacaaaccagcaaaggaataaacttattactaccagattcatcaaaccaaaccttggacgagtttaccttcatcccatgataagcggtaaccatgagatttgttgtggtttcaaaactaaaaaattaccacacgtaatatataactgtaataaccacacaataatcacacggtttcgcaaatgagtaagtagtcccttcatctcagtatataaataatttgaattagatgagatatatcctagtattataaatggacaaagttagtactataatttatcacatacaactaaagtcatttatattttggcacgaagagtacctgtattagggttttttcgggaagcttaaaattctgagaagttagctagtgagaaagaagctgaaaaactcagcttatgacttctagtttatttttcagattctacagttatatattctcatcctctaaataaaaagactataggagcttccgtcaagtagcgagcttccgtcaagtagcgattaaacaggccctatgaagattagcgagggaaggagtgtggtgggccccaccaagcaggagaggggggtgtggggcccaccatgcagggccactcactccaccaccacaataagagaagacgaattgacaattccaccgccgcccgcactttgctttgcttccggtctccggtctcctcctccaaactccggtcggtctccggcgcggcgcagccgagcccccaccatacgacgcggggaggcagacgacggggcgccgctgctgct

SEQ ID NO: 48261 - DNA, 452 bp, Oryza sativa
acgttcttcttcttcttcttcttgctctggtttcatggcggttgctctgtccaaggatttggttagtttcaatcctttgttacagtttgggtggattaattggagagtctcctttgctgcgcgactgcaattgtgttcttgatttgcttggctcggacttagtcagaggcgctgtgtctttgtttctcttcgcatactgatttgtggttaagaatagtctctgctttgtggcgacataaaattctcacttgttcttctgtttccgctaagaaaattggcttcttgtttttttttctctttcaaaaacctgcgaaactcgaaaaaaaattgaaacgaattgcctatgattagtatgttgctcgtaaacggaatagattgaatcagcacggttgatggatacagactctttgcttgtgtctgattttgccggaattgatactgattgctacaga

SEQ ID NO: 48262 - DNA, 563 bp, Oryza sativa
atcgcatcgtttctcctctcagcttaccaatttatctgctcgacatcaactctgattttaactcttcatatctagagcaaggatttcttttttacctcaccattttttttccattccactccgtatatatttagcattttatttatttatttaaaaaagattagttttcttgtattgtgaaattaattccggatgtcacaagagaacagaaaaggaaaagggaaggggaaaaaaagaaccccccgagagatttgctcctccttcgccacatggccacatcgttggcgccgacgtgtccacacatgaatattccaccatatattcgtggtccatgagatcaacaagaaaaattctcctcctccatccatctctccattctataagcatttttcttctcatctttttttttaaaaaaaaagtccagctgtgctttgagatctcttgtacttatgatattcaaaagtttaatttaatactactactaacaagaacgtgaacacaacacatgatggttagtacaaaggtaggtgagaagtcggtgccatgtgcataattgccattca

SEQ ID NO: 48263 - DNA, 436 bp, Oryza sativa
ctgtactctattctttgtcatggttctctcattttcccctatgagtttttacatgacaaagtttttaacgaggcagcatgtatcattgtatcctgtgatgatatgaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaattttttttccttatacatttcctttgtttttttttttaaaaaaaacactgtgcact

SEQ ID NO: 48264 - DNA, 1501 bp, Oryza sativa
tggaagagggattacgctaggagagatttatatactgattaaggaagagaattttgcattggctgttagttcacgcgtgttcttccatctgcccatctcattgtccacgtgtcatctcaaagcacacagcatatctcgaactttactaaccccatccttttcttttttattttttcttttgctgttggcagaatccgtggagataaaccggagatgcacatatatactctattgtcccaaaataatcaaatttaggatgggataggataatacccgtcctatctaaatttagatttattatgttatatctcatcatattttaggttgatttattctgagatagaagcaatatgtggaacccagatttatacatgagtatattcacatatattttgacaaaaagaagttttagctatgtgtcacaaatttcacatctctataaccttttaagtataaaagatttatcacgcgggtataatggattttcgtaatttcatacagagctagagttaagttaatatataaattatagacctaaaggctcgtgatcaatgcccttcgccacctctaaagttagtcatatggatatcgatttcgcaagccttacttattagggccgacacatggctaaaccaagtgatgttgggtctgttcggctgtctgtttcgtggttgcggcgtaaccagcaccaacagtgccacacacacacggcgcagccgcagccgcagccaggatgccgaagagaccccttatatacaccaactgatatttattagacaagagtatttcctaaatatatattagagtattatggtgaaatttaatatatttattagtgagctttcacttaaaagccatgcacgacgtgaaatgacctgatactttattttggtgtttctatagtcaattttttaacagtaaccgtccttttccgtgaaagataatataattaagatatgccactgtccatcgttgtttgtacagtccttttcccttcgttttactataaggaagatatgccgacatataaccatgcattattagttaccacaacttgtttttatcctttttaaaactttcaagggatcgattttgtacattgacttgcagtgcaagtgattttgtactctcaatccaacgcaataacatttcaattggaggatatccactcatttagattcgttgaggtaaaatgtatcaacttcacaaaaatcatatacattacactcagagaacaaattaattgttttcttaaaaaatgaaacaacatattgactttcaactaattcattttcaatttgcaatacaaccataattaataaaagaactgtgtgcaatccaggaataagcccttcccacatcatcgcttatatttcccatgcatcttctctagctggctactgcaattttttagattatattatataatgatcaatttgggaaggagggagtaatgactttagagaggagcgcaggttctctgtatcgagaagtaccacat

SEQ ID NO: 48265 - DNA, 1501 bp, Oryza sativa
ggtcacactgacatataagtgccaccgtgatattgccatgtcagcacacaaagtgaattgaaacttgtttgaacatactcatgataactttggagccagaaatgtatttttaaggttcagacacacaggtaacatacccacataattttagagaccatccatacacttctctaatgacatagggactactcctatatatgattgttgttactgtacttgccaccggtttggaaggaaacaggtttcaagttgacagtgtcaagaatttaactttcaaaaaaaaaattataaaaggatgagaaaaacgatgaaaatttgccagaattgcccctgctcctctccatctatctccctttcttccctcgcctcaccctgtctgaactctgaactctctctctctctctctctcctcctcttcccggcggagtcccccacctcgcctcccctccctgcgcgcggcaccaccggcgggaaggtctccggagtgcgcggcggtgtggacgtcttcctaccctccccgtcccaaccccgcggccgcttcgttcttggtcgtcctcggtgtgttcttgttgttgttgttgttgttcggatcgagttgatttcgtgcccctcccattatggaatcaggtttcttcagggtttctctgatgtagggtagaagattgtttggagaggccaagaaaaaaaaagttcttttggagttcagctgaactcgttgttaggtcgtttgcccctgatttagattcgattctgaggtaataaagttgcggaattgtggatgtccggaggatatccgagggttttatccgctcaatttgatgtgatcaagcaaaaaattcgtttctttttatgtttaaaggccttaatactacacaagctagtagtagtttgttttcttctgctctactgcaaaagtaagtactccttgtttgcatcccttggtggctttccagtacctaccatctgatgttgtagctccttggaaactgcttgcttatccctttgtcatgataagaatgtggtgtgaggaagaaacctgtattctttgtagttatacgctttatttgctttccttaaactctgtctttgtctgatttaatgtaaatacaagctgtcgcgcgaattcgttatcttgtcatgacttgtcaagaacagaagaacagtcctttctatgaagaagttttgagcctattgtatgtgatcggtagtgactaaggaatgctgatttggatttaccttcttgtacttgtgacattgcagaagatcaaccgtctggccgggagcctagagttgttaactacggtgtttcagagtttttttgttatctcttctgctgttgtgctgacttctaatgggatggggaaacaccttaaccaggcgcctcaaagtcttttccatggccttgtttatatacttcgactataaggtgtggttgtatcacttcttcatgctgttctttcaataaaaagtctcaatccattctactagtagaagcagatta

SEQ ID NO: 48266 - DNA, 1501 bp, Oryza sativa
ttcgagctctctgctctcctcggggaattaaaagtggtttgttattgtgcgtgtgcgagaggtggaaggaggtcagctacagctacacccatcctcttcttcttctctcacttctgctcccattttgttctctctgccttgtgtgggtcctacaccctctcctgctaggctcacaccaaattaatttacagtgttttgaattcaggacaatgaatatcagattttaaaaaacattatttagtattccctctgtaaaaaaatgcaacctagaccctctgtccagattcgttatattatgacacatcctactaggttgaatttttttaaggacaaagggagtaaattgtattaatatactctcgtactgagagtattgtttaagtttggagtaattattaaataatcaattagtgttaatggcttaactctcatattgtttcttgttacggctgagttcggcgctcccttttcccaacccaccttactaatcgttttcacgcgtacgcttttcaaactattaaatggtgcattttttaaaaaaaatatatatacgaaagttgttttaaaaaattatattgatctattttttaaaaaaattaactaatattaaaaggccgctctgttttgcgtgcagaggagggattggttctcctctcaaacacaaaacatttgagggtaaaagtacatgaattaggagtaactattattttgaaggtcaaaactgaacttaaaatagttcactaagaattattctttttgaaataattgcatgtctacaagatccgaaagcgaattcatccattcatccctaagcaggaaagaacatggtctctccgcgttgaaaatttagctcttttccttgagtacaaaatttggattccttctaaagttgtggcacacttttagaaatttatccttggttaaacgtgctccccgataattcggagatataacagtaatagtcaattgttctttgacatattatgcactaaatattagagtactcaaatggacggttatggtttgactgtagttattctagtacagtgattgatttcttttaaacaagaagatatggttatactgcaaaagaacttatggttacacagtatgttgtattttcgcattgtgaggtagaattgcaggatgaagttctactactaaaacaaaacggttgaactattgtggaaagagtaggagaatcatttttgagttgaattggccatgtggcctttgcaattcttcagaccattctatctctacttctgttaaccatatataatcattactagtacaatactatatactgtattatcatatttaaccgttccatgatttcatctgaacaaacgaaacatttgcaacttttaataatcctcttcaccgctgaagtgaagggagctgaacttttcgtggttttttctttgagccctttgacttgagtatagtttgtgtgtttatctaccaacaaacagtaatctcactggcacgagcatcatta

SEQ ID NO: 48267 - DNA, 1501 bp, Oryza sativa
ataaaatgatgacccacgcttttgctgccgaatacaaggataaatgtactcttaatattatagaaatgatgaatggtatatgttgagatatcttagaaatgataaggggtgataatttgatatgcttgcatgtggagctttaatttaataaattgtagtagatgatgtggaatgtttgcatgagtattaagatgtaataattattagcggatagtgatatggtttgtttgtacattaagatttagaatgtaatgggttgtaaatatgtagtaggtatagaatttttttttagttttttttattgaagcttcaattaagattagtcaagatttcacatgaaggattatgtaacaatgtagcttagaattagtaagggtccatggccaaacttccaaatacctttctattggaggaattttcaattgttattggacattagagcctcatagattaatagtgttcaactaacatgggatcatacatactggtgataagtatgtctcgatgaaaaagcagagtatggacacatatattatcactagttgtattcccttgagaacgaccttatgcctagaattatcaagcaatgtcgcatgtctggatttttgtactcttaaaaagttcgatgtttttttataacgaaaatggtttgtatcctaatctctgccatacaatacacaatcaatacggtactagtataaaggagcgcatacacgggtttatgtcagtaatatatttgagggctatttggtaaggtttcaacttataaatttaactttaagaattaagcctgtagtgaagttaacccagctctatctctgaagttcattttgtgataacactccaatcagttccactcaattggtcttgacgacccaatttatttttacgtatctaggtatttgctcaagttgttcttacctttaacctcccaaccccttctctctctcttcgcacgcacgctttttaaactgctaaccggtacgtttttttaaaaaagtttctatacaaaagttgcttaaaaaatcaaattaatccattttcgaaaagaaattagctaatacttaattaatcattcagtaatgcgtgctctgttttacgtgccggggagaagagattcccaaccgctcctcccgaacgcagcctaaggtcaaccgtagttatatatgcctcgggtctattttttttcaagaaaaaaaaaacgaatcagatcatgtccacactgatcagatctttggagaggcagagacgggaatctccacggcgatcacgtccacaccacacagcacgaatcttgacgtagagcccagcttgtatataatggcacgcattcctctgcacctctgcagtctgcacacacgcacaagaatcgagtgagccagagttgagagttcgttccatctcccttcgctcgccacgtggcagccgctagtccttatcgccgccgccgcccacctcgccatggcgccgccacccgccgccgccgccgccgtggacggag

SEQ ID NO: 48268 - DNA, 777 bp, Oryza sativa
aacatcgatccatcatcttgtaaatattttgttccaaacacaaaatgaccacgtacgggcagcttgcaacaaaaactgctctactagttcattgctcgccaattggccattggtactcgaagagtacatgttcatcttggaaaaaaatggaaagctgaacagaatatgaaaaggtgaggatcttggaactggtccggaatctatgccttttgtgcatttttatatgttctataatcctcacattaaaaagcttgctttcgagcactaatcatgcatactatttcttttgaaacaaaagctctaatcatgatgcatgcatggtgacattggtgagtaagaaatatttgaaagggccgaaatgagaggcctgcatgcgccatgacgactccacgcgttgctgcccacggaaaaggcgccgtttagccaaaagatgagcgaaaagatgtcaaatttacttatattgattcggcgccgtaaagcaagatcacaacaactttaaaatggttcaaccgtaagaattaatattaaagtaatagtacgatacaagtttagcaatataattaccatattctttttttccataggaggagtgcattataggaaataccatacataagtgttaggtttcatattttcaacatacaagttctagaaaatagcatcgcatatagctaatttctctatgaaattatttcaccgttatggctctatcaatcccgtccaacccactaaacgtataaaaacactcttgcttgcttggccacctcctcccatagc

SEQ ID NO: 48269 - DNA, 1501 bp, Oryza sativa
atagttactcctaattcatgtacttttaccctcaaatgttttgtgtttgagaggagaaccaatccctcctctgcacgcaaaacagagcggccttttaatattagttaatttttttaaaaaatagatcaatataattttttaaaacaactttcgtatatatattttttttaaaaaatgcaccatttaatagtttgaaaagcgtacgcgtgaaaacgattagtaaggtgggttgggaaaagggagcgccgaactcagccgtaacaagaaacaatatgagagttaagccattaacactaattgattatttaataattactccaaacttaaacaatactctcagtacgagagtatattaatacaatttactccctttgtccttaaaaaaattcaacctagtaggatgtgtcataatataacgaatctggacagagggtctaggttgcatttttttacagagggaatactaaataatgttttttaaaatctgatattcattgtcctgaattcaaaacactgtaaattaatttggtgtgagcctagcaggagagggtgtaggacccacacaaggcagagagaacaaaatgggagcagaagtgagagaagaagaagaggatgggtgtagctgtagctgacctccttccacctctcgcacacgcacaataacaaaccacttttaattccccgaggagagcagagagctcgaagcaaacaagaatcacaggagcgagcacggcaggctgcagcatcaccaccaccctactctctctctctagctagggttgcgctgcttcggtctcggtcttggcgccgcctgcctcgcccttcttgctcgcccctgctcccctgtccctctcgtgtcggggcgacggacggacatcctcacccgcgcgcacgtacgggtgatcgatcgattgattcctgctccgacgaagacggcggcggcgccggtgacctcgccggacatgcgcggggcccgctgaggtctttgttgccggcgaaaggggtggagtgattgactcggtcggtgtctgcctgtctggtctgaggtcatgatgaagcaggcgcagcagcagccgccgccgccaccggcgagctctgcggcgacgacgaccaccgcgatggcagccgctgcggcggcggcggtggtggggagcgggtgcgaaggtaggacgagttcttgctttgcttgctgcttccaatggcggttcgggatggagcagtggttgccttgccgtgttcttgtttctgcaatctggtccctgttttatcgcgttattatttcgccacaaaattaggcaaataaatcctttcttattcttcttggattttggattactgcatttttttttctctgcatttttgttcctgtgatttctggcgagcgtcgcagcatttactgttccacatttatgccccctcaaagtttgagtaatcgcaacataggagtacgagtagctgctactgcagtgctaagccatgtgcagagattaattggtttgtg

SEQ ID NO: 48270 - DNA, 1501 bp, Oryza sativa
gaataactctcaagttgttgcgtttgaaaatgtaaaaattatatgaatatatttgtcttgaaaaatactttcataaaagtatacatatatcacttttcaataaatatttttacagaaacaagaagttaaagttgtgttttcaatactgtgtcgctgtccaaaacaacttcctttacgagtacggagggagtatgtattaaaagaaatacaataatcctctatttctaaataactacaaccaactaactgcaattattgtatactaagtaagttcgattgaattaagtaaaatataattttgctgtggggtctccagtttagacctgaccaaagacttgaaacttgaattcttgaaagatgtaacgcaagcatatgttgcggtcaagttgatgcgcttaatttgcctttggctctctacacattcaaaaaggggaattcaaacgtatttacaaagtgtaacattctagatgaatttgctgccttgtcaaatgtcatgttagtctgatagtctcatgccttgactctgctgcatcaacttattatattcgagtgataactaatttgccttcttttcgaggacctaaatgctaatttgcttgcgaacagaacatgggccaggatattccaaagatattcgagggctggaaaacatgggccatgcccaacttgagcaaaacggacagcccataaaccgggagtacctatacatctttcgaaagatttttatgatcgtatcacatagatttttaatctttagattaaaatccgatatatataataaaaggcaaaaagcaattaagaaacaccataatggatactaaattaccatatcctcaagaaaaagaccaaatccaatacaaaatttaaaatttacatgcgaagattcaaaaattacagtgtaactaacaaaagttacagtgtaagtttcataaattacactgtaacttataagaaaaggcactgtaaatttgagtgagaaaatcgagtgagagataagaaaaaatctttcgagtgagatatagcaaaatcgtaaagggatatattcatggccgagaagacccaacaaacatgggccaggcccaaattgagcaatgcgggacagcccataaagggtgctatttatggcccagaaggcccaccaaacatgggccaggcacaacgtggaacaaacaggacggcccatgagggcactaataaggcccatccgatcaagcggcccgcccatccactccgtctccacccaacggcggaggcgacgacccgatattccgatccgccggcgccggcgccgccagtcgccgactttatcggccgtgcggctcactccactccgggcgccgccgccgctgatcgccggcttcatcaaggattcctcctctcctattgggaagcttcgggctcctctttttttcctgtgagtagcaagggctcagcgcgtttattatccactccgtttattacaattccagttgcttttttttattattattatttcctcttc

SEQ ID NO: 48271 - DNA, 1217 bp, Oryza sativa
tttacccttggatgatcaaaaaattcatgaattacattattaaaaatataaaagcttctcgcatgagactattatagttatgagtttgttgtgcgatgcattatttatcccaaaaaaatatttttagataatgaaataaaaaaaatacgtatttattttttaaaaaaaaggtcataaaaatgaggagcattcatataaagataggtataccaatgttcacaacatttttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacattaaaatgatggaaaatgtaacggtaggggcatggaagggatcaaattgaaatttcaggggtatagaagggatcgggtaaattttagtggtataaaagggattgagtgagttttcaggggtacccagggaatttactctttttttttccctttcatatagcaaatcggtaggagtcggactttttttaaaaaaaatttcgctatttttttttgaccggacctggaatcggtagagtcggactttttttttatttttggatcggactcttttttcgcccagtttttttcccaaggttttttttagccagttttttttcgctcttttttttttatcggacgttttttttttctcccggtttttttctttttttgatcggactcttttttttcatccgggttttttccgcctggttttttacggatgataaaagcacctcttgtttttttaaaagtaagcagagattacggccagttggaccttcccttctggaaccatccacggccttccaaacccctcccgccaacccccgtcttctctctcgaaccatccgtccccaaaatccgccttctccactctccaccctcgtcctcgagcttcgtcgaacactctagaacctccataaatacccacctccaccacactattataacaacctcgcctcccttccctcgctcttcccaagtcacagctacgcacgcacgcacgcgcaccacgaaccagcacgcgcaccacccaatggcgg

SEQ ID NO: 48272 - DNA, 267 bp, Oryza sativa
aatcttcatatgatgtctgaattacaagtccaaacctccttaattcttgtgtttgtgcgtaaacctatcttcatcttcaagcccataaattatgtctgtaaatcattctacgtgtcacctgtggcctactgcctcgagaacaaaacatagttcagtctcacaatcttctcataaacaaacaaacaatgtcgggacatacgtcctgcgtacaaggcacagatgttataccatattgcaatagaaacaagaaagaacaacattagtagc

SEQ ID NO: 48273 - DNA, 262 bp, Oryza sativa
agtgtgtgctatctgagttgctatttactttgctacttgccctcctaagggcttatctaactcttaccccgccctcttctgggagtttagatggctagccgcccccgccgtgcagctcgtgcaccagcccgctttggttttgaagatggtagagccgagccagaagcaaatcatgagtcagctaatgagcagtctcaccacagcaaccgttcacaccgtactgtttcccgcaacgcagaagttgagcaaccccgccacagca

SEQ ID NO: 48274 - DNA, 1501 bp, Oryza sativa
tttgaaatttttttgtgattagtatttttattattattagatgataaaacatgaataatactttatgggtgtctatttttttaattttttttataaatttttcaaataagacaaacggtcaaacgctggacacggttcctcacgactgcacttattttgggacgggggtacgtagtatccatcgtaacgcgtaaattaatatactactacttgtcaaatgaaactaatgtctcgattcctgacatgttggaattataatattgttatggtcgttattgttatatactagtatatgctagctgaccaagcaacatcccgcccaataggtttcctgcataaactgaacattacaccagtaacacgtatataactagtgacgaactgatgatttcattcaattatcatgacattgcccaaccgatggtatatattatactatatgatactcgtccggtattctaaagtattttagttttgttataagctaaatttatctaactttgacgaccaggagtatatgacaaaatgaagatgcatgtgctttatgatagaattagccaatgtttttgtacaattaataatttgatattgtctatggcgccattggtacaattaataattacgggtccatggatctcccctggtaggatattatttcgatagaaacatacactttttcaattaataaaattaattttattcaaatttaaccaaaatttgttcaaattttaacttagttcaattcggtccgaaatttatagaacttcccaaaattccgtttctagaattgtgcattatattccgcaatatatacaatacctacaaaatgaaaagcaaaaaacatatcgttgaagaaattatagactattaattctagctagcttgacatataagcacatgcatacgctgatacatatatgcacatgcgtgaatcacaatatatgcgcataaatgccgggtaaacgcaaacgttttatttgttggatcttcccgtagacagtacgattgctagctattgccggtcaactgaacaagccgaaaatttcactgcagaaaattgaaaaaacattgcaaccgaaacacccgtgcggctccggtttgacgcgtgcacctgatcgattatgatcgatggagaaacagaatcctgatctgatgctgccgtgcacgcgttcctactggtcaattggattgatacgtactccatccgtttaaaaaaaaaaatccccaactgaaacttatatcgttcaaaaaaaaaaaaaaccacaactgaaacttggatgggatataatctaatacaataaataaatctagacatgctaggtttttttagacggccggatggagtatatgaatctggacagaataatctatgtctaaatttgtagtattatgatgggttaacatcgggtactaaattgctatttcgtgggatggaggagagtactattaattatttaattactccctccgtttcacaatgtaagactttctagattcatta

SEQ ID NO: 48275 - DNA, 236 bp, Oryza sativa
gggtcctcgatcctccggtcgccccgccgcagtagtcttcgcccggacatccgaccaaggcaaagcgccctgctcccgcgttgcagccaccgccacctcgtcgcggacagcgggacttcctcctctccggcctcacccctggtgacctcctccccatccgccggccagcttgcctagaggagaaaagtgtgtgagaaagagagaagaagaagggagagggtgatgacgtggcatca

SEQ ID NO: 48276 - DNA, 1501 bp, Oryza sativa
aaaatcttgtcgcttgtttaagtgagttgttttcaaagcaagtcagtttagggttttagtaaaattattgggatttattcgtcagtcagttggggtttgatgggtgaaatgcattaggtcctagctctataacatgggttgcaaggtatttatgctttgttcgttattattaatatgtatctaatttctcattactttgtcgttatatgagtctgtcttatttattcgctctcatgcaaaatgacctatgcataaaattttgttcttgttcgattctcttatttgagtcttttattgctttatttaaatttggatttgagcatgcattgatcctactcctttgtcttctctagatggccggtcacccacccaaccaccgcggagaaggcatgatcgacttcgtggcagagctggcacgcatgacactggtggtgggctaccccaatgcgccggagtacacgaccatcccaccgctcagtggcgagcttcctcaccgtgtccgcttggaggtccatggctacgtggggacttgcctcgctaacatggcggttgaggcgtcaggaggcacagcagatcatgcctgtcaggaggcagcctacttgatgatggccaggttacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaagagaatgctcagttgaagggtcttccagcaccaggaggagtccggatccgcactacgccccgtaagaggacgactgcacccgtgcgcatccagcttgcgcccaggaacccacctccagcagcagcagctccggcagttcctccagctccagctccagctccagctccagctccagctcccgctcccgcgttcactctctccttcgctccagcatcagccgccagaggaccagccagtggtaccggaggttggttgtctgctactcccagtggcagcggcgagactgatctgtcaggctccaggagtcgctcagagggacctggtgacgagcaggaggacgccttcgactccaccgaccgcaggagccgttccgagcattaggctcgttttcccattagtttatcgattgtctagtttctgtttgttagtttgtgtgtttaggttgcttgtttggggtcagtcgacggtcgatatcatgtgcctatgatatggctgtcttaataaggatgtttgcttgctcttttaagtgtttttaattcagatcagaacaattgcagttttaattcctttataataaagcttagctcttgagcatctgtttttcttcttctcccccgtctgctttcccctccaga

SEQ ID NO: 48277 - DNA, 1501 bp, Oryza sativa
gaaggactctagaaccactgcgaccgaagcgagcgcagagtcgaaaaccctgaagtttcgttccttctacagctgccaggagactaggaataccaaggagtcgaagccgctgcgaaggtgctcaggtaaacataccctggagaatgaccaccaatcctggagccagctgccacgagggggagagagggcagcccagccaggaggggataacacacggagccagacctgaaatcaaatcatatagcagtagaacatgaagcaactgacttattattgactattcccatgcataattaagcatgatgatacaccttttagtactatatacggttaacaaaacagcccctgcttttttagatgccacggcaaatcaagcagttgcagccgtgaaaatcactgcaccaatagtctcggactttccccttctttataagaccttcaccccagcaactaaatttgcagaaccttttggtgcagaacactacccagccaatgtcaataatacaatcctctgtgaaaaaaaagagattaactaccacttgttataatgcttatcatcaatcagactatcaccattcagaacttgcatggagaaggaatctgatctataatttcactgttgaatatgcacaaagcactagttataaacagagtaaatcacaacaaacattgcaagacacaacatactccctctctctaaaaaagatttgacttctggctatttacttgcctctatgcttagccagaaatcaagtcttttttttttagatagaggctacatgacaagaaaaggtataccaataacgtcaaaaaatagtcgagaaagaactcacctgtctaggggcaaatgtagaatccaaattaccaggtatcatacacaagtacctcttaatcacacatatgctactttatttatgtgataacatgatcaaatgctaatgaatttttcagaacttaccctgtgtggtgtgcaccacttgagctctgtgtggatccacccttgcacctgcaaatgttggattcagaagtagaacaagaaccaagatgaagcgaagatctagagatgttgcttccatctttgagaaagggaatgtggttccctggtacttctctccccctatatataagaagaacaaagggcagacctgatacaactgttttccatttcactaattctcgctgcacttattatttggctaaaaaacaaaataaattaaatgcttccaggacataagcaataactcaagaagatgtcaccatttgactaccagcccatctctatggtagatgacacccttcaatagctcctcgagatttacatgtacctatatatcagtaaggccattccttgcagactggaggcttcattagtatgttttcaagtgacatataaacaagatatttaagaaatttaattgatggttaaaataactcacacaatgtattgtttcatttttgctatttcataggcaacacatgcatagacgagtcatattggaaa

SEQ ID NO: 48278 - DNA, 1501 bp, Oryza sativa
ccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactataagcccagccgttgcccacgctggcttgtggtaagtacgataaattcttccagggcatcccgcgaaccggtccttaactgccatgggtgcgactagcaaaaccgtgcacccacagcccaccatgtggttcattttatttaaccaacaccagagcggtggtattaaaccaacattatcatataaacctatagtctaggttttaaatgagatccccaatgtgtgctagttgaactaagcatggctaagcaagtcctagtccaaagtctaatcatgttataacccaagctaacaaaggagcatgatatccaaaagcatggctgtaacagtaggtatccatcccatagtgatattataaaacaatgcaatatttgaaagaaaacaatggagcatttgcaatataggatcaacatgttcaagtgacaagcatgacttgccttgctctgctgctggaggtacctcggcgactatttcgaagtacaccggagcgtcgaaagaaccggaatctagcgacatacaaagcaaacattgcaaacaggctataagactactgaaacagagaacaaaaccatttttaatggattctacacatttttcttgatttactgagacttaaatgggattaaacggagctcggatgaattagatatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaagagggtggcggcttgcgggcccaccggtcagcggcacgggaaaaggatggggcggcggcgccacgtggcgaccggaccggcggccccgatctacccaagggtagatcggacggcggcgcgggacctcgcggccggggcgcgcgggcgcggcgcgagacggcggcgaccatggcgccggcggcgcggcgctcacacggcggcggcgcacatgcggcagcggcgcaaagcgacgaccgacggcggcggagagcggcggctagaggagaggaaggggaaaagaagggaggggatgcctcaccgagggtggccg

SEQ ID NO: 48279 - DNA, 1501 bp, Oryza sativa
ggcgccgggcgtccctcgcccagcgtgactatctcccggccggtggcagattccggcatgaagcggcgcggcagcccggcctgcctctcgctcacgatgcgggaagacggcagcacgctaccatcgagcagagcggagccccgtgccatggcgccggaagaggagatgtttgagaacgagcgcgtgtggcgaaggtagggcacaggaaacaaggagttagggcgcaagcggcgaagacaaggggaataatgacgagaggaaggaagcaaatctcttcctcggtgtcttcatacccttgccaacgctgtgcccggctcctcacttctcgcgcccactatctcgctccctcgtttctcgcgcccacgcttccactaatcccattcgcccgcttgcggcgcatgaggtggatatgcggttgtggcagtcgagatggaacatatcgtgcccgcgttaattacgctcgccgaccgaagcgccatcaccatatctccaggcaaaacgaaccggctcgtcccgattcgcgtgctacctgagtaatgtggcagtcttgaagaggccgctcattattgacagtcgagttaccgttgccggagtgcgtgatttgtgaccattgggtttctgcccaactgtggagaccggtcccacctgtcaccaggcttttggaagtggcgtcacgcccgaccgcttcccttaaggagggcaatcgccctggcataacgccgggggctactgtcggtgacatgggaccgggagtatcatgactagaggcttgggcaggagcaatcacccacgaggcctgaccccctcgggggggtcgggcccgagggtgatgtggccgcccccctctttgtctccccgaggggtcggaccgctcccgtttcggccccgagggttgaggcgccctgtcacaccccgaagttttcctccctagtcaaaattgtaatttataattgaccctaagaaaatgctggtgaaatcaggagaaaaccctaagaaagtaatgcaaataataatcggatttgacatgtggaatttttcttgaattctacatgtcgaaattcattaacaggatttttagtggaattttcagagctctagaaataattttaaccaattaaaaatcactaaagtgcaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgcattccccgcgcccgttcccctccctctcccgctcgcgcccgcgcccgaga

SEQ ID NO: 48280 - DNA, 213 bp, Oryza sativa
cgccacatgtatgggttaggtgagcacagcggggctcacctaaccgcatttattgctggttggacgagcgcgccacgccgcatttaatgcaacgcatcgcacgcttatccggtccgtgaccggtcgcagtgtgtgaccggtcacagaacggtcagatcgcgggttaggtggcaacaggcggcctgtcacacgcctcgccccgtcccgtcagaa

SEQ ID NO: 48281 - DNA, 1501 bp, Oryza sativa
gcttaatgaactggtgtagttcaggtggttggttgggcctgttgcaacgtggtgtagcgttgaacagtgattggttaatattgattaatttactacaattgttttactactttcaactactgcttttaaatgctagctttgtccaaaagaacccctagcctcctttggttatatcctgcatcatacctcctcttccggtatgacttgctgagtacagtgggtagtactcagtcttgctctcttttcccccacaccagagctaaagatttttctagttggagctatcttgttgaagttggttttgtcgctgccgtcaaggattgcctgtggagtggagtcgccccgctgctgaagtcaagcttcccggtttagctcgcttttatcttttccgctgcatttgtaatcttttctatttttgtaagacgtggatctgtatgtcaacaattgtcgtttgtgtacccgggctggtcctggacagggatttaatgcacattcagcttagaaattctggttcgtgaatttctgggcgtgacagtcgtcgacgggcgtgtccttcgtcatccacgtcccaggccggaactcgtcaccgacagtcacatcctccaccgtccacgccacgtcggagcttgtcgcgggcggccgcttcctccgccgcctcgacaagctagccaagtacgtgctcgtcgtgctccacgccaacgacgcggcgagggcagcaccttcgcgctctacttccacatctaccgttgcgtccgcgctgggctcctcctcccctgcgacggcgccagtgctgccggcaaggagctcgcggtcgcgcgcggggtagtgcgttgacggtgcgggcatgggcgccgtagcgccgccgcctatgtcagccatgcgtgcgtgctggagcggcaccgtgtcctgtacaggctgctactgctactcgggacatgcatggtcaggtatcgctcctctttaaataagcaagtgtcccgttcggacgggattccgatatgtagcattcccgaaaacatagataatgtataataaggacacacggttcatgcttgtcccactgatgtgtataattaaagccctactgtacacgtcaaagaagctcaatgtttaacccattctgtaaataattgtgttgaacctagtggatgaggaaaaaaaaactcgttctcgccgctaagccactggcttctcctcgtttaacgggtgtctttaagtacagggaaacaaacatctaaaaaagaatgcaatacttagtgtgtgtttgagaaggataggattgaggagattaggaagatacgcaaaacgaggtgagccattagcacatgattaattgagtattaattattttaaacttcaaaaatagattaatatgattttttaaagcaactttcctatagaatttttttgcaaaaaaacacaccgtttagtagttcgagaaacgtacgcgtggaacacaaaactatctttctctctttctcctgcactcgaacgcgcagcc

SEQ ID NO: 48282 - DNA, 168 bp, Oryza sativa
ccagctccactcccagttttggtggagctgaaactgtttggctgagctccagctccaggagggccggagctggagctggagctgtgccaaacaggcccttaatcatccctggaaaatttcagtacaaaaagggaaagagaatcataaacaggtagtgatccctatcca

SEQ ID NO: 48283 - DNA, 1501 bp, Oryza sativa
agttggtaatatggaggaggcatttgcattacttgatgctatggcatcaattggcattgaaccgaattgttacatatatggtacgcttgttgatggctattgtaaaaatggaaggattgatgatgcattgactgtattcagagacatgttgcacaagggagtcaagcctacaagtgttttatatagcatcattctccatgggttatttcaggccaggaggacaactgctgcaaagaaaatgttccatgagatgattgaaagtggaacaaccgtgagcattcacacatacggtgttgtgcttgggggactttgtagaaacaattgcaccgatgaagcaaatatgctgttggagaaattatttgctatgaatgtaaaatttgatattattactttcaatattgtgattagtgcaatgttcaaagttggcagaaggcaagaggctaaggaattgtttgatgcaatctctacttatgggttggtgccaaatatacaaacctacagcatgatgataacaaatcttataaaagaagagtcatacgaagaggctgacaatctctttatatcagtggagaagagtggccatgcttctgactctcgtcttcttaatcatatcgtcaggatgttactcaataaagctgaggttgccaaggctagtaattatctgtctataattggcgagaataacctcactcttgaagcttcaactatttctttactggcttctctcttctcaagggaaggtaaatatcgggagcatataaaattgctccctgcaaagtatcagttttttgagggagcctggcaagattaatacattgttgtatctgaaattgtttcaacatgttgcactctagagtttcttctgctcccacgggaaggaaaataacctgtcccccaaaattctggcattgattattttattgttgttgtcagtaatgtgttgtttgtgttgaaatcgtgagcttgtcaattgctctgcataccttttatctgttgttattgaatgagaagctagacagcggagttcaaaataaactgttgcatttttaatacgacaacttctgatgaaaaaggtagcacaggtaggtgtatgcattgtgaagatatttgtgaagataggaactaacttacctttatattcttatgttttagttgatgttattcttggcgatcttctgcttataagcgactacttgattacttttgcttgaaggatattatcttcatttcagcacaaaaggtcctttgaagactgaatattgtttattcttcgacaaatttccaacgacactttatcagtaggaggttgttgcataatggtcagatcagctatagtttcgtttggacaatactcgatcctcaaatgttcaactggctgatctggtgatcgcctttatttcagacagttcagagcagagaaagccatttcctatgtttcgtggctatctttctggaccctgattcaaaacaattacttttttcataagcatatctttggcag

SEQ ID NO: 48284 - DNA, 1369 bp, Oryza sativa
cagcggcggcgcacggcgcgaggcagcgacagcgacgttggcgcggtgtggtagcggcaacgcgacggcggcgcggggcttgaggcggccgggcgtgcgcggcaaggagggttagggctagggaacctcgtcgagcacctagagtgcaatgaacagtgctagcctaatttaacctattctttataaatcttgtcctttaattcctaatttttccacaaatgacgtttacatatacttgtgtttattttaatcgaaaaattcactctagattgatagcacccatattttatttttatataattttcttgaatttaattagagttaattcttattccatcacatttagatttaattgatacaaatatggtcgtaataatattttactcatttctgtcctccccaaatcttattttaaattgcactttaattatttaccctgtcaatttacttttagggtttattcctaattaattattccattattcgtgatttataaactccgaaatcaaaatccaataaactaatcgaataaaatcggcatgatgcaatttatttaaaaagtttttgaaggcccaattttttggagtttagatttttgtcggtctaatttttagggtgttacacagtatctacagggacggaagcagatcctctaacttaactgcacatacagttgagtcactgatatgtgggtcccaccttactatggcccatatgtcagtaactcaactgcacagcagttaagtcgcactgacgatactagtagtagctgcgttcgattcagctgcgtctggtgagctgatcgtgtcacgtgaaacgagatgaattattactagtatatgattaattaagtattaacctttgcaaacttaaaaactatttttttaaaaaaaaaaacttaaaactatttttttaaaaaaacaaacttttatactttctttgttacaaaatgtgtgttgctctctagaatgtgatttgacctctgtcactattataaaattgattttaccaacgagacccctttatattatagacggatcataactatcccatatataaaaattgctcccccaaggacgatccgatgacctcttgcaaaaatcgggtgtgttaacaagcctgcataaaaaagtaaacctattttcgcatgtggatattttaagaggtccgcatgcgaaaaatatcccactcttctttctcccctcctccctttcttcccataagtccattcctctcttctcctgcccactccctatccaaccctcccactccccactctcctcacttccctcccactcctggcctctatccagtctctacctctccctctctcttgagcaaccgtcgagcgtgggatctactggtggca

SEQ ID NO: 48285 - DNA, 1501 bp, Oryza sativa
ctcttaagatgaaataaaagctgcaattagtgcgctaacagcatcacgcgcgttcatcatcctagtcatcaaactcatcagaatattgcaacatttcaggagtttctatttattttttttccaaagacccaacatgtctttgaatttatttcaggattcctttttgcattgtcgttgccttggttgtatcgtcctatctacggtacattcaacacgcgccggtgcgccttttagtttcagaattccaccatgtttggcaggcatgattcaagtgcgtgatagctgaataatttaagacgaatcgttagcctcgtcaaatttctttcagcgagattttcgggtccgccttgtcagttctcacacgttctggtctactttggtctgaagtctgaacccctgagagtcagagacgctcctgctctttttcccaaagctcagcctcgtcaggccatagctgatagctgccatgaggtgagtgaataatctgattttatcttcaaaggtttagttgttcctctccttcaggtcatccatctaattattgttgttattttcataaaatctaattatagttagtagatgcaaattttacacttttacagcatttcagtgtcctctctcctcttcttgatgtacttggtgcgcaccggtaagcgccaatcccgctacccacgtaaatatcctctttatagttaatttcctacctagtataaaacttgaaagaaaaaacttttctttaaggaataaagaaagagagaaactaaaatttcgataagcgaaaaaaaaactccacttgtccatttcacttgcatccctaattaaccggtgtcaccaatcatcaaactagggactaacagcttatttataagattttcctttgcggggaagcttagttataagttttagtttaggggactaataattgcctacaaatttggtgccagttaccgatacaaaattaaagtcgcgttcagagaaggcaaagtttgatttgatgccacactagtcgatcaggcagtaggatcttttgactagtgaagggcctggaatgggtgctagtttgctcacttgggccaaaatataagagttttcctgggccgaaacggactactactcttcaactatgtcaatcaaatttcaaaatatgaaatccttaacaagtaaaaaacttctatttaatatgtgaaaatggtattagttaatctctatgaaaataacttaaatatttatttttggaaatatttttcatgaatgaatatataattagaaaatagtagatacagatcgatgccagaaattttcaagtatagaaataaccaatatacggtacataataatataatatttagtttgcaaaatattatgctacttatttttttctcttccgaaagcacaggattaatttgtgcgacacagtgcttaatgttgatccctgataatgacacatcatatgccagggtgacagcaattgatgactacttcgattaattctttctttcca

SEQ ID NO: 48286 - DNA, 1501 bp, Oryza sativa
tctagtaggttttcaagcttgcagtgtgtggtcaaccgagatgtgcgatttgctcttcttcttagagtactagtgactgcggcaataacaggagttgatttattgattaacatggctgctacataatatgatgatggtgcctcaagataaaagtacgctaagatttgcttcactttggcaataactgtaaaagccgtttgttgactattttgtttgatgggtacttggtcttatgatgtgcaaactatgaactgtgaatggaagcttgacaagcatggcatttgctttgttgtaccattgaaattacatagatagttttgtttgatcacaatagatcgaagtatgaactgtgaatgaaggcttgacaaatatgccattttctttgtgcctttgtttcaccatagaaattacatatatatttttgtttgatcacaatagattaagtcattgagtagctatccttggagctggctatgacctatgtaccgttcctgataatattttagaatatgaaatgctttaagtaagtagatgtgttgttaatttatttcatataatgcgcaaatttatagataacctagtatttgagattcctagttaccctattgttcgtgtactattcacaaagttgtgttataggattgacattccatactcattatgtgcttatataacaagaaagaaagtccatatgttccatttgattatatcttctcttatgtagtgagtgtagataagctgctgtggaaatttttttttaagcataggatgttttttaggactggatggaaattgctttatattaatgtttcaggctttggatatatggaactttttacatttacattctcgaattcatcgtacatgtcataaatttcaagctcatatatggaaatccatgctgcctgcctcaggtggaaacttttagatccctaaatttgaggtttctaaggaaaaactcagcctccacccaaccaaatttgtagtttcatatgatgataactaattatatccagaacctttataatcaactttagtcgttgcatatagtaatgttcctcttataatccttgcatcactttttccatcattgcattttctacttctcattgataccaattttctttacaccctatattgttgaatgaaaatgctatgccatctttttgtttactcatttgcatccttaactagtattgtttagctatattgcatttgttggcagttggcgcagtccttcattactttctcatccgtggaagtgcctcagtgattcttctcaagtatctcgttatttcacatgccattttcattttatatggtatactgtattaataattgatttggcaatgattttagagtattccagaaatcgtcttgtttttttggcacagctattgtttgtattttttttttatgtcacagtgttaaatttagatgatgtctcttgccttataatgtatttgaggactgatagtgttttcaattttcatttattcag

SEQ ID NO: 48287 - DNA, 1501 bp, Oryza sativa
ctttaccaatatccgggcacgtcaaattaagaagcgcaaatctatccgatttttttttaactgatagctcatgtgtacctgtatgttgcatttgatgacgtcgagcggggtcacggcggcgtgggtgagcccgcacgcggcggccccgccgaaggcgcaggcggagtagtatgccggcgagaacagctcgatcatcccgaacggcggctcgctcggcgcccccgcgacgaccgccggcgcgcccccgccgccgccgccgaccccgtcgtagaggaagctcgggagcagcgagttgcgcggcgccatctctgtcgccacgacgctggcccctgtggtttcgtggtggttggatgactttgatcgccgcgtcgtctcgggccgggcggctttgtgttgtggacaccttgtggtgttcgttcgttcccctcgttgtttggagcttcgctgcccgcgcgcggccgtttttatacgggagaaactggaggaaaagcgattgtttggttggctcgtcggctgcgggctcgcgcgcgcgcgcgggtgcagtgtgccttcgcgcttggcggggtttgaccgcgtggtgtctttgggagcaaggtgatcgaagggagctggtcgtcacgtgccagcctgcctgcagtcaggtgatgtcaagtcctctggtttgggatttgggattaccttcctgagattggtgttaattttgaccctgtggtttattaggagaccgtgatctgttctcgtagtgaatttctcctcaacttgcgagttgcgacctgcgagggagatgttctggtctggatacgtcgactcgctgttttggacttcggagatgcattgcatgatggcggtctccatgtaggggtgggctaaaaaaagaccgaaccgaactaaccgagaccgataactttagtcataacgttgatctccatagtgtactaatcaattgggtcatgggtttcacttaaccgaaatacacttcaagaattaacccgaatacactccaagcccaacgaagaaattctaatttcctatccctcccaagtcccaatgaaccccacggcgcctcaatgccaccgcgccatgctcgcgcctcttcctcacaggcccgcgcctcctactcctcctccagtcctccactatggcctcccctcccctcatggttgtgttggctggttatctgatgaaattattgtgaataccatacactgagattttacacaccgactctgtttagggaacttatatctcttgatttttttttaactgtctaatgtctactgttcaaacaccttggaaaaaaaatcagtcaaatttaaacgaagaagattttaattcgtgcaccccctaaatctacgtcccttctcttctttctcaccgttacacttcaccgttgtccgtgcttgttgcccactgatgatccgacacctccacgaccttccctttcaaagccgcctcatgtctctaagttaaccaaaagactataaggagaacacaatgaggc

SEQ ID NO: 48288 - DNA, 1255 bp, Oryza sativa
taagcactgtaatcttttgcccactattttcttgtttgtttcacacatgcgaggaaacagtccctgactccctgttaacatgatctccaatgaataaggaagatagggttaactcatattataagattaacagcatcaagacaactaaaaaaatgcattccaaagaggaaaaaaccgaggatgctgaatattcagtttcttgagcttcatttgttttcttataagctgtaataaagttaatctatttttttatagaaaaataaatgaagttatgttgcatctaactcatattattgaaagtaaaatgcggttcaagttgcaaaagaactataggttacaagtcatggtagtcttgtatttggagtataggttatcaactaaactgttgggttgtcttcaatttttttagataatgtgggttgtcttcaattagacgggggaatccaattaacagcctcgactcgtatcctaacttgtctaagaactagcttcgcttcaaccaattctttcgtaccctcagctctactcatgttagctttggctatttcaagtgcctgttgagcttcttcctgatcaatgtcactacccagttccacatcattccctaaaatgatgatctcattattaactttctggcaaaactgctccacagaaccgccgttaaccattgatcattgaggaggcgattctcaagggacccatatctacagctgtgttaattggggggaggggggggtatggtttggtaatatggcaatttggccactactagtagataaaatgatttctttcacttcacaatcccaaatgattcgcttagtgcataaacatttaatttcatttcttcaatttgttctcctcttctaagtttatagctttcgtgctagcttcatcgatgttacccaccaaataaaaagcttgttcaggtagggcgtctaattccccggaaaggattagttgaaatcccataatagtttctgcaagaccaacatactttcccggagaaccagtaaaaacttctgccacaaaaaaacggttgtgataaagaagcgctcaatttttcgtgttcttgctacagttttatctacaagtttagtactattgattatcaaggatctcattatctttttcttttaatagttgtatctttcgctctccctcaactatagtgacaactgatggcagtcttgtgttctgctaacaagttcttttctatctgtgccgttcatactaatggtgcccctcattattttta

SEQ ID NO: 48289 - DNA, 344 bp, Oryza sativa
atatggctttccactcaccatcatcggcatggcattgaaggcaagaactatcccccatgtgacatgtacaagaggagaggcaatgaggcatatgacatgttgagacatatcaattgtatttgtttagattgtttgaccatactggtcaacttaagaccttcctcaggaaggtgccttttggcaattagcagtcattggcctttcattgagtttgcaccttcatattacatacttgaaaataactctgcagcaatagaatgcagtttactgtgttggagtttcagatgagcagctgtccttagtttggagtttaggttgaaggttgtcagcttctttgttgcagt

SEQ ID NO: 48290 - DNA, 1501 bp, Oryza sativa
ttcttcgtgttgtattttttctgaaagacgagtggtttttcgtataaaatggaatagggtgtcggtcggtgggaggatgtgcgtgctattccgttcaaacaagaggagctttttttgcataaacaccatcacacgtcatttactctcaggataaaaaaaatgataaggaagtgcgtggcgcgcatgcagcgtgagaccggcacaaccagtgagggaaaccggacaaagaaagaaggaacggctccactgctcacccaatcgaggagcttctgcatctgcaaaccacataccacaactatcgaggagaaaaaaaatttcaaaaaaggacaaaaacggagccctacgaggctttactatcttattatgcatgaggatgaggaaagaggataagtgacttccgtcatatattgtagacataatatacaatgcaacgttggtaaactacaacaagttgcaagagatgactagagagcactaagagatcttgtgtgacgtggataacttataagcctgaatcggtctcaatagttgaacatgcccttatatccattctaacgaaacaaggtactcttagtgacacaatatataaaatggttgctattttttttctccaattcaataactcaaaaagagccgctgtttttatgtcttaattctccatccaatttaaaaatttgacatttttgatgtttatatagtctttaaaattattttattcactagttttattttaaattattttaccccaataaaattataatgtgatataatctgacatgtgattggcatatatcatactaaaaagatgctaatactaaagcttttaaaatttaatataaaatgggcgatatatatatcttttcttttcttttttttttttgcgggggacgatatatatcttttcaattaacacaataggtgtcgcatatacacaacaagaaaacttcttttttttttcttaccttgggagttgagatcgtctatgtaccgaagtatacaatatactagtatgttttaaaccacgatacttttgttgcgacaaacagtttaaatctcgtattttgattgaatggctatgggctacacctaatactaagttttccgttactgttccggtaggggttaccgtttcccgatattatcatggttagcacgaaaaaaatgatagagttaccgtataatgttaccgtggaaactgaaagataacggtgcaatattataaaccataaggcacgtacatcatgtgtcaccttaattgcaaaggttaaggtgttaactccaaattctacataaagtgtattttttttggaagtaaactgatttttttccgacattaccaaaattgcaactaccactagtagtatataattaatgctaacagactgtttaaagtgtttatgccaggttgatggctgaaagaagcgcagaaagagcgccgtttataacgacccaaaaatttatttcaaataaaaccaaaaaatgcccaaaacggcaactccga

SEQ ID NO: 48291 - DNA, 1501 bp, Oryza sativa
tgctactcagcatcgtctccatccatccattcgctttcgcggccgcgcggcaagccggggaatgcgacgctgcgggcgactccggcgccgagatcccaggtgagcaccctgtgcagtctgcagcacgcattttcttcttcttttttacattctcatttccaatctatttcatgtatggattctcagattagattctcctgccgaccacttgggttgggggggtgaccgtgttctttacttcttgattttatttttctttatctggcagaactgtaacatatctcgtcggtgcgagctggaggaggaggagccattggtatctcgccagcggggcagtgagcctgtcagttattcttttcttcctgtgaaattcattagaaagaacctgttgtgctctccgtgtggagttctcgataatttgagattttttttcttagtttttccctttccaaagattgttaaggtgctttaggggtagtttgtacttcattatgttgttacttttgttttattaataacatgataaggcttttgtttagatctgttatcattttttagtgatatgaggtttggacttatgtggggtggtcaactctattagtattatggaagtttaacaacaagtacaaccaaacgaattataatcaaacaatttaaaaaattactgatggtgaaagtttgaatattaattgtcatgttaagtattgtcatactgaatacttcatactctgtaaatactggactcagggattgcatgaatattgtttccaagcaaagtccaaagtggccacatgacagtgatgaaattttaatatcgggccatgagtataatcttatcaataaaacactcatacttcagtactcaatcaggtggctggttcaggacttcagcttagattgaatgaattgttgctactgaaatgggtgattattgtgaattgctggctacattgaagtgtttgaccacagccttggaacttctaccttttgtaggctatcgatatcgtaaattgtttgtattattctgaattttcaaatagtacatgcccttcgaagtgccaagtaaattggatcccacagaataagatgatctcacttgtgtggtgtatgccttttgtaaatacagttatacgttagaatttacatgagttctgatgccacttttttccaccctatactgcaatttcattaactgttttctgattgctgcaaacatgtagttttcattttttttcaatactttatacttttgatcaaacagcatctacgttctatatattctggagaaccccaactgaaaagttttattgctttgtcaagacagaaaatagcaactcggaacacatttatgattatgatctatcatgacatcctttgttgttccttattcatttccatgttcctaacaccactggattacatccatcaccttcatgttatttacaattttccttctctgactatgaactcatttctgtttattttcaattttaggggataa

SEQ ID NO: 48292 - DNA, 1501 bp, Oryza sativa
cgagtagattaggacgaattctgtaaaaatctgaatttttatttttttttatttagctgatttacagatcgatttctaaatacaactggttcgataagggagactgataaccacaacaatcaagcggctgtcgatcgtcgcattttgaattatacaactatagctgacaccacaacatcgcactttcaattatacaactggatttgtgtgtggtgatccggcgtggcaaaaagattcctcaactcgtagcacattctttctgcttaatcctaggaaatcaaccagtaatctaagctaaaatcaatgtaccaaagtgggtactagccatgcagccagtggcaatgttcccttgcatttctttttcgattacacgataagcacacacattacagtatactcacacacccgtgaagcgtgaatgtgcccccctaacacatgctccagcgagacatatatctgatcccgtattacaatcctgttaaaagttcacctatacatgtataatattcgtagtcactacgatttaaactctagtgagtgaagccatgcacccacgattccaccaccgcacagccaatgcttcctcggttcccttgcatattgtcaccgctcaaatcactcaccaagatcgaagtgctttatttgtactacaaaattaacggtgtgtttagttcacgttaaaattggaagtttggttgaaattagaacgatgtgacggaaaagttgaaagtttatgtgtgtaggaaagttttgatgtgatggaaaagttgaaagtttgaaaaagaaaagtttggaactaaacacgatgtaaaggcatgtttttcctctctacaaaagtatatgtggtgaaaaagaagaacaaaagaaagaaagaaaggaagaaaggtgaaaagaaggttggatgtcctctctcaccggcctacatatgttgttgctgttgtttgtttctgtgtagcgtgtgctttccatcataccctgccaactggcttatgcatcgtctgctctcttcttttctgacgtcgacccatgctcaaagccatcgattgcatatgtgtgtacgtactgatgacaattgacactgcagtagttgtgatgtgcgggacctcaattttaaatcacgtgatccaaattcaaacgcgtctttgtgcggtggtttcttttgcgacattgttaacctcggatttcgacaacagatcgagcatcaatagatggatacgtcaaagtgaaagatgttgagttagaaatcaaagtataaattatgtattatttccctagagtacaagtttgaaaaacacgccgtcatcgcttcgcttattttgattataagttgtactccctccgtccctaatataagagattttgagttttttttgtttgaactctttcaccactcgtctgattcaaaaaatttgtgcaaatattaaaaacgaaaagttgtgcttaaagtactttaaataataaattaagtcaaaaaaataaataataattccaaaaaaattga

SEQ ID NO: 48293 - DNA, 1501 bp, Oryza sativa
tctgtccatccaaagttacgaccaatcagttatttttctctgtttttttaatacagttaacctagacccttctctttaagaggccattccctacatatttatctccatgatactccctccgtttcaacatatttgatacagttgacttttaagtacgtgtttgaccattcgtcttattcaaaaaatttaagtaattatttattcttttcatatcatttgatttattgttaaatatacttttatgtacacatataattttacatatttcataaattttctaataagacgaacggtcaaacatatgctaaaaagtcaacggtgtcaaacattttaaaacggagggacctatatagcacctgactaatttataatgatgtgtttctcttacccctgcctatttctctcctgaatcattaatccaacccaaatggccatgaatgttttccgatctatctacccttattccttgcaccccttctacaaaaaaaagtcgaactgtataaatctagatatagacatactttctccatcctaaaaagacgaatctaaaactgaatgtgacacattctagtataatgaatctaaatagagttatatctagattcgtaatattaggatgtatcatatcgtattaggttagttttttatgggttcactgtgaaagtatgtgacatggcatgtctgtagatttgtcacggagagctagctagcatgaaagaggagacaggtttctgggagccctgtagattctggtctaaccaaaatagaccatacagcttggccatgcctagcttcttctttcatctcttgtccactctttcctagtttttttgtttttctttctcgtgctaattaacagtattaattgaatgtagcctctgaatatatctgtccattttgcacatgcatttctagccgatgatacatcgagttcttgatccaagttaatttgatgaacaatacaaacaaaggaagatataattttttttgggggggaacacaaggaagaaaaattatacacaaatatagaggagatagtcaatgtttgcgatgaatatcggagcaatgcaaattagtaaccgtgcatgtttgtaccttattatagtccatttgccctcgttgctatacaatgaagcacgatggatatattgatcgatcaacttgccttgcatattaattttagcaactagtagaacagatttgagcacaacagtgtacggttagatctgaattataagtcgttggaggtagtgttcagggtgggaagaggaatattttgtaagatcgaataaaataggattaattagatacatggaattaaaaatatgccggtttcgaaatatgccatcagtattcgtgtatttggatcataccattataattttacacatattcgagatatgccactgagatgcatttacaataattgtttttatcaaattgcccttctttccttcttcttcctctttctcccctctcctctcttccacgagaccagcga

SEQ ID NO: 48294 - DNA, 1501 bp, Oryza sativa
ggtcctgagatctcaagttaagttgccactcctaatttaaaggttggatttatctttaaaaataagaatttgagaattaagcgttcgagtataactacttgacaagtgggtgcaatctagcataataacttgacaatttagtattttggtgcacatcaacttagctaagcatatgcttggtgagttttttttttcatgatatcaatatgctattacatagcaatcctacggatattactttataatattgaacttaatctttaataatcataccgcacatccaattgccttcaagaatttttgttttcttcaccttcccaaatctcaaccgaaatataataatttatacatccaatttaattgactatcagttattaattattaagataaaaatataaatatgcttatatacaaatccacgttagtatattatcaaaattacttagaaattgaatatgtataaaaaaagtgttccaaataattaaacttaacttattatatcaaaatcgtacatatcttacaagttgttgcatttatgcgatcacttataaagttcttgtacaaaattaattgcaattatatgctaagttgttgcactaaaacgctcatttgtcaagttcttgtatcaagttgcaccgacctgccaagttgatgcaccgtgggtgcaatttaccctaaattctatataaatataaaaagattagttcatgattaaaaaacatttgaagataaaatcaagtcaaaataaaataaataataattaaattaatagatttaataagacgaatatatagtgagacgtatatagagaagtcaacggtgttatatattaaaaaaacagaggtagtatttattttgttataatttattttatgattaaacatatgatttaattttttttagaaaaacatgattaatattttaaaacctttaccggagggaataatccagttgactctgcccagattgctgcatgctctgcttaccagtcccacaagctacaagcacgaactgttcaaaaagttgaaatgtgtcggacgcgcccaaaaaaaaaagaaaatcgttcctcgtgggagacaaaaacgcatataaatgactctgatcgatcagtggagcgagattaattcagatttgaacgagtcctgcaaaactgaatattaatgcctccctttcttttctctgcgcgcgtgtgaagtttgaaccgtgtgtgtgcagccacaaacaaacgagatcagaaactaggcctaatctcaaccataataaaaagcagtacgcagccaagaattgaatggacgccacagaagaagacttcaaagttcaaaacatgcatgcagacagtgcgcacacaccgaccatatccatccaaattccaaagtatgcatcgtctatatataaacgagcacgccatggcagagttctctccaagctcgatccattgctccgatgctcagctcagcactccaaattgaagctaattacgatcatagcctgacgacgataa

SEQ ID NO: 48295 - DNA, 1097 bp, Oryza sativa
actacgacgaaagacatcaaaatcaactctaaaattaatatttgaaatttaaattttggttgcagctgattataaacaaactaatgtaaataatgcaaatttgatgttaatagatttatcattaaacaaactatcataatacgctttatttaaaacattttcttcttatagatattattggttaaaatagcatctcgaagacgtgtcaaagttcaaaaatgcttataatttttggacggagtgagtatgtgatagatcactcaacaaacatacaataaaatttagcatctacatgttgcaatgaaaaaattcctttccaatatatgttaacaagctattgttgaatttctaattaacaagctattgttgaatttcttttttacttgtagaagttaaattttaacatgtttgtggagtgatatatcacatataaatctatcttctcattttttaattatttttcataactatttaaataacatgtaaataatgaagtgatgtccattcgagagtttaaaatcaactcccgcgcaagcactgctgaatcctacctgactacagaacatatgctctacagtacatttaggcgccgtcattgtcttgtagctaggatacgctgagcaaaaacagagaagagaatagagactggcttaaactaacgaacttcttcagatatccattttccttcttctcttcagaatgttcagagatgaacacttgaacaggataatatattcgccgctgagtgagatattcagagttagatgaccatatattggcacacacagtgggcaacacatgaatatatgcatcgatctagtcaaaattcgcatcaatcaaagttaccatgctgcattatgtttagttccacgctaaaattaaaagtttaaagaaattggaacgatatctgtgcagaaaaattcgatatgatgaaaaagttagaagtctagagaaaaaaaaagttagattctaaacagagcctccatctgcttgcattcagctagagagctaacaactgaaaattctatagacagaaaaacacaaacacacacacaaaaaaagtcttgtcatctaggctagtctatgcttcttctagt

SEQ ID NO: 48296 - DNA, 1501 bp, Oryza sativa
aagacgacgactgacaagcgggacccacctgtcagcggcagcgagggcgcgcgcgggcggctcggttgcggactgggccgacttgggccggggagagagagagagaaggttttgggccgactttcggcccaaagccaaaagaagactttttaaaacctttttcaatttagattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttcttttctaggcttttaaaaataaattctaaaaattccatttaaacaataatttacatattttgaattctcagggtgtgacacctaatatttttcttcaatattattaattaaatttttatttttacaaaattttatcatcaaattatatattatcctatacttggtcgagctcgcgagcctgcttaaaagctcgaaggaggattaggctcaattcgggctcggctccagcttttgtcgagctcgagcctagacgtgaaagctcacttgagctcggcttgttgacaacctacttccaatcttctcctttctttcacctcccatatccatctctctctctctctatctctctatctcatacacacccaacatgacctagaggaggtgacaggcgtcatgaggtggcggacaagatgatgggtgggcctcactggctcactgccacctaggattaaaaattggattatattgtcacgttctatgccacgtaagatcaaaaccaaatttgtactgggggttattcatccagtccaaaaaagttgagtgttaaatgttctgttttgtagtttaggggagtaattcaaactgtcgtaatagtccggaggtaatttggactttaacctgtaaaggaaaacattaaaataacatttgtaaattcagctgatatgatatgtaagttcatagtaattttgataaaaataatatgcaagtaaatatgtttttgttattttcttttatagtaccttgggtgtaaatctaagggtagaaaaaatctgtatgtttttttttagaaatcaccaatatatagatagatagttccagaaatattagttgactaatgaatagtgagccttttgtgaaggtgtgatggtggttgtacaggatggcttctctttcacgggggcaaggagcggttcttctctcaactttcccagtctcccatatcttgtttttcgtgtacaagcctccaaaactatcagtagacggtaccattttttgcgaaaattttctctagaaaagttgctttaaaaaaacaatattaatttattttaaagtttttatttaactaatacttaattaaaattaattatgtactaattctttgtttggttttccgtgttagtaggcaaggctcgctctcgaattcaggccagcctaaggttgggtatggaaaatac

SEQ ID NO: 48297 - DNA, 1501 bp, Oryza sativa
tggcatagtagggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccagttatagcatcttctattgtggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctagatcataatcacccccttataaacaaggcatggactccccagcgacccccgtgggcttatctccgccacttctcagtctggtgccccgcaatgaaccatgctacacaaaagataaagccgttgcccatgctggcttgtggttggcacggttaatgtttcacaaccgaaactcgtgaaccggtccttaattgtcatgagcacaaccatcaaaaccatgtgctcacaacccaccattaccaggttttagttggcacattaattaattaaccagtcacgattgaccatcgtgaactatcattaaaccatcattaaataacagtgagtcataagttatcccaatagtgagctaatgtttctaagcagggctaagcaattatatctaatatctagttgaaccaatatataaagctcaactagtcaagttataataacccaaggtatcaaggaataaagtaatcaagaacaaaagggctataacaaacaataggttaattccacccaatgacattcgaaaataaatgcaatatttgaatagaaacaatagctttaaataggatcaacatgctcaaagggttgtttgggatctgtgtgacttgccttgctggccttggaactcttcaaactcttctccggcgaaaacggactctccggaaaagacggaatctaaacagaaaagagcaaaaacaccaaaacagcacataaacaagcatgaacagtacatgtggatatttttaacatgtagatctcaattttagaaaaaattagagacttgaaccaactaaatcggagctaagatgaattagatatgaatttttgaagatttaatcggattaaaacacttatattgattttaattgaattatgacgcaataatgaattatttttgaaaaggaaaaggggatttattgcgtcagcaggctagggtttgcggtggaccgggcgcacggcggcggttcacacgaacggacggccgagatcgacttgatccaaaacggacggccgagatcgatcggtccacgaccggtctacgacgaacggccccga

SEQ ID NO: 48298 - DNA, 349 bp, Oryza sativa
cgaacagcaggagcagcaacgacggaagagaagagatcaagaaaccctgaagaggacatgtcttccgctcgtccccatcttgttcctcttcttgctctgtttcttgcgtcttcttcttcctctctttggtttcttcttttcattagttttgatccacttcttgttgtaggagatttgccgctgtgaatatggaataccaaatcaccaccatcacccaatcaatcaatctgaccccaaattgcaaattcgctctagttttactctgcatgcatcatcagttcatcacaaattcaccatttcttttctcctctcctcaaactgcgacacgctacgctgctacaggccacga

SEQ ID NO: 48299 - DNA, 1501 bp, Oryza sativa
aaacaggagtgaaccgatataaaaataggggtaagaacgagatttccccttatagtaaacatgtaacatattacactcatctatgtatggcgtgaatatattatacaaatagcaccggtctataccactgtttatgttttttttataaaactaataactgattttagattgtatcaatgacgtgggtttagacagtgatcgatatggttttgtagagtattttccatacccaaccttaggctggcctgaattcgagagcgagccttgcctactaacacggaaaaccaaacaaagaattagtacataattaattttaattaagtattagttaaataaaaactttaaaataaattaatattgtttttttaaagcaacttttctagagaaaattttcgcaaaaaatggtaccgtctactgatagttttggaggcttgtacacgaaaaacaagatatgggagactgggaaagttgagagaagaaccgctccttgcccccgtgaaagagaagccatcctgtacaaccaccatcacaccttcacaaaaggctcactattcattagtcaactaatatttctggaactatctatctatatattggtgatttctaaaaaaaaacatacagattttttctacccttagatttacacccaaggtactataaaagaaaataacaaaaacatatttacttgcatattatttttatcaaaattactatgaacttacatatcatatcagctgaatttacaaatgttattttaatgttttcctttacaggttaaagtccaaattacctccggactattacgacagtttgaattactcccctaaactacaaaacagaacatttaacactcaacttttttggactggatgaataacccccagtacaaatttggttttgatcttacgtggcatagaacgtgacaatataatccaatttttaatcctaggtggcagtgagccagtgaggcccacccatcatcttgtccgccacctcatgacgcctgtcacctcctctaggtcatgttgggtgtgtatgagatagagagatagagagagagagagatggatatgggaggtgaaagaaaggagaagattggaagtaggttgtcaacaagccgagctcaagtgagctttcacgtctaggctcgagctcgacaaaagctggagccgagcccgaattgagcctaatcctccttcgagcttttaagcaggctcgcgagctcgaccaagtataggataatatataatttgatgataaaattttgtaaaaataaaaatttaattaataatattgaagaaaaatattaggtgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttga

SEQ ID NO: 48300 - DNA, 1501 bp, Oryza sativa
ccctttgtttttgtaggaagagcacgaggaggaggcgccgatctgtagggctcgttgttagtcatctcgaccaagggaccggtgaagctgttggttcttgatttctttcgttgcttttattattgttctaaagagaaatcctcgttttcttcctgtgagatttatgcacatatctcttagggcactcttacctgggaatatttcgttgtttttgcagtgattctcgttagtgatttcgttgtttttgcagtgattctcattcgtttatgggtgcctatttttaggattattgggtgttttctaggttgttattgctagaaatgctaggtttttttggttcaactggataaggttgtttaagtttgttgtttaccttttcagcggctgtggtttggactggtgacgtatccagtcaactctagacatcttttgtcgactcatcagtaaacagattacgcccctttctataaatttgctgctgattcttctgtcttggatttttaacagctcataagctcatataacctgcaactgatttatggatccgttgaattgtttttattcccctagtctttactgttcactaaagtaaaaaaatgaatggcacatattaataatgataaactgctgcttattactgtttcatacaagggggaaattctacctagaaatgcacaccatggcatcaataaaaaaaaagaagaaaaaaatcagattactactcaatcacatgctgtttagtttaggttgaatgagtttttgtgaatgtgataggttttctagctttgtaattgggtttgaaatgaaatggatggttatcatcaacttcctggaatttctagtttgttgtcgtgttttggatatcacaacaggtccagttattaggcattacaatcctgaaccttctttcatgttcttgtttgttcaaactttttcaaataccctttgccctttcaagttgtgagggatatacagcaaggtcaaggcgtgaggcatataaaaagggttgcggcttgccaatacttgcagaacatcttctcagtttttagcgatacatgatttgacatggatattcaaacttcaagacttggtctcctgcacaaaagttctatctcatttttcgtgtttcttttctaggactgggtttgactttgtattaattctgcatctccctttcgttttctaaacaacaatgtactatttaactgtatttaatctaacaggaagttttccattaaatttttttataaatgataaaatatgcttgaagggcttcaaagatgtaggtattctagactactgggctttatagagtcaaaatattattgctgtctgaagacaggtaaaatgtgaccaatgcatgatttcagcctatcaagaaacctttctcatcctttctgtttgcacactcatatgatcactagttcatattgaccacgttcatgttagttatatttgccctgctgattccaagcttcctttttgattttacagggaaaaa

SEQ ID NO: 48301 - DNA, 1501 bp, Oryza sativa
tggcatagtagggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccagttatagcatcttctattgtggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctagatcataatcacccccttataaacaaggcatggactccccagcgacccccgtgggcttatctccgccacttctcagtctggtgccccgcaatgaaccatgctacacaaaagataaagccgttgcccatgctggcttgtggttggcacggttaatgtttcacaaccgaaactcgtgaaccggtccttaattgtcatgagcacaaccatcaaaaccatgtgctcacaacccaccattaccaggttttagttggcacattaattaattaaccagtcacgattgaccatcgtgaactatcattaaaccatcattaaataacagtgagtcataagttatcccaatagtgagctaatgtttctaagcagggctaagcaattatatctaatatctagttgaaccaatatataaagctcaactagtcaagttataataacccaaggtatcaaggaataaagtaatcaagaacaaaagggctataacaaacaataggttaattccacccaatgacattcgaaaataaatgcaatatttgaatagaaacaatagctttaaataggatcaacatgctcaaagggttgtttgggatctgtgtgacttgccttgctggccttggaactcttcaaactcttctccggcgaaaacggactctccggaaaagacggaatctaaacagaaaagagcaaaaacaccaaaacagcacataaacaagcatgaacagtacatgtggatatttttaacatgtagatctcaattttagaaaaatttagagacttgaaccaactaaatcggagctaagatgaattagatatgaatttttgaagatttaatcggattaaaacacttatattgattttaattgaattatgacgcaataatgaattatttttgaaaaggaaaaggggatttattgcgtcagcaggctagggtttgcggtggaccgggcgcacggcggcggttcacacgaacggacggccgagatcgacttgatccaaaacggacggccgagatcgatcggtccacgaccggtctacgacgaacggccccga

SEQ ID NO: 48302 - DNA, 278 bp, Oryza sativa
acagtacttcatcatttatttgttttgatgtaaattatttcatcatttctccaatatctaacataatcccgcggcaaagcatgagacatcattagtatatacaaaagttgggtatcatcctcttattgctattagtatagctaccaattaatacatgatctatcctcttattactcaaacacatcatcagtaactatagttataatgatagtatattgttatgatagagaatgtgaactccgtccgtccccgcgtgcctgtgcccgtgtccgggcagt

SEQ ID NO: 48303 - DNA, 391 bp, Oryza sativa
cattcagtatatagcgaatgatatgtttgtgcccgtggattgaacaaaggaaacccgagcgcatgcataataactgcattttaagacataatacaacattatattagatgccggcgtaaagagttatttttaggagatgttacctgctataaatgctcctttaaataactgatcttatcaaataggacaaatagtgatgcatatgatgtaacaaacaactctcagatgcatactgagaaaatatcctgtctgacaccattttcctatgatgcatgaacatacagagaaaagggccatggatgcgggccatttattatcactacagatatataatggatgatgcactataaggcgatgaactctgactactgcattgttctctcatataaga

SEQ ID NO: 48304 - DNA, 1501 bp, Oryza sativa
ccaatagtgaagcaccaaaactgccatgaggaagactggggtgtccccgaaaaagagaggaaaactggagtggctgtggctgacaaagcttgatcaaacttgcaaggcatttcaccctagtttttgctgccattcacttgactaaatgaagattggtactacctgtcactcatctgcacatgtgtagttggctatagttgcttaccgagcaaaacctgcccgacttcctggctgcatctatcgttcagttgtttttatgacttcagaaaacatatggcgaaagataataactgtactggtataaaaaaacaatccatttgatatctcatgtagtaaccacagaacaacttgaaagtaagacgagaacagaataaaagcagcaaaactcggtaaacaaagctgttcagatcaatcttacctaatctttgtaaaatctgaagactgtgaagttattagattttgttcagattcacatggtagaccctatctgctggccatttggcactaaagtgataatagtgctgccttatgatgtgctacataagtcaatgtagtgcattggctatttctctactactgggaacatgacctttgataaagcatgtatacttaaaccagagcaatgagtgaaaggagaaacaaaaacaaaaacaaaacatcgggtgaaatatcgaggaggataaacaaatcagtaggcaaaaaatatatcttgatttcataatagtacaaagtaaaatttagttcttgaagagctatagtagaccctacattgatctttgtatttgcccaatgaaaattaaaaataattaaatggtataatgctatattagacttctatagccattggtcaatatagttaaatggtaactggggagaataaagatgaaacgagataaaaaaaaaggagcttctttggttaaagcaaaaaccaggtccaggcgccaaaagcctctgaatcactttcgctttttcgaaacaagtacgcaatgtgcaccttcgtctttatcatataattatcacagctgatagaaacatttctggcttcagagaagagtttttgcttacgtttgtctacgatatttggagagcaagattgacatgagactaccgtcagctaccaacagttgtacattgctgaatactgcagggcacaaaaactgtaagatcgttcttttttaaaacgaaacgcacaaggaaagtgaggcctaagtgcctaattcagtaaaaatgatggccatatattttctgggtttatatgttaaaacttcagaacacaaaattacagctttaatcaagcggcaaacactttcagtgccaggcttaaacagcggcgaaccgcgagcaccattttcagagttaccaaatatttgttctgaatgatcctgcaatttccagccaagttgttatcatgatatgctgttggcagaatatcacctcaactcggtacaatgggtacactccactacttattcagaagggggagagacaagtaacaaatcga

SEQ ID NO: 48305 - DNA, 246 bp, Oryza sativa
cacttggtatgtagcacttgagtgttgattatcacagctacacgatgcattgagcttttatatcagcacgcaacaccatgtttgattatgagacacctttatttaattgaaagtcatcatctaaaacatctctactgtgtagactttttaaacccctaaccttacttattttacatgttgattctgtggctttttttcaacaccctcaatgactcagaaattttcctcctcttgcccccttccagc

SEQ ID NO: 48306 - DNA, 1501 bp, Oryza sativa
gtaattcagaatatatatatggaaatcggatcgactagaaaatacatcacttgacttgagcaatgctatagaaacacttcaatgttttccatacaggtaataacattgtggtatagtaagatgaagccgttttgactcaaaatggcagtatcaacatatgtacaacagtacacattaagaaattatcgacctaaagcatgagtgcaagaccacaggcgctcgacacaacaattgcccaaaggagggtataacggatgccttagaattcatttgaagagagaacaaggcctcataatactacaagatcaagaaactagaaaaataattcaagatcacaaactaagctactacatgcacatacgcaaagtaaagtatcatggacacttaataggcaccaggaaacaggaaaatgcattacagaatactatgttaattgttaaacatgaaacaaaccaacgtaatgttctcagacgatcaatgcgggtaaacggcaccagaagttgccttaaaattccaactagcactttttaactaaaatatcttgttatgagtaggttactataacaaattgcttcacatggccattggttaagacaaaaatcaccatatataacgacgcggtactaaaatcttaaatagcacaaaacaaacaattccagaatcaatgtagacaaaaaataaacagcgtatcacacatttattgcattttttccattttgcaactatgatcaagtccttaacagacaccatacccactgaattgaacataccttttccgcgaggcgattaaatcacacattcacaatgtcacatcatttatactgcatgatccatatcataatctgaaagaagctttcaatcacctttgcaatcgccgtgatgtcacgcaacggcgtcctcgggtaccaatcaggaagtgggcttctcctctttgtggctgtggccttcacagcccaaaccgggggcacgttctccttgttgttcgatggccgtatgaaccgccgagccaacggcttcccggggcccctcgccgcaagagcacccggcgaggccaccctcctgatgaagaacccgccaccgccggagagctcgccaagggccgtcctcttgctatccctcatctcaggcatattgctgtaatctgcaagtagcagaagaggcaccgatgggtaagaacacgccaaacgcatcaaaagatcagggaaatgggcacatattagcctcacatccttggtcttctctctgatccttacttctactcgtatgaatcctagctagagttccttctcctcctatcccccggaaatctgcaatagcaaaatccaaagtaaccatcgatgcagcaaaacaaagcgatgacgctacccaaaaccccccaagaatctgccatacttctcacttaccctcctcagcctcctgctcagattcaaaaacctcaccagatctgcaacgacagaggcaaacagacgcatcagaacacccagcaaacagttcatcaaaa

SEQ ID NO: 48307 - DNA, 1501 bp, Oryza sativa
cgtcggcgagccaccgcgccgcgccggcggcgccggagagcagcgccgtggcgcggaggaagttggccctgctccgccggatgctccacaggtgggagccggcgtcgagcatgtactccacgacctcccgccgcagcggcggctcggcgcggcccagccgcgccgccacgacgcccaccgcctgccgcctgaggccgtcgagctgcgcgacggcgaaggggtggacgtagtgcgccccggggaggagcggctcgccgtagaggcgcaagacgctggcgagggacaggcaggtgaggcgcacggcgaggcagacgtcgccgttcttgcgcaaccccgacgggtgcagcaccacgagccggtgcgcgttggtgtacaccctgtccatctccagcgtcgagaggcgtatcctcaccttgccgatcctctggtccttgccgccgccgccgccattgccgaggttgcagttgtcgaacacggcgagcgtgagcaccgtgcacgggtcgtagacctcccaggtgtactgctcgttccaccgcggggtggaggagtcgacgacggtgcgggtgcgcacccacttgtggccgtacttggcgacgcagtacgcgtcggtggtgccccggccgccgtcggcggcggtcttcatcggggggaggccctgcgcgccgaggacgccgacctcgagcacgccgatgggcgggcgccacagctgcctcgccgtggggcgcgtgtcgctggcgtacatggcgggctcgtccatgacgtggtaggcgccgtcgaggcacgcccggaggtgcacgcggccggcgaaggcgggctcctccggcgagtgtcgcggccggtgcacgaacggctccaggctgaaccactgcgactgcgtgtgcgtggccgcggccgcgccgcgccggtcgaggcgcctctcgaagagggtgagcggcagcacggcgcggctgacgatctcgtccttgcccgggtgcgccgcccgggcctcgatgacgagcaccgccggctcgtcgaacggctccgccacgacgaacaccagctcctcgttccacgatgggctcgtcgggcggcagcacggcttggtccggagcgtcacgccgccgacttgcaccttgacgacgacgaaggcctcgccgtgccgtcccttgtcgccgcctgcgccggcgacggcgcccgggacgacgtcctgcgcctcgagcacgcttatccggaggtaccacagcttcggcgtcacgtacaccttggaccgcgtgctctgcacggccgccacgccgtcgccgcctccgcgcaccgacgccgcgccggcgtgccacgcgtccgcgaacgcctcgtcggcctgcgtgccgacccacaccgcgagcatgacctctccctgcaccgccctgccgcctccgccgccgacgtcctcgaggcggtaccactgcggcgcgagcgggctgtccggcggcacgcgcacgggcgcctcgccgacatcgaacgcgacccttccaacgtagccgtc

SEQ ID NO: 48308 - DNA, 1501 bp, Oryza sativa
ggctcctccagtggcacacgtcggcgagccaccgcgccgcgccggcggcgccggagagcagcgccgtggcgcggaggaagttggccctgctccgccggatgctccacaggtgggagccggcgtcgagcatgtactccacgacctcccgccgcagcggcggctcggcgcggcccagccgcgccgccacgacgcccaccgcctgccgcctgaggccgtcgagctgcgcgacggcgaaggggtggacgtagtgcgccccggggaggagcggctcgccgtagaggcgcaagacgctggcgagggacaggcaggtgaggcgcacggcgaggcagacgtcgccgttcttgcgcaaccccgacgggtgcagcaccacgagccggtgcgcgttggtgtacaccctgtccatctccagcgtcgagaggcgtatcctcaccttgccgatcctctggtccttgccgccgccgccgccattgccgaggttgcagttgtcgaacacggcgagcgtgagcaccgtgcacgggtcgtagacctcccaggtgtactgctcgttccaccgcggggtggaggagtcgacgacggtgcgggtgcgcacccacttgtggccgtacttggcgacgcagtacgcgtcggtggtgccccggccgccgtcggcggcggtcttcatcggggggaggccctgcgcgccgaggacgccgacctcgagcacgccgatgggcgggcgccacagctgcctcgccgtggggcgcgtgtcgctggcgtacatggcgggctcgtccatgacgtggtaggcgccgtcgaggcacgcccggaggtgcacgcggccggcgaaggcgggctcctccggcgagtgtcgcggccggtgcacgaacggctccaggctgaaccactgcgactgcgtgtgcgtggccgcggccgcgccgcgccggtcgaggcgcctctcgaagagggtgagcggcagcacggcgcggctgacgatctcgtccttgcccgggtgcgccgcccgggcctcgatgacgagcaccgccggctcgtcgaacggctccgccacgacgaacaccagctcctcgttccacgatgggctcgtcgggcggcagcacggcttggtccggagcgtcacgccgccgacttgcaccttgacgacgacgaaggcctcgccgtgccgtcccttgtcgccgcctgcgccggcgacggcgcccgggacgacgtcctgcgcctcgagcacgcttatccggaggtaccacagcttcggcgtcacgtacaccttggaccgcgtgctctgcacggccgccacgccgtcgccgcctccgcgcaccgacgccgcgccggcgtgccacgcgtccgcgaacgcctcgtcggcctgcgtgccgacccacaccgcgagcatgacctctccctgcaccgccctgccgcctccgccgccgacgtcctcgaggcggtaccactgcggcgcgagcgggctgtccggcggcacgcgcacgggcgcctcgccgacatcgaacgcgac

SEQ ID NO: 48309 - DNA, 342 bp, Oryza sativa
agaaacattagctcatgattgggataacttatgactcactgttattaaatgatggtttaatgatagttcacgatggtcaatcgtgactggttaattaattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcagagataagtccacgggggtcgctggggagtccatgccttgtttataag

SEQ ID NO: 48310 - DNA, 1501 bp, Oryza sativa
ttaggtgtagccctggtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccttctaaaaatattggaaaagtagaactgttctcctccctttctcttttaattgaaccaaactaatggcacatgcacttcataatctcttttaatggttctcattcaaaaatttattccagtgttattagtaccgtacatctattactgtactaatggctcattttatcagcaaaagttttacaatattgttttatttaatcttgctgcaataaaataaatttagcatgttgattttataagtttctttcatttcttttgaaaccagttattcaaaagtacaaaatttgtaacctggtttccaactgtttcaacttatctcgcaaagcttggtttactttatttacttacctttttactttgaatttctaatctttattcaaattaatccaaaaacttgtgctattaattggataaatgtcttaactccctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcagttggccgacactgagtatcgctaccatcctcgccaaccccagggaagtgaccgtggcagttaccttgagactgaaggaattgagaatgatgctaccacaaggcatttggttgagatgctgtgggctatggatgaaagccgcgcggagactgtgttagcagctcaagatcgtgaagattggaatcgtggtaagatttgcaagttagaagacaaggtggatcgtttggagaaggaactagccgcattgaagggagaagcaccacctcaaaaggccaggattcgtcttaccgcaaggaagagagctctatttgtccctcgctatcaattggcgccaaaggttcgtgtggtggagaaagaagttgctccaaccttagcagatcctccggttatcatcataagtgatgatgaagaagaagaatccaagcgcaaccattccaagattgagtgggtagctacccaagatga

SEQ ID NO: 48311 - DNA, 1501 bp, Oryza sativa
gcaattctgaaagaagctcatgatactttatattccattcaccctggtagtactaagatgtaccaggatctcaaggaaagattttggtgggcaagtatgaagcgtgaaatcgcagaatacgtagcagtatgtgatgtctgtcagcgagtcaaggcagaacatcaaaaacctgccggtttgttgcagcctttgaagattcctgaatggaaatgggaagaaatcggtatggattttatcactggtctacccagaacgtcatcaggccatgactctatttgggtgatagtcgacagacttaccaaagtggctcatttcatcccagtgaagacaacatattccggaagtcggttggcggaattgtatatggcaaggattgtgtgtttgcatggcgttcctaagaagatagtgtctgatcgaggcagtcagtttacttcaaatttttggaagaagcttcaggaagagatgggttctaagctgaactttagtactgcttatcatccgcaaacagatggacaaactgaaagggtgaatcagattttggaagacatgttgagagcttgtgctttagatttcggtggaagttgggataagaatctaccttatgcagaatttccgtataacaacagttatcaagctagtcttcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgagtggcccagtctcgacataagagttatgccgacaatcgccgcagagatttgagttttgaagaaggagattatgtgtatcttcgtgtcacgcctcttcgaggagttcatcgtttccacaccaaaggaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtattttggaaatagatgagagaaggaccaggaatcgagttatccgcttttgcaaagtccagtggagtaatcactcggaagaagaatcaacttgggaacgagaagatgaattgaagtcagctcatccgcatctgttcgccagttcttctgaatctcgaggacgagattctgttcaaggggggtaggtttgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttga

SEQ ID NO: 48312 - DNA, 1501 bp, Oryza sativa
gagggggcagccgctgtgcacgcggggggaagatccccggcagcgcgagagggcccgtggggtcccttccgcgggcgtgggcttgacgctagggttcgtcgtgttttgatttctgtgggatctgtttgttgctagggttggggggttgggggttggccgtaggaagtttagatggtttttggtggtgcgcctcagttcacggccatgtccccgcgcacgtgcgcgggttgcccccagctatcggtgtgttggtagatctctctgctttggtttcccactgtgtcgggttggttaattatgcttgtgcggcagctactgtttaggtgtagctcgtgtggtttattgagctagccagggttttatttggttaattggaggtgatcatctgctcgtatagtcctatagttaacgaggataacttcgcactgacgaccaggagtttaataataaagtaataataagctcaagtttaatagtgggctataagccaagtagccaaatgtaagcttatgtggaagagagagtttgaaaaatgaagagggttgggtctcagtctcatgtaagagctaaccattcacatactttaagatggataagttaattgtatagatgagatagagaggagaagaaaaatatagataagcttatagcttatctactatgcatgtcaactctaatatgtgctataagttcatagttggctttattattaaacttgctctaagttggttcatgccatggtgcgtgcagcttctgataactgttaggaggcaattagtttatctcttattcctagatatctcttattagtagatatttctgtgcctttgtagttttgtctatcgattgtgatatttttaagagattgaaatctggtttgtaatacatttttgcattagtgctttctcattgtaagtgttagttcatgttcagttgtaggtaactctgatactgatgccaatggcaattgtgtctcggtattctctaaggattctttgttggttttgctttatgataggattaccagacaccaccattttatattcattaagaaaactttcatttttatcagtattttgtataatactccctgtgtttcacattataagtcgttttgacttcttttccagtcaattttttttaaagttcgtccaagtttatagaaaaatatggcaatatttccaacacaagacaaacatattaccaaaatatattcagcattacattttagtgaaactaatttggtgctgtagatgttgctaaatttttctataaatttggtcatacctaaagaaatttgactagaaaaaaagtcaaatatgatacggagggagtacttgtcacttgttcatatagcatggatattactggcacacagtaaacttgtggatttttgtaggctgctgatgtatttgtattggagtttaacctcaaagggatctaaccctcattcttttgcttcttgtaaggtgctcagaattgaattttttttatggttttc

SEQ ID NO: 48313 - DNA, 680 bp, Oryza sativa
gaggatccccaaatggccataacttggccatttgaactcggaattggaccgttcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatattctcatcacctggacactttggaatggatggattattgtggaattggattcacacttccccctctattcaaaatccccaaaatggttttaggctgggctcggggtgcatggttttgatagtagcacctcggccatataaggaccggt

SEQ ID NO: 48314 - DNA, 225 bp, Oryza sativa
aatttaggtagatgcttcgctgattaaataggacaacattaggtggttttataactttagactttgggaattctcatatcatttggacactttggaatggttggcttatgttggaattggacacacacctctcttcctctttcaaaacccctaaaacctgttttcggtggggtttgggtgcatgccagttgcgggaagtagcaccccggccactataaggattaa

SEQ ID NO: 48315 - DNA, 462 bp, Oryza sativa
aaaagtaaggcctgtttgatttctagacacagctgcccttttggccagaataaaatctaagagatgctcaccaaggcacagacacatacaaaggattcagcatactgtctaaattatctaaatgtgttgcagatgcatacaaggccaagctttggacatatgaagtaacctttcaaatcataaatcaagttcataaaaattgcaatggtggataagaggaattagtgtctaaaaagtttgtgacatagcagtaagactcagttagaagatgaataaataaataaataaataacaagcaatttaaagtttctggtgatgtactaatgtggatatgaaaatcatcagaaaaaaagtttcaggtaatgtggatagaaaatcattggtacaattccaaatagaataatccatgtaacaaattgcacaagcaacagtaatagcatgtacatgatgcattacaaagaa

SEQ ID NO: 48316 - DNA, 537 bp, Oryza sativa
gatgggttggaaactatgtcatgtctttcgtccgtatgccgtggtggtatgtggcacgtggttacacgtgagaaagatgtgtcttgtgggtaaagatgtacacctctgatcagagtataacctattcgaatagccgcgtcctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaagcaggttcgtgtgggttcacggccttgattaataatcttgtatagctctaggatcgtatttacaaaatagctttgagcaactaagtgtcttttaatgctgtttactgcaaaccctaaccctttatattataaacccccttgtactcccttgcatttattctgcacttatgggtgtgtcttgttgagtacggtggttgtactcagtcttgcccaattttttccaaacccaga

SEQ ID NO: 48317 - DNA, 232 bp, Oryza sativa
ctacacacaagctaagcttagctcgagctcattcatataccttagcttagctaaagcctagctcactctcactctcactcttgcattgcattgcaatattgcaatattgcattggtcatgaacactcgaggcagcggcagtagcagcagcagcagcagcagccaggccagcctgatggcgttctcggagccgccgaagccggcgagccagccgtcgccgccgtcgtcgccga

SEQ ID NO: 48318 - DNA, 1217 bp, Oryza sativa
tgttcagattgtagttaaaataaactttaatggtaaaaattttggcaagtgacaggatttcttatatatttatcaaatttggcaacaaactaaatgtagatatttttttacaactttattaaaaaaaagtatggatgaaaataacatcaatctgaacagcctctaagattctgaatgagagttttttttcttcggcccctagtttcctttagaatatgcattgaaagccacttggaaagaaagatgcattattattacccaaaaatagaacaaaaaataatgcgtatccggggaatcgaaccaaccaacccctagtttcctttagaatatgcattcaaaggcacttgcaaaaaaaaagatgcattattattacactaaaatatgcattgaaagccacttgcaaaaaaaaagagatatagcataattattacacaaaaaaataaaaaaaatgaattattattacacagttttttttcttcggcccctagtttcctctagaatatgcattgaaagccacttggaaagaaagatgcattattattacacaaaaatagaacaaaaaataatgcgcatccggggaatcgaaccaaccaacccctagtttcctttagaatatgcattcaaaggcacttgcaaaaaaaaaagatgcattattattacactaaaatatgcattgaaagccatttggaaaaaaaaaagagatatagcataattattaaacaaaaaaaataaaaaaaatgaattataattacacaaaactatgcattgaaagccacttgcaaaaaaaaagagatagcatagttattacacaaaaatggaacaaaaaatgcataaatagagcaaaaataatgcgcatccggggaatcgaaccccggtcagtaccgtgggagggtactatgataccactacaccagatgcgcttatttgaactgatagattaatcgtttacattttaacaaagactgacaagcttttgaaaaaaatgaactaagccatcacaaatgatttataggtaaaagttttcttactttgtgttatttgccgtttaaaatctgatgttaaaaatagaatataatgaaaaaacttcaaagtgacttaaattttaaaatttaggataatagctcgcttcatggcagaatttctccccttttaatcgtctcatttcccaaacctcgccgcaggtaagggagggaagggagctgaaccggcggcgaaga

SEQ ID NO: 48319 - DNA, 382 bp, Oryza sativa
cttttgcggaaaatcaattaaagatagctcacgtgcgaggaagacgccatcgcgagaggcggaaccgagcgaggaggaaaggagggcggaatctcgcgatccccaatccgtggaggggcgctccgatgcgccgattcggcgagagatcccgccgatcggggagctcccggggtgggattccagctgcgggatttgggggcgctgagcttgagctcgggggaggcggggggtgggcccagggctgcgagcggcggcggcggccgcggaggcggggggtttggttgtgggttgtggggttgggggtggatgctgtcggtgaggaggcggcaggaggatgcacgcggcgtagggctccggggcggcgccgcagcgggcggcatgg

SEQ ID NO: 48320 - DNA, 1501 bp, Oryza sativa
cagcagtcactaaagttcctcagggaggatgggcaccaatcgtatttgccttcgtgttcatgctcgtcatgtacgtatggcactacggctctcggaggaagtacctgtttgatctccagaacaaggtctcaatgaaatggatcctgacacttggtccgagccttgggatcgttcgggtgcctggaatcggtctcatctacacagagctggtcaccggggtgccttccatcttctcgcactttgtcaccaacctgcctgctttccatcaggttctggtcttcgtttgcgtcaagtccgtacctgtgccgttcgttccagaggacgaacggtacctcattggacggatcggccccagggaataccgtatgtaccggtgcatcgtgaggtatggctacaaagatgtgcagaaagatgacgagaactttgagaaccacttggtgatgagcattgccaagttcatccaaatggaagccgaggaggcagcctcctctgggagctacgaatcttcggaagggaggatggctgtcatacacacagaggacacaaccggcaccggtctggtgatgagggactccaataacgaggcttcaggcacgtccctgacaaggagcagcaggtcggagacgctccggagcctccagtccatctacgagcaggagtccggtagtctcagccggcgtcgcagagtccgttttgagattgcggaggaggagcggatcgacccccaggtgcgggacgagctggctgatctcctggacgccaaggaggccggcgtgacttacatcatcggccactcctacgtgaaggcaaggaagaactccaacttcctcaagacgttcgccatcgactacgcttactcgttcctccgcaagaactgcaggggtcccgcggtggcgctgcacataccccacattagcctcgtcgaagtcggcatgatctactatgtctaaatcgatttttctgatcatgcttgccgtactacccagtaatactagctttgttttgagctgaatcttctgttggtcatcctcaactgtgtacgtcattttgtttgctcttttatacatgtaatgtagttgccgagttaccatgtgatgtaaagatgctggcagaactagctttagctgctaccatctgaactccggggcttcggtgatcttgtgaatacatccagttcaactgttaaaatgttcaatgatagcacataacatggcaataagtctgaacatcttttgtcctggcattataagtttggagcatctttgtgatttctcgatccgacgagctttgtgtaatgcgtgctacattaatactactacatcaattcttagcatgtcgtgggattgggaaatggattcccctatttctgaatcttggatgaattgtattcattgatcatgctttgcagattttcttcggagaatctcgcactatttagtccttggttagttcccaattttttctttaaacttctaactttttcatcacatcaaaactttcc

SEQ ID NO: 48321 - DNA, 1501 bp, Oryza sativa
tatatgtgttggcctgtgaaaatattgcattgcaagatggggtcaggtcaagccctagctagacatctgaaaaggtgtgaggaggagaaggtggtgttcaactggagatggggagaaaaaaggagaaatctaagggcaaggaggctccacacaatggccttgacaagatgtactagaaatgcataagttagttaatttgcagagagaccagattaaactgataattataattatgatggaaacgagcacagcacacaagacacatgttcttgtctattccttagggtcacacccgggttttgggggtggcctttgcactactttgactttagacctcccttatagaaccaacaagttttgtggaaaagacacacaccccaaaaaaataatatgtatgctaggacagtgtgggtgtgggtgtttgtgtgtgtgtgtgtgtatgtgcaattgtagaagtatgcaaggcagttcactaaacataatcaagggaaaggtagaaaaagaccacttggggcatgcacatttgtctcaccaagttgtggtttgaataaaaggagatcagacagagtttagtagtgaaaaggtgcactcacaattcacagaacaaaagctccacatagaacgcttactttaatcatttcgaatttgaactctgattttcaattgttgattctatgctaattccaaaaaacttccatatattagatattttggtggatatcattccaattgtattggtaccttaacaattgtcagtgcttgctacgaaaactctgtttctagttttcagataattgatggcaattaattagtactgcatcaagttcaaatcttcagctcgcagattggacaaggttattgtactggtcaaacagttcgatctcacagtgttagtgttgctgttgtctatgtgattgattactaagttattaattaaacaagcgaccaagtaccaagaggagagtgcactacagcacacttgtcccattttatatcgaccaccaaaaatgacaagcaattacgcaactgaagatgatgatttggcactgatctaacgaatgaaagattgttcccactcttcaagttcctatgatccatgttgattggtctgatcatccccaatggcattgtcctgcatttgactgaacaatgattaacataagcatgcatggtttcttgttgttaactcttttgtttacttgggattggcaggtggcaggtgatgatcagtgaagcagcatatgatatctaaactgagagtagtagtagaagaagaagaagctagtacagaggagtgtatgtgttggagctaaaactgacaagtacgagactacagctccttgcaaaagggggctcctgaccatacattgctataggctggctctacactctacacactactactgtctacacatgcaattatacacacagagatgaaatgcatcttcgtctctcccagtcccagctactaggccacttgtgcgagctttgcctacaagga

SEQ ID NO: 48322 - DNA, 1501 bp, Oryza sativa
gacgtcccattgttattcccctgcgtttgtaaccaactcctcaatagtgatcattgccaatagacgctcatggtttttccccgtaagtgttttctacgtaaaaattcgtgtctccgttgtgcatatattttcataacaagtctactttgtcatttttggcttatgtgcaggcaacaggcaccagaggcaccttggggaaaagaaggcgcagaattgcaaacctcctagcttaattgcttaaacagtgagaaattgctataaagcaactcaaaatcccagttcaatcaacaagcctataaaaacgcacataaatgatactcctaacgtaataatttgaacttcaactacacgcaattccttcctctgaatcacacaaacagcaaaacgaccaaaccctaatccgcattcgcaaggaaacacacctagcttagctcgatcaatctgctcacgaaaaaggtatagaactaatcaagtagccgcttatacgcgggaatctagctttccccacaagtgacactagacgaatcgcttgaatcagcaaactccaagctacgaatggatctggagtcagggaaaatagaaggaaaggggggcgacggatacgatacgacacctgggctgggggcgggaaggggcagtaggcgctggaagcggcgcgaacttgctgccccggagcgcgcggcgctcctcgtcggtgaggtcgccggccgccgccatgacgccggccgcaccgcacgatcggcggcggtcggtggaggtgtgcgaagaggaaggcggcggctcgactcctccggttcagttgggctcttggaccttctttgggcgcggtcggagtcggaccggactggaccggagcgtgtgttgtgttttgactttttgagttcaaacgggaggagtacttctgtatgacatacaggtgggtccgggtataaaaattcacgcttccgcgtaaactttgacgaatttttgtactccatactgttttggcttctacgatagaacattcatatggctagtttatccaaaacttggacagctagttcaaaatttggcttttaataatttccatgtgcttcagacattcatatgatgcaggccaagggtgtgtttagttccacaccaaaattggaagtttgactaaaattgtaagtttaaagaaaaaagttgaaagtttatgtatgtaggaaagttttgatgtgatgaaaaagttagaagtttaaagaaaaaattgggaactaaccaaggactaaatagtgcgagattctccgaagaaaatctgcaaagcatgatcaatgaatacaattcatccaagattcagaaataggggaatccatttcccaatcccacgacatgctaagaattgatgtagtagtattaatgtagcacgcattacacaaagctcgtcggatcgagaaatcacaaagatgctccaaacttataatgccaggacaaaagatgttcagacttattgccatgttatgtgctatcattgaacatttta

SEQ ID NO: 48323 - DNA, 1501 bp, Oryza sativa
caagaagaataccggaccggtgtgaacctgcagatgcagtcacaaaatttatctcaacacttcagggcaacgatgtgaaaccaaagtttgaattacaagtttacaactccagtcctgtcactgaatgttgtaaattgcagcgaatgttggtacctaccgctgaaagggcgcttccactcaaacttgtgcatggaaagaacttgatatgtctgttccaagaataaatgacacatctgagagttcggatataaataagaactattcagaagcctttaatttaaccacaaaatagttcaggaatcagtgatttgttgtagggatgctaatagggtgttactccctccattttcatattacaagacacttgatttttttttctaaatcaaacttctttaaatttgatcaaatttatagaaaagcatagaaacatggtaacatcaagcaaacatataatcaaaatatattcgatgttagatttaatagaattaatttcgtgttataagagttgctatatttttctttaacttgattgaacttatggaagtttaacttagaaaaaaatcaaagcatcttataatatgaaatggggggtttctcattcagagtaattgtatacaaggaacataaacatcaaaaggatattgtgttgaactgttagtgtatcaagcaactcttcctgaaagaaacatctgataagattacattgcaactggataaggccaaaaagggggacagaattatgggaaactagtcagtagtcacaacacacctaacgtttctacaccaagaagtaagttctgttgttgtttcaagctaagactgagctagtttcatgtttcaaacaacacacgagatggaaaattttcaccacaaactgcacctacaaagttacagtacgccttgaactacactacacagatttcagcccggtcaggtgattcgttcccgagaatgtagcatcttcactaccttagccaattaccctagaattttactgtcgctgcgctgcaatttcttgatttcttcccaaccacaagccattcgacgaattgcctgccccacgccacgaaacaggagttgcaggcctaagaagtgaaggaaaccttagtacctgggcggcgctccggcgaggagaggggaggaagcgcggccacgcggcggcggccgccgcaggctgcagcacggacgacgccgccatggccgaagggctgcagcgaccggagatttgcgcgaggagcgagagaccggaggaagaagaggaggggtttggcccttgggcttttatcctactagagtctctggcatgtgggtccataacaaagagggcccacatgtcagtgactcaaaatcatgtgactttagtgagaggatctcaaatccgtggttgaaaaactacactagatgccactacggcggctgcggatccgcacgctctccaccgctgccgcccaccacccgttcgacggaattccccacccgtcgctcgcccgccaccgccgcg

SEQ ID NO: 48324 - DNA, 564 bp, Oryza sativa
tagcctatgtgagttcttcatacattgatatatataggcagttcaaaaagttctggtttcgagagtggtttatcttttatagtgtatcggatgagttcacaatctgttatctatgtaataacaaattaaactgttcactatgatggtattagcaaattgcacccaacaaatctagattggatatcataaacgagcatattggatagattttggcaagtcataattaagtttggtttgaaggtgacttgtgaaatgtttgtcgggaagatcttttttctgtcttaagtactatacttgttttacatcctgttgtgatgttgctcatgaattctgctgcataaccttattgctacatattcaaatggcaatgccgttatgtggagtcatatggtgatgaaccaactcattccattccccaaaaccaaaaagggttaggtttgggattagaatctaatgaccctaaaaccctgaagtgaacacctcataacttgatagtacgttacttacagtgcgtcatgccatcgattacagttatgatctgatgactctgtttatattcttaga

SEQ ID NO: 48325 - DNA, 1501 bp, Oryza sativa
ccgaagcccatgctgagagccctggagtggtacatctggccgtacgccatggacaccgtctccaccgcggtcaccgcgctgaggacgctcgcgaacgtggtctcgttgggtgtcaggcacctggccatggacgagaagagctcgagggcgtcgttgcaccggccgttctgcgcgtagcccgagatcacagcgttccacgcgatgatctcccggcgaggcatgaggtcgaacaccatcctcgcgtcgtccatgcgacgcgccttggcatacatggtgatgaggctgttcgacgccgccgcttcgccggacacggcggccttgaggcacgccgcgtggaccatctgcgctcccctcgccggacagtccgctggcagcgccgacatcagcgccacgaaggtgacctcgttcggcggcacgccgtctcgccgcatgccattgaacagcgtgagggcgtcctcgccgtccatggagatggccgtggtccatgacacgacgtcgcgctcgctcatggcgtcgaacagcctccgggcgctgccgggagcgccgcacttgtagtacatcgcgacgagcacgttgccgatggagacgtatccctcgacgcccagcttcaccgcaaagccatggacttgccggccgagctcgagcttcccctcgccgccacatgccgggatcacgctgcagaccgatatccggtcaggctggacgtcgccgtccctgagcatccggaggaacacgccaatcacctcggccgggcagtcgccgtcttgcgcgagcccgcagatcaacgcgttccatgagacgaggtccctcgccggcatatcgtcgaacacactcctggcctccccgagagaccctccacgtgagtacgcagtgacgagcgcgttgccgacgaacacatcagccgcgagcccggaccgccaagccagcgcgtgcagctgccgcacgaggaagccctccccccggccggcggccagcgagagcgcgacggtgcacgtgacggcgtcgggccgcacggcgccggagcggagcatccacgacgcgaagtcgagcgcctcggccgggtcagggaacgcggagaggatggtgttgtaggagctgacatccctcgcccgcgccgcggcgaacaccccgacggcggaagggaacgacccggtcttggcgtagcgggcggcgagggagttggtcacggcggcgaagccgtggaggccggtggttacggcgacggcgtggagcgccgggagggaggccgggtcggacgccctgacggcggccgagaaggcgatggggttgacgcggcggtggcgggcgagcgacgggtggggaattccgtcgaacgggtggtgggcggcagcggtggagagcgtgcggatccgcagccgccgtagtggcatctagtgtagtttttcaaccacggatttgagatcctctcactaaagtcacatgattttgagtcactgacatgtgggccctctttgttatggacccacatgccagagactct

SEQ ID NO: 48326 - DNA, 1501 bp, Oryza sativa
gtaaggcttgagcaggctccagtgccactgagtaattaactgaccaaaaccaatcaggacacagaaatcaacctgctaaaccacatcagaaaaaataacaaattgaaggagacagcagaaacaacatgcatatgttcttgcccgctcagattatttcctctggatatagatgaatcaattctgtccatcttgcatgagactatgtacagtcatacagattatatctgaagaacttgctaataataccgcatcaacattattcacgatcgagcatacgcaccccggcactaatctgccgaagaccggtcaggattcggtggttaccaatctgtctcgatcggtttggcattattcccagtgcagtgttaccttgagcatctatatcattctcatgtaattaactggattcaataaaacttccttcatcttaaaaaacctggggaatcttcagttttgcatcattcatgatgtcatgatgatgatgactcaattggaagtttggaaaaagttttaagataaacacagtaattcttcctgattcttttacggttactctctagactccagtggatttattctcaggagatatttatatctctcatcattcaagaaaagatatttctgacgagaacatcttcagttaaaacaaaaagaaaagcagttacactttcactacttcctatagcacattcgagcagtaaagccggttaaggaaaacaactccaagttaaaagaaggaaaagcagttagactttcacttgctacagcacattcaaaggctgagtagtaaaaaagccaaaaactcgcatcttcagcaacacgcgaaagaagaataaaccatttaaaaactcgaaaaattgagccagacaaagatatggtatcgatcctctgctatgataatcatcgaaaattatggacacgcagcactagaaaggccagtcctgcaagaactatatcctcaagctatcatctatccagcatcagatgcctcctgatctatcctaccattatattcaaacttatttgataaaaaatctaactgcaggaaacctccccaatcagggagagtgatgataatatgtaggctgctcgattattctccattgaatatttgaatggctcaacaatccggaggtgttgctttgtggatcttttaggaaaaagttattccgatctctacactaattagaaatacacatgttgtttaattatagacattagaattcaaacctagtaaactctgcttcactaatagtgcgcttttatgtacttaaaatggtccgttgaattatagatattagaatctaaacctggtaaactccgctacactaatagtgtgctatgtacttaaaaaggtccgattggtggctaataagctcgcaccaataagttattactcaaattacgtagttacatgtatttctaatataactagtagtactagcaaatatgatacattatcactcactagtaattactattatagagcatcttaaatctc

SEQ ID NO: 48327 - DNA, 1501 bp, Oryza sativa
ccgaggttagaagaatgagtaagattaaaagataccctttagccttgggatttggaatattttaatcctatagataaaattcctagaaaacctggagaatttcaatactacaggagaaattcataaggtctttgaacaaacatttgaattaaatcatttcctttataagtattcctataaaatagataattccatatagattacggagaaaaaaatatctcatgtttttttttcttcctgcaaactttaaatcatttttttgaacattcaatatattgaacattaaaagcacaaaacgtgcactggagatacatgattgtttttccaaagagcagcttgtaagagttgctttgtaggataagtattgtcattacaagtatgactaatattttgataattcagcacttcagattcaactttaaatcgttgcgttcctcatttgtgtcaagtagaagtttcctttctttttttttaatttcgttaggaattcaataagcatgttattccatttctatattttcttctattttatgttttttacatgcgttttacagggttgcttagtgggtgggatgttaacgattccgatatggcactaccgttccgaaacttggcggtacgacgtatttcacgtaatccggtggaaaaccaatatattcctaacaaatttcgtgaactaaaatttaaacacaaatccctaaacttactgatacattaaaaaatcgatcagcttcaacgaaatttcggttgaatccatcgaaatcagatcgaaatagacagactctgatcgactgccattatccaaacaaagtctgatctagggctgtcaacgagccgagcttgagtgagctcgtctgcctaagctcgagctcgacacaagctcgagccgagctcgagcctattccacattcgagcttttaggcaagctcggttcgagctcgttcgagctcgagctcggctaccgagctcggtcataagtagtataatatatattttaatgataatcttttgataagtataattattttctagttaatcacactaataaaagagtagaaaatgattaaaataaatatattatgctaacacatgctaatttattgtgtaaatagatactaatatatatatttacctattagtttattatattaataaggtgagctcgagctcgtcttgttaaagctcgcgagctttgctcaggctcgggttcggctcgtttgaagctcgagccgagctcgaatcaagcctagaacgagcccaagctcgagctgctcgcaagccgcgagctttttttttgacagccgatcgattgccatgccatcccacccaccgttcgttggtttgatgatgatccaacggccaccaattaaaaaccttgtagccaaaaaagaaaaaaaattataaaaaccaagaggtcgcgcacccaaagccctagtcctcctccatccccaaactccgccgccgccgccgtcaccgccgctcgccaccgccgcggccgcca

SEQ ID NO: 48328 - DNA, 1501 bp, Oryza sativa
cagattagatatatgaagtgggttagaaagacatgttttcagttttccatataggacattgggtgagcttggctgtaggcagcctttgggcgatactgtttctgttatatacctctttttttgttcatccatagtggatcgatgtagaagttagactgatcatgtctaatctatgttcaacatgattggttggatcactattttcttggttcagaatgaatcaaaaggtttcttttttactattcagtgctgatacgagctgtgcatagcattggagtccctacaggcctacactgggattgtgattgtaggtttatggtttgaatatttttttgggtccacgattttattttagttgtagcatgtgcagactatttggttggcctgaattgctgtaactacataaaacagttgtcacccaccatgatactctgcttcttttgttcccaatagccaccaaaaaaaaaaagaaagatatggtggtacaaccaaacgaccctatgacctgactgtgcagtaaactattctttgacgccacataacttctttgcttgattacatggtctgtagaacagtttttcgtacaagaatgaagacacttgtagccatgtacattcggcttaaaagcgattccgattgtgaatgcaattctgattttccagctatccttcttgcaggtgttgaggtttgacacattggcgtgactgcaggactgaaggatgcgcttcctcttcatgcgataattcgaagtttttctaccaccagtaaatgtgcgatttttacctagttttaagatagtggaggtctgttgtatcatctatctagtagaaaaattttgttcccaggctgttctatgggcctaaaagtgttctgttaagctgtaacttatcggtaagctactgcatgactgaatgctgcaggcctgcagtaacatttgatcgtgatcaatgatatacttgtcttatggaccctacggataaaccctgtctgtccaatcttcatcagtttacgttaaaacctctggatttgtacgcattttggctttgataagcagataaaacttacaaataagatatgtatttcctttataggaataatgtgcattgaaagagagacacaatgactgaagggtaaatactgatcgatcagccacagaaaaaaaaaatcagaacgtcacttggcgacacaatcgtaagttcgtaacgcagcgtccgggcggttgaaacttgagaggcaaaagggaaactggagttgcgatgtcataaaccgagtgaaaatcgtcgtcttcttgttcactgcaagcacaatgttcagagtgcacacatacaccatgaaaagaacggcctccccatctcttgttcacatcttcaatatgctcctctgcagaggccagtatgcaagggattggaagctaacgagaaaatttaacaggtaatgtcaaggatacgatcatatcttgctaaaagaccggaaaattttgacaggacatacatactttatg

SEQ ID NO: 48329 - DNA, 192 bp, Oryza sativa
tttcatgattgcatctattacttgtgttttggcactggaactgttgattttatgtaactttgcaaagcaatgtgcatgatgcagggtccttatcctcctttatgcctctggttaaggaatctggctattactctgcagcctgaaagactttcctgccaatatattttgagctgggagaaacccttcctaagg

SEQ ID NO: 48330 - DNA, 294 bp, Oryza sativa
agagcttgaatagatgcaagactgcaactctgcttgctcagcacatatgttgaagcgactttgctgaattgcttgctggttgctgttgaagtgagttgaaataaggagtatcaaccaattgcattaggcaactaaatcggagccgtctaaatatttatggacaaaatttcttcaaaaaatttaacatatacaaatatagtataataatagtgtatttacattttcactcttaataaactttggccggcccggaaaaaaaagtgtacttacattataatttgaatataacaacaa

SEQ ID NO: 48331 - DNA, 373 bp, Oryza sativa
ttttatctcagaagggctgactgtctctgcagtctgcatgcttttcttgtgtttggaattttgctatgatctgatcgctagaaactctgctatggtagattgttggcatatgaaattggtgacaaaacgtattagcacaattggcaatcacgttcctgtgtagagacttggcctcatatgttctgggtgttcggtgaaaatattgtcaatatctctttttaagtatttcacctgtgtacacaatcactctgttggtcagtatgcttgcagcttaggtgctcaacgttcttggatccagagatttcattaatttccttgttcagtaacttgtgcttctggtcacaattcttaaccaagtattttgctttgcaga

SEQ ID NO: 48332 - DNA, 1501 bp, Oryza sativa
ctcctctctggtggctcgcgccaaatccaccccgcgtatgcgttgacgtcgtgcgcgaaccagctgcaaaacctgcgaccacagcttcgattccgcgaaccagatgctccttcctatggaaggaagtaggttagcgtctcgatcgcaataagctgtgcgttttctttgttcttggatgacgtcgctgggatcttgatggtgtgcttagtttgttgtgtttttataccttgacagttggaagagcggtttgaatctaatctattgttattagagtgttgtcatgtatacaaacagcatattttaaatatttttttaaccatttataattttagaaacgaacctttccaacacttgttttcaaaatctaaatcttttgactacgtcgctaacctaggtggcgtgacaacaagacaacgctgtaataatagactggcgtggtaacattattttgcctcaaaactttcagattttagaaataatttttgaaagtgtttatttttaaaattaaaaatttcaaaaagtaaaaaaaatcacagactgtatccattattaaacttaccatgtatgatcagataaattttattccttcatgggatcagtatgatttacatatgtccaaaacgggattttcatatgtccgaaacggcagtgatattcatacatttaaaatttcttatcacctttgttcgacactttttttcccaacccctctctctcctttttcgcgaccaagcctatgtaaacaaaccactgagaatagttagagaaggactactcatctcacacggtgaattggcaataaatgagaagcacaaataatgttaggttatttgatagtgcagtgatggccgtgtgatttcaatttggaaatgtcgtgttcaatctccacactttcacactttcttattaaaaatgtttagagggatgtctagcattccaaatcttttttttatttacattctatacatttctactagtatcccgcaaactttgtatagaaactactcgcaagctttatataaaaactactccggccaagaaaaaaattgctcgcaatagcatactactcactccgtttcacaatgtaataaatctagacagtctagatttattactattaatatgaatatgggaaatgttagaatgatttatattgtgaaacggagggatgagtatttcactattttgcatcagttctctgcacggtacgacagtacaacacggagatgatacggagacaaatcagccctgtgcgtgcttatccagtttaccgtctccacagggaaacggactcaaaaagctaaatttaaacggagagcaaaatatttcccgtaacaacctgtatcttgttgccctcctcctccgccaactcacggatttcttcttctctcctcctcctccgcgaggcgaattctcctcctcgtcgccaccgcctcctcctcctcctccttcccacccacgcttctcccgcggatctcctcctagaagcttccacggctcg

SEQ ID NO: 48333 - DNA, 752 bp, Oryza sativa
aaaaggtgataggtgaaggtgaaacaataaagtactacaaaagttggcaggtggagaaataaactagtaagaaaatggatggtggagagaataaacaaggttaaaagtaattgataggttgggaataaagttttatctcaggatttcaaattttgaaataatttgtaaggaaaagtccttgcattttgggattctccgtccaaaagaaatcaatcttggttatgtacctgaacaaatgtatatctagattcatatagattcatatatagtattgtttcagtacacaaattttggtgtggtgaaatgtcagtggcaatatttcctctcttttttttccatgtatgcagtattcagtgctttcctggcttgtcgtcggtttgtacttatgatggccacagctaactagctactccctccgtcctaaaatataagtatttttggagtagctgtttgttgcatgtatacacgataccgaggtggtgggctggcagtaacagctaacggagtggctactgcaggcatacgtcgttaccgaccgcaaatgaagagtgctggttacactttttcccccctaagtgaagagtgttggattcacttattttacaaatgaagagtgttggttacactatttttcccctaagtgaagagtgttggattcacttgttttacagtttgagggtcactactctattagagatccttttcatgtaagcttttgcgtctaaccaactaggaacttaagattgccaaga

SEQ ID NO: 48334 - DNA, 238 bp, Oryza sativa
tactataaaagacactagtggtgccaccaccactacttttgtactttttgcaaactagtcccttatattttctaatattatataattgtctaatatttgtttcaatcaagtgaatatcatgtattcaaataagcaaacatctctatgacatattattatatattttcttttacccatagcaaagcatggatattttgctggtaatttagaagtgacaatacatcatctcttggctagg

SEQ ID NO: 48335 - DNA, 1501 bp, Oryza sativa
ttctactgctccaaccattctcggcaaccatttccagcttctactaccgccacgctgccattacccgagcactacgctatgattcaggcgatggtgacctggacggacttggtcttcttctccggcggcggccgcttcttgacggtgaccgtgagcaccccgttctcgcatcgcgccgagatgccgccggtgtccgcgtcctccgggaggcggaacttgcgcgcgaacgccctcggcgacgcgcggcgctcgaggcggatgtacttgcactccccttcctcctcctcccgcttccgcttcccgttcccggcgccattgctgctcttcatcaccagcaccctgtcctcctccagcgtcacctgcgcagacaagaaagaatcgcgcccaaactaactcgctgattcgaacgcgaatcgaggaaattcagggctcggattttgtacgcacctggatgtcggacttggagaggccagggacgtcgagcacgaacgcgtactcgccgggggtctccatgatgtccactggcgcgccaccaccgattccactgatgcggtgctggccgtgtccatgcgcggcgtggtgcgcgtggtcgcccgccgagcggcggtccccggcggcggcgccgaggcggtcgagcacctccggcaggtggaggaggctggtcacggcggtgtcgaacagctccgtcatggctaccaacttgggctttgctctctcgctctccttcttgctactgcagcaatggcgagacggcggtggaggagaggaatgggtataaagcgagcggaagcgaaggttcgagatggcgcggagttcgctgcgctgtcgcgcgtcgagaaagatcaggagacacttggaagaacctcgtacccacttgtacattgggccgaacaaagcccaaatctcccatcacagcagctgttttggaccgcagtctaggccttggcctggttggagagttaatccgcagacaccgagcccatcaaatctgttgctgacactggtggcctcgtgcatggaatataaagtccacttatggcctctcaactttacttcaagtttaactaacatcccttattcccagtacaggaaacttagcccatcaactatacgaaaccgtacaatttgataactcgtggaggtggaggagttagttgcagggagagcgctacgcgtcggacgtacggcacgagacgaaaaatcggtgcattcatgagccgtccgatccacgcgcatgccatcagacatccaacatcacgaagcatgcatgcatgaaaaatattttaaactactttttctcttaaattatttatccaagtcatgatccgattacaccattaaattcgccattaaattcgttgcagttaaatttttaaaaaggaaccacacatggatatattccagtgaaaaaaagcttattattgaattatttttaaatgttgcacattgttccaccaagtatatcggaattgtttcactaggtagatcgaaaatgtttcaa

SEQ ID NO: 48336 - DNA, 1501 bp, Oryza sativa
tctcgcaggaggtggcgcgtggttgacgcggtcagaaaagcgcgcgcggccgccctcgaggcgccagctgggcacccgcgcctgaaacttctggatggtcgcccccggaaatatctccgtcctcccaaccacatctcagccgtcaaccacccatcggacggatggtaaaaaaaaaagaaaaatgatccggttagatgtggggtggtgggccccacatgtcactggaaaggtcttgcactgttctagacacatcacacatctgcttcgaggcgaccgttgcgttttttttcctgatgctccagtggaaaaaagagcggccttgaagagcaagtttaacagcgtagccaactactggctctaatttatctatagctaatctaatagtttatttatacaatagttacatactacattattaatacatagttccatatattatacacacactgtgtcttggagtctgtgctacagttggctacaaatctgtagctcgctgcccttctctctctttatttatcttcttaaaatatgtttgcagctggcttatagcctgctattatgtgtcttcaggcgtgtaatcataaccaaactaattaaccgctagtgagcgtctaatggagtagcatcaccagctaaacgtatttcagaattgtggatcagatcaactttttgtctaagaatctttagttgctccggctttcgcaagtgtaaaaggcactcgcaattggtaacacacgccatagccacactgaaaaggacaagcatattagcagttgcccctacctttcaaacgattctttcgcctgattaacatctttttcgtccaggttgaaagttgataatcacaatcaattaggcccctttgcaatgcatggttgtctgaaaattcaaatacagtaaaagtgcaaaacagaagatgcagctagtaatttccccacatagcagaaaccacataaaaccgatcaattaggtatcaggtcacaattaaccatccggataagctcatcaggagtgcatctactaccatcttctcgaatgatgtgaaaaaaatggcaaattgtcaaggttaaccgtaaatctacagtgccaatttctgacggcacatcctacgagcctcatagattattcatattctctaataaacaaaaagatttgtgagagaataaaaataaatttatagataaaatgtttatatatttgttcgtagcgatttaaaagtcaatgttaaaaataaattacgttaaaaatatcttaaaattaactttaaaatttaaatttagattttaattttgatttattagccaaccgacgagactctacggctctgtgcgcaacagtagcagtgtctggaagcagggatagctagctgcagctgtagcaaaagcaacgatggccagccaaggctgggcgagacgtggaaataaagcgaggaaattcctaggcagaaatatttaaaaggcaagtgggcatcatggccttgtttctggaggcttcctggact

SEQ ID NO: 48337 - DNA, 1501 bp, Oryza sativa
tgtaatttctttgtaatttagtctttttgtactctcaactctttcataatatataccgtaggggcttcccctactgttaaagtttcaaaaaaaaaaaacaagatgaccgtttagtcctaagaatagaagtatgattgctagtctacttaatttaaacataacaaagcagatgttatacaccttaaaggttaagagcaatgtatattgctaaatcagcccttttattgcttaaagacagggtctaaaaaatggttccataatgcgtagactttataatgagacacgtgacatatgagtggcctgaatcaggagaaagagaatcccctaatatttttttattacttatgacatgttcatatgcataagggtatctggactactatatatatgaactactcttacataggtaaagcagatcataaataattatatagatcattttttttcatatattatggttgccctaaacaatgcaaaataaaatggttttgccaaatcggataactattcttttggtgataggagacgtacccgtcaataacgagacgtccgtagtgacttcgtcaatattaagatatatgtcggtatagtttttcggagatactcatagggatacgatgtacatatgtgtgttcataggattgagtgtgtacgtgttgtgagcattgcgtcgcgtttgtacaaatgtttataaaaaaatataggaaagggtctttatattttaattgactctctttccaatatctatgtcttgatgacaataagatcctgataaggatctgttgaacagaaactaagcttgactcgatgtctaccacgcgcagacttagccttaaacaacttttaacataaagtggtagccatgtatcaaatcaaatcacgccatttgtgtggcaaaactacctatatagcaaccaactgttctttttaatcattgagtaaattaatttactagtagtagacatctaaacactttgtcatattagcctcctaaaatggaactaaaatagcaatcctgataggatactaggatcacattcattagtcattgtgtcttcaattctactagcgcatatatgcaggtaatttgttgattatgtatttatgtatgcaagttttaaatttgaacactttataacttactgtgcatttaagagaggatatgcacataccgaagaagaaactgccaacagctaatactgacaaataatccgatccctttttttccccttaattttcacaggtctacatggtacagcttggaaggcttaagcccctgtgtggcgttgaagaatttgagcgtgcgcgcccacttgaggcggtccttgagcttgtgcacgacgacggtgtccgccacgagcgcgtggcggaagcagttcaccccctcccgcatcccgccgtcgaggtagtcgtacatccgcgtctcctcgccgtacctgttactccccttgccgccgcggcgcagccaccggccgaacacctcgtcctcgggccccttcac

SEQ ID NO: 48338 - DNA, 1137 bp, Oryza sativa
gagaaagagaacgatcgaacgaacgagagcgagaacgagaacgatcgaacgaagacaagcgagaacgagggaacgaacgtgaatgagaacgagcgaacgaacgtgaacgagttagggaacgtgaaagagcaaacgaacgaggacgatcgttaacgtgaaatgcaatatatatatatatatatgtatatatataggacactcatatggggcaccatggtgcccgggcaccatggtatcaaatacacaatgtatatatatatatatatatatatatatatatatatatatatatatgtatatatatatatatatgtatatatatatatatatgttacttcgcatttatcctaatacatttttttgtatcttgcagaaaagacgtgttgtcggagtcatccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 48339 - DNA, 1501 bp, Oryza sativa
cccgggactaaagatagcgatctttagtcccggattggtactcccggtttgaaaaccgggactaaaggggggttacgaaccgggactacaaagggtttctccaccagtgaaactagaaaaactaaaacataatcccaacctatatacgtggatggattgggattaggacctaaccagaggcacgatggaggtgtgagttcagtaaatgccaatgaaagcacattttttgctcagatatactctctccgttttataaagagtacttttatcctttttttattttaattactgccaggacttttgtcttgtagtgcaattttcattaaatggaaaaatataatcacagagagagcactgttagatttataaatagtactttaagatatccaaccattagtacttcattattcttcccgttttctctttgtattaatgaagggcatgttagtgccgattgctcgatctgctttaactttcaaaaacaacacttcttttatggagggagtaatcatctactcatgttgctgaaagctgaaagctgaaagtgtgagctcactaatcccattcctctaaaattttttaactatattggttggcctttctcagacaagagaattcttataattctctctatacagtacattgaacgtagtatatttttctgcattttgtttggacgcgactagcggttatacgtcttatcctagccaaaatgttaaatgccgggtacccctccgtcaaaaaaaaattccaatcctagtacgaacctggacatatgtgtgctcatgttcgtagctagggtttgtctctttttttttacggagtagtagtgctttattactcgtcaaaaaattatttttgatgtttttaaaaattttctcaactagatgtgacatttaagaagtaccaattataatattaaaagcaatattgccaatcgccttcaagacggtggaagacaccgtgcacataccttcaaggaggcattacatattactccctccatctacttttgattggcatatttccaaatataaaaaatttatttttgataggcatatttcaatccaacaacctatccttttaatgactttttcagatttaatgtgtgactctccattcattcacacataattggctacatgagcatcgagaaatgtaaatattaatgaatcgcttgtttacgagaaataactaatagcatgtttaaatggattataagtagaattaattatccttatcctcgttaggtataccaagatgaaatatcactatcaaaaatagatgaagagagtatgtgcaagtacagcatttgattaaaagagggtgaaacactcaaatacaaaaaggtgcaacaagataaagcataatacaatgttttgaaaaaaaaatacaagaagagcctatcgtccgggccgatggctgctcgtgtcgatgacctctggcctcgtggcctcagcctcttccattaagtggcatagttattactcacatttgggat

SEQ ID NO: 48340 - DNA, 1501 bp, Oryza sativa
aagcatctcaccagctaattagccgttcttctcccctgattcgggtaattggcttgataatatgatggccatgaagaggctttctttctccttgttcctcctcccgttcttgctcctcgcgttcgtctactccctcttcttccccggctacttcagtatcctgccatctctcgccgccaggtgcagcaacagcgtggcggcgacgccggcgaacgcgacggggccggcggtggatctgcgcgtgctcctcggcgtggtcacccgggccgagatgtacgagcggcgcgcgctgctccgcctggcgtacgcgctccagccggcgcccgcgcgcgccgtcgtcgacgtccggttcttcgtgtgcagcctcgccagggaggaggacgccgtgctggtgtcgctcgagatcatcgcccacggcgacgtcgtggtgctcaactgcacggagaacatggacgacggcaagacgcactcctacttctcgtccctcccggcgctgttcgccgacgcgccgtacgactacgtcggcaagatcgacgacgactcgtactaccgcctggcgtcgctcgccgacacgctccgcgacaagccgcggcgcgacctgtaccacgggttcccggcgccgtgccacgccgacccgaggtcgcagttcatgtcgggcatggggtacatcgtgtcgtgggacgtggcggcgtgggtggcggcgacggaggcgctgcggggcgacgtgaaggggcccgaggacgaggtgttcggccggtggctgcgccgcggcggcaaggggagtaacaggtacggcgaggagacgcggatgtacgactacctcgacggcgggatgcgggagggggtgaactgcttccgccacgcgctcgtggcggacaccgtcgtcgtgcacaagctcaaggaccgcctcaagtgggcgcgcacgctcaaattcttcaacgccacacaggggcttaagccttccaagctgtaccatgtagacctgtgaaaattaaggggaaaaaaagggatcggattatttgtcagtattagctgttggcagtttcttcttcggtatgtgcatatcctctcttaaatgcacagtaagttataaagtgttcaaatttaaaacttgcatacataaatacataatcaacaaattacctgcatatatgcgctagtagaattgaagacacaatgactaatgaatgtgatcctagtatcctatcaggattgctattttagttccattttaggaggctaatatgacaaagtgtttagatgtctactactagtaaattaatttactcaatgattaaaaagaacagttggttgctatataggtagttttgccacacaaatggcgtgatttgatttgatacatggctaccactttatgttaaaagttgtttaaggctaagtctgcgcgtggtagacatcgagtcaagcttagtttctgttcaacagatccttatcaggatcttattgtcatcaagacatagatattggaaagagagtcaat

SEQ ID NO: 48341 - DNA, 1501 bp, Oryza sativa
ccgagagagaaagagggagtccgcccgcgcctgcggcacgagcagaggaggaggaggatgagggatcgggcgcccgccggtggattcggcggaggcgggagggaattcggcggcgcgcgagaagatgatccggtgggttcgccgcggcgcgcgtcggcgatggcgcaggggagggtgggaggagaatggagcggaggaagaagaggggtggagttgggctctctgggccgtaagagcgtgatggattgatgggccagatactttttcatgggccttatcaagagggagggagcagtgagcacggagcacggttgttcgtgtttttttttatcatgtttcacaccttatactctcatgtttttcacactcacatttcctaagctattaaataatatttttataaactattctgtaaaaatattgttttaaaaattatattaatttattaatttagtttttatctactatttaattaatcatgagctaatatatcactttacataactgaaagtgtttctaaacccttcgaaagaacacggccttaactcccaaggagattgtgagaaagtttgttttgttttccgcgtgcacgcttctcgaaatattaaacggtatattttttaaaaaaattatatacgaaagttgttttaaaaaatcatattaatctatttttaaagtttaaaatactttatacttaattaatcatgcgctaatggctcacctcattttgcgtatcttctcaatcttctccaaccattttcgtttgagcttagacttcttggctacatgtgccttttaagctttaagtttattggtggaatatatcttaactttacattttaaaaaaagctactcaaacttagtttttagctttaacagtgtaagggtgacctgtggttttaaaaaagtcaaacaaaaagagtgatggtttatttggacttaagcttttttaaatatggcttaaaaagcctaaataaaaaggaccttagctcattgaagactctgtttagaccattatttgtgctattgtatagatagggcagcatactatttgtgctattgtatagattgtttaaagaattgtattaattcagtatgcatatctaaatatactgttatacgtccaatgttctaatgtgtaaatataaaatggaaaacttctatagattggcagttatgtataccattgcatcccttttcaactcttagaaccgtgatcaccccacccctattgttctgtttatcatagaagcttcgtcaatcattgatttccccaacatgacttcttcagttcttgaaattgaacagcaagacagataggtactgagaatcaattgtaaaatgcaatgtctacgtagtacaacacagccgcgacacggatggagagaaagaattgcgcagtagcagcagcatcgacgagttttggcacgcccggtcactcactccgagcagcgccaccgccacggcagagtggcagcggcagcagctcggtgctccggca

SEQ ID NO: 48342 - DNA, 1264 bp, Oryza sativa
tcacacatggtcgcacacagctgcgtgaccgatgaggccgttccctcgaaaacccgtgcgttgcgctctttccaaatcaaccatgtaacgaggatgaccccggcgtcgaacgtcttgcgatcgatcttcgcaacagtttgccgggcagcgagccaccaaccggcaaagtctgaggacggcggcgagcaggagaggctcaaacgagcctgaaccttcacccaaacttgctgcgagaaggtgcaggcttggaagatgtgttggcaggactctccatccttagaacaaaggtgacaaattggtgcgagcttccaacctcggcgctgcaggttatcagctgttaaacaggcattgcggaccgcaaggaacatgaagaacttgcatctcactggcgcgcgggatttccagataatcttgccgagcgggcaggatgttctaccggccgaaaggatagagtaggcagactgcaccgagaagtcgccattaggtgccgccttccagatcatagagtcagtacttccggggtcgagagaaatcccggcgatcacgtcccagagcgcaaggtattcccccatcgcttggacagacaggccgcccctaatatctgcaatccaggagttgtcgcagagagcggcagccaccgtgatgtcactcagcttgacgaaggagaaaagaattgggaatctgtactgcactgatcctccgtctggcaaccagctgtcgcaccaaaacgaggtagaggctccgttccccagcagtactttgctaccagcggcaaagcagtgcagtgactttctgtcagctagaggcgcaacgcgcatccaaggacgctctggctcagcgcggcgcagccaaatccaccgagtgcgaagcgcaattcccattaggcataggtttctgatccctagtcccccctgctcgatagagaggcaaagcttctcccaagccaccaagctgcaagagcccgcagcatcttcatcacccttccaaaggaaaccccggcatttcttctcaatttcgttgatcgcccaagctggtagttccaagacggacatgaagtagagtgggagcgatggcgccaagttcatgtttttgcatatcagaacttgctcgttagctgcgcgtgattaggcttctgttctgtacttcgtaatctagtattagccaatgattaaaagctccaatccagcctgttcatactctattattagtcatttttttgtgcttgtgtgtgtaattttcgtagccgtctaggattgttggaata

SEQ ID NO: 48343 - DNA, 264 bp, Oryza sativa
atgagcaaacaggagaaaagaatgtcaagcctaccctaaagaagctccatatgaaccatgcttgccctaaaatagctcacatgcctatgcatataagagataagatcattaaaaaacagtgttgtatcataatttagtgtcactgtgtgtgcaaaggtcaaaatatactagctgagtatatgatttaaaacagagatagaatcaagatgagaattcctggcgtggtagcaggtgcagaaatcaagagttaaattttgcttaaaa

SEQ ID NO: 48344 - DNA, 318 bp, Oryza sativa
tgtgtgcctgttgtctcatttgatctgccatttcagcgcagttattatttttcctatctgcatttaagcaattctattatgtacatgtttgtgcatctgctgtgtgttctcctttcctttaacctctcaccatcttaactatatttagccattgaatggacttggctatgagcctctcaatggcatctcctccctcctcctttcttgctcttttcatttgccacttctctgttctcgtgtgttagttttcatgcacaggaaagactaatgctttggattttggagaaggtgaaggaggaagagacagaggaggcagga

SEQ ID NO: 48345 - DNA, 218 bp, Oryza sativa
attcctgcagcccattttttttctatattacattattacacataaatttaaggttggcgaagtgtttttttcttaaagaaaaaagttttacttggatcagccaatacagcagcgagagacaacaaaatgtcagtaaatatagggataacacaaatcgacccgctgacaattcattcattctaatttaactaaataaaatttagttgaattataataga

SEQ ID NO: 48346 - DNA, 1501 bp, Oryza sativa
tgacataggcctccaaatgacggcagccatggctggtgacgacgcaaatgacggcggccatggctggcggcggtggctgtcaacggcggcggtcgcggcggtgctcctcagcttaggggatggtgggtgcggaggaaggtcggggaaggcagcactcctccctgtggatggcggccacggcaaaaggcgatggcgacgatgctcctcccacaggtggtgacgatgacaaggcaaccgaggggatacgggggagctcagcagggatggtgagagccggtgtggcggcagagctagagggagaggagaagcatggatacagggagaggcggatagaaggatagccagtctgggaggctggccaatattggccagtgcgtgggttgagatggacaggcatttggcttagagagtcgaatagagagtctattgaaggagtgtttttggttcatttgctaaatttttggcttggaggaatagagaggctgttggagatgcttttactcttaggagtgggtaatactacttgcaagcgatctcgttccatatcaatatgtaacgactttctttttagtgtgctaatgtcatcgtatttgcaggatcatcgcgtgttgtttatcgtatatgcacccgatgacttcaatgaagtccatatgcgtcgacgcgtagtttctcaatgaacgtaatccatttacctatgttgcctttgatagttttgttttattggaaaaaaaaatgaagcaaccctgatcatgttaaaaaggagaagcatgcgcatgtcataaagtataaaccgtgttgatcaatgcactattgttgatttagtcatatgacttagctctagtaccattgtaatagatcatgcgcattttgctaaacataatggattgatatttgcagtatactgataaaagatcagtttcagaggacacacacctgtaagtattcatggttaactagtgcaaatcaattaattaaccgatgtcagcagcagctagcgtaataatcaaaagttggcttggcagagaagatcttggtgagtgcatgtctgacttgactgcatggtagggcggcgtccgttaatccccagcaacacacacacacacacaaacacacacaaaaaataatgtggcggtgtccctataatggagccaaccgtcacatcatcacctcacaaattcacaattctcacaagcccacacccgtatttttctcccggtgtccggtgcctccttcctctctagctatccatctactaaacctactataaagccagcccggccacaaccccagatgcacccgctcaccgctgctgccaaacacgccatcaccataccaccaccaccaccaccagccgcagcagctagctacacatcgtcgccgtcgtcaggcactagcgatccatcggttctagatctctcttctgctgagatagacgacgacggcgacggcgacgacgatcgagctgagcagcaagaaatcaagaattcgaaggagttagtga

SEQ ID NO: 48347 - DNA, 1501 bp, Oryza sativa
caagtactatgcatgcgatcaaatgctaaactccaatgaggctcagcaaagatatccagttattcccactgcctttcctccccccttttcccaactttttcttccctggggctcatctcttttcctttggccaaaatttaaaactgttcatgttgctgatgacaggcaatggcctttgggaatatgaccttgtaggaagtgacaagcaggaaaataccaaatgactccttccatcctttctccttgctagcttatgaagggttgcatattttaagccatcttgctttaggttaataaagtctatcctgtggacttgatcaggattaacttggattgccttttgagaaaaaggtggtggctctattgcatccatctagttttaccatcgctgtcttatgagtcactgacagtggggctaatgtgctccactctggtggcctgtccccacctgtcggtggcttgacacttcgttaggaccaatcaattgttaatttttacgtcgatgaccaggcaaattaatcatcaaggtcaatatgtgagggctcaatttcacggcattgtgattggtattagtttagtattagcaatatgcaatgtaaagtggtagccttttgccattaattcccaacagcttcctgtttggagcttcttccatggtgcataaataaggatgtggacatttgtgccacttgtctagacagtagtgagtgagctagctagttcaactcaatcagttttaagagattgattgccatagtaagttagttatctcccaaaaatttccttcacttggatgcatggttgttggttaattattttttatcgctgtccaatgatcatagttagttagagagttgttgggtatatactatcactgtaaatattatctactgaattacagtgatagttacatgcagctaaccttgatactaaagtattattgttaattatttcccccctttttgagttttgccacatctagggtagaagagcagagtagcactatccacatagctaggcaaatatatggcatttaatagatgaacaagttttccaagttagttaggtggcacaagaaaacaagcagccaacagcagcatggaggactgggagaagatggtcaaaacaaaagaatatgcatgagctcttgatctgtagctgggagaccatagatgttggcagtatgcatgcatgcaaattaaaattcttgataaatttgatgatggaagaaaagaaaaccatatgtgcatattgatatccccatgtcttggtagctgcctgcagtaaatgaccgagtcatgtacacgtttctttctttcaattcgcttagagttcttgcctctttcagtctcaacttttcttctgaatcttctctttcagtctgcatgttctttaactagatagcttttctctgcttttcttggtacattctctgaaccttaacttggattcaccatgcctgacgtatgggcaggcagcccggccttttttccgtttcaga

SEQ ID NO: 48348 - DNA, 454 bp, Oryza sativa
ggaacctgctatggctattgaactgcagatactaaattggcatgatattgggtccttgtagtgtaatcgttatgtacacaaatgattgacatctgaggaatttttatcacatttacttacaatgtaaaaaagtttcccagccatgtttgtcacaaggttgcatgctaaatttatcttaatgcaatcgcgtcttcatatcctatttagtataaagaaccgagtatttgatttaccaacagagtgtctttttgttaaactatcagtttggcatcctactgaaacattctagtactgtttgttgtttctctaattgtaatttttgtgcatatattgtgaagcataaatggctgtgcaatttccaaattgctgctgtcttttgtttgataaattaataacagtttctcatccaatgcagacttttgaagtgtggaggatggtggttatcttttttaga

SEQ ID NO: 48349 - DNA, 1501 bp, Oryza sativa
tgagaaagtaagggttctttggaatgtgaattgctgaaaattccttggaaaagagagaaataatgtgcgtgtgtacggatatggattgcctaaacttggtgtcaaattttgttggtagtggtgttttgtgatataatcccagtttggttgtttcagtactggtaaaaatagatcaggacttggattttggtctttcaggaactggatgcaaacctcagcctggtatctgaatgtgttaggtcaggttgtgtcatactgcaatgtgttttcagtagggtggattagtttactctcccttctctgaatgctattatacttttacaaactttggtgcttcttctctcttcactgatatatcttacccttggtgctatcatgcttgttttgcatatccatactacgagtgatgtcctgttctttgcctgccaaacgcctttggtattaatttaaggcatgtttttccaaacattggctatgaatgaccttggtcattatggatcattggatcctatgagaggtgaatgatattgtttctatatgatgtaccgtgctgtggttattgtagtgttgattttgacatcaggccttcagatctgttgaatattccacctattgcatctctagagtctaaactgtgggatatgttcttacgtgctatgataagatacaatacaacacatgtattgtattgaaccttgcatcctgattttacactctatgttctggttcctaatttagcctagcctgttttttatactttggtataactttcacctggtaaagttgtgtgtcagctgtggtttgctgttaatcaggtataacccagaaagtggaaacatgtgtgaatagacagctgctagctttgcctgcatggtggtctctacactttataatttagacaaacttaaatattactaaattaggcaaacctgcatactgcgcatacatgttctgtcaaagtttattatttttcttctatgcgttgtgacctgtccatctatgtactgtatggatattattatgcttgagaggaggtaggtatgctttaatatccactgctgtttcttttacgcgtgttagtattctgaaaagggcaaaaacaatgtccaaagccccatgattacataaacggggacaggtttgtgatgtttgatcacctttaaaatgcatcataatttcaacttgttgaacatacagattacctgctttcttcatttccgtgttcagcagctttgcaataatttctatgttcatttctagtcgtcttaatgtttatttgaaaatttattttccttctatgtgcgaaattgatgttttttttactgtgttctcttgcagaatagctctctttgtgatataaatctaaatgttcacttgaagctggaagtctctgctgaagcgtagaatcgtagataattcctgcactcagttttgagaaaactggaggtctcagaaatttagcagcttgcttctttctttgttgcatctaagaattgatgac

SEQ ID NO: 48350 - DNA, 1501 bp, Oryza sativa
aaatccaaccgggttgagatgtttggccttggttttctctggcgactgaaagttgcaagcttacattttacatttacagcgtttgtcaagacatccattgagggaacagtttacactggttcagacaaggcaataatgtgataatgtgtacaacaagcaacttcgtagtagtactgaactgtacacttcaaattctgaacacccgacactgagctgtcttctcctaaccctgcaattatcttccatccttctttgttatgctgtcccaaagcaattatcactcgtacccaagtactccagagaacaatgtcaaaattgtcatgctgtttttctgtttagctagtgcaggggacgccaaaagtctttccatcagctccatttgtttcgccgcatattgggcatagttcttgacagacagtgattggcacgttgttcatcagtaggtacataccaacagaaaccttccaaaccatgccaatacattcttcgtatatattcctggctattcggtaggtcagttctgaatgagtgagtgataatggcatctgtttctgccataaaataaacgaaatctgcgacgcaaatgcaacgttgtgatgatcacttaaattagtaccacccagatgcacatggtgttttaccacgactgacctcttgacctctgagatttattgattagattataacgtaatcgttgttaactgcaaaagctgcacttgccactgttcctttcttgactttcagagttcacagcatagttcagaattcagaaacgaagtacaagcggttaattaagtactcactaattaacaatggagctgtacgcactagtagtaattcttttcgagcaatgaaagctgtctgatgggcgctggctatcaatgtatgtcactgtgttgtcatttggcagccaatgtgagttgtaaagaggtagtatagcgtcttttcgagagcaaaacgccgtggcacgatcggtgctacaggccaagtcaggcggttcgtcatgatgaatccaactcaccaaaaataattctggtgcagttttatttcagtcctctgctcttgcatccaaagagctagacttccctgaacaaattggcatcgattttaattaccaaacggtaacggaatgaatgctgtgactaaattagctggactgctggagtagactctgacctgcatagaactaactactataattagttcgagattccataaaaatcaaagaagctaatcagttcgtcctctcggcgcagcctgcacataattgaactgctaattttattctagtcggaagcacatttaggtagacctgccttccatagtcttgtgtggcgcaatcattatcgaacatggctcctgtccccaacaccatcatctaaaaaatggcttttttactctcaacgtcgagtccatatatacggccttgagctagcgcggtggtggtagactggtagtggcagtagtgcaaatccacagctcagcattttgcctcccatgg

SEQ ID NO: 48351 - DNA, 1501 bp, Oryza sativa
ggttctcgcaggcggcgagcacgttcgccacgtcgttggacccgcgcagcgtcacgctctcgacgcgcagccgcgtgagccccgcgaacgcgcgggggcacccgccgacgagcgacgcgagccgcctcccgttcgcaagcgtgtccctgcccgtgcactcgagggcgcgcttctcgcccctcacgtcgaacgccgcctcgcggaagcgggcgcggccgctcgcgatggcgtcgtcgacggagcggacgatgccgatggactccgccctcaggtagaaccgcacgaggaggcggtcgatggcgtgctcgccgctgcgacgcgcgaggatggctttcgcggcgtgcgccacggcgaggttggctcgagcttctcgggacagtctcgacgtgaaagtgaaaccatcctgatgatcatcatcctgcttctttctgaaggagaggacgtccagtacgatatcgggcagcgcggccgggagatgcctccaccgtttagcgagtatcgctgttcttactgcgtcgcgtaggtcgacacgtttcaggatggagagcaggacgtcgtcaggtagctcgctgagccggtccgccatcgatgcatgcacctagctagctttccacaggaagagatgagattatacttacatacgtacactcgctatcgattcgatgcgaaggtgaagaacggaagatcggaggaagtccggctagagctctctatttaaaggggtacacgtataaggacgtccgtgtcctattcaaattctatgtcgtacagtatacccgattccgcatccgtctcggagattaagtatttctttagagaaaaaaaacgttggaatttgctcccttctcgccttcttggtctcttgtgagatttgggggcatttaactatttgccacttttaagatatgataattaaaaatttatcactcgctatctatatgagtcctcatatattcatgatatgggtctagtggcaaattttttatcaccacttataatacaattggtagatcgatgcagcaataaaaattgggctcgcgcaggaagttacacttaactagtttattatcattttctcttcctttgtttaaatatctttttcctaaattaattatccgatttatgatccggtcataccattgtattcgtttaattaaatatttacaacaaaatatcgtatgattatattttaacaagagaaaaatgtgtgtttcaaatcgttaaaactcaatgttttatatatgataaagatatgtttcagcatgtgcctttatcatgtttcacaaaattcatgcaactaactacaactactatctctcctcaccatccatgtatacatgcatccatttagcgatcttcaaaattatgttcttctaaactatttatctaatctacgatatgcgtgattatattctgatgaaaaaaacaaatatgtttcaatttataacactcaatgtttcatatgtgatagtgacatgtttcaacgtgtctctactgtgtt

SEQ ID NO: 48352 - DNA, 525 bp, Oryza sativa
cataatttaggcacacgcgccgtaccgctgctgtaattagttctcaacgtttctcaggtttttttttacctaattagttctcagtgtctcagtttgttcatgtggatatacatttacttattttgttgagagaaagacatgcatgcatccatctcaacattcatgcattttagtatatcaattgcatgcttatgtcttctcaattctgttgttgctccattcctctctctaatattatctcctttttttccttttcgtttttttcacattttgttatgggatggtatggtggtgaaaaaggttgaaaaagaaaaaggcatgtggattccctacgcacatgcatgagctttccgacacacatgttgtcggcgtgccatacgtgttcacacggcgatacatacatttcgcgcattagacctcccccaattttggggcatttcaacaaataagacaccatatattatttggatttatgattggaagtgtaaattgagtcgttcttccgtctgggagaggcaggcggca

SEQ ID NO: 48353 - DNA, 1501 bp, Oryza sativa
gagagagagagatatcctacagtccataccgcaaaagttggactccaacaagctttgttggcccgctaccttttcatgcatggccattctttcttgcattctcattagcttttacactgtcaatcgcatctccatgaggccacaagtccataaatcatccaagaagctatctattaatatgtttttgaattctcattaaatttttgtgtcgatcaactgttaatgatgtaacaaaaaccgttaacgatacaagagaatttagacgtgtttttctacaatttagacttgtataggtcgaatttgaacttagcttaaatccatatgtccatagagaaatatatcacatatattaattcattttgctattttttttaaaaaaatatcatagctatttgaatgacctgcgagcaggcttggaaatttcggactgaaatttctgagatttcggtcatttcggacccctctgatacgatattatttcggccaaaatatttcaatttttttattttttttcatgaattttggtaatatttgtccaaattcaactaaaattattcaaaatttcggtatttcggtgacatccgatcaaatcgactaaaccgaaaagtttaaccctacttgcgagaaatgagaaaacaaaaaaaagggaactattctaaactctcaaggggatgttccatcattatttgcatgccacttaaatagttaaaaaaataagaaaatgtattaacatgtgatatatcactccacaaacatgcaacttaaaattcactttacatgtcacaccgaaaaaacaatatgcctgtgaatatgtgttaactagttgtagtttaatttaattttttgttgcgacacgtagaagttgaatttaagatgcatatttgtggagtgatatatcagatgctaatacatcttctcaaaaagaattatttttttgttaactctttgagtgtaatgtaagcaacgaggggatatctctcgactattcgagagtttataatccacttcacttcaaaaaaaaatctcacttttcatgtctcggtagatcttgcaggttatatatgcttgttcttagttaaaccatatcgaatatacgagatagatagatctcagtagtagtgaagagcaggcgcgcgcaaaaaacagatttgaaatagtttactccagtagaagaaaaaaaaagaggtttggggatgcgcaaaagttaagtagagacggttccagatcatcgttaagtaaagcaaagtagataaagaaagtaaaaaagcaaaagcaaattaaagcagagcgctatagtaggttgcagaggcgcaagtagctaggtaggtcgatgtcgatatatggaggccggagcacacaagaagaggaggctggatcagatgggagctatatatgttaattatattatagctagctgaatttgcaagcacgtactacattgttagatttgatcgatcggtgagcatgtatagccggcgggcagcggcgggaggagagcagc

SEQ ID NO: 48354 - DNA, 1501 bp, Oryza sativa
ggagaaagaaagcagaggccctgggctagcatggccttgaacagaaggaaggcctgggtcattctgctgcacagcacaaagcctccgataagtgcgctccaggtgacctcgttcctggcaggcatggcatcgaacaccctgcgagcatagagcaggctcccgcactttgcgtacatatccaggagcgcggtgccgaggagcaccccgtccgtcagcttgctcttgctgttgcggttggggtggaggcaggcacgaatgcagtaggcgtggacgctggtgccctgggcgagcgccccctgctgggcaaggagcggaaggagcgccacgagggtggaggcgttgggcctgagccgatgcatctgcatctgcatgctgaggaggtgagcaaccgcgtggtggtacatgccatggtgcgcgtagccggcaagcatggcgttccaggcgacgagatccctggcgggcatggtggcgaagatgtgggcggcgtcgggtaggcaagcgcacttgacgtacatgtcgaggagggcggtggagacgaaaaggtcggcctggaggcccgcgtggatggcgtggcggtggatggcgcggccgcagtggtggtcggccagcgcagagcaggccttgagggcgaaggggaaggtgtagttgttaggggcgacgcggtggcggagcatacggcggtataggtggaggccatccgcagcggcggtcggtgaggaggaggagtaggctcggatgaggtcgttgtaggtgcgaacgtccgggctggggatttgatcgaacaggtggtgagcgcgggagaggtggccgctggcgatgtggtcctgtagctggaggaggagcgacgccgacgccgacgccgacgctcgaggaggttgcagtggaggtggatggaggcaggcggtggtggaggagaggcgacgagcagcatggtggcgccaatggaagtggaacgagggcggcatttgtggtggcggcgcagaagcagaagcagcagcagcaagagaacggtgacgcatcgcgcccgctactcctcgctgccggcgggacctaccctacataacgccgaccaaacgccgccgcgaggaaagattggtttggcggcggggcgatctggcgccggatgaggtcgggcggcgctggtgcgcatttgcacgagcagctggtgtacgtgcgctgccgggccggagtggagtggaggaggaggggagctgggttgctgggccgcgagaagaggatggcccggcctagcgaagacgatggcctgctgggccagtgtgttttcagccgggaataagtccatctccaactataagatttgtttcttggtctacatcgtctatgtgacaataaaagaagggaaaaccaactcaatagacatatatcagtcgacccctctctctttatctctgtagcgttggatgacaaaagcgggcacctccttatttttacatacgggtcttctcttagcagttagaaaaaataaagatgtttctatata

SEQ ID NO: 48355 - DNA, 468 bp, Oryza sativa
tgtgtgtacagaacggcgcaatagcagaggcgatccacacttggaaaagcaattttgacaaggagtttgagggggtggaggaatgcccaatctgttacagcattctgcacacgagcaaccacagccttccccggctggcttgcaagacgtgcaggcataagtttcatggtgcttgcctctacaagtggttctcaacatccaacaaatcaacgtgtcccttgtgccaaactcctttctagtccggctgtgctgcgctatgcctattttttttttgcaccgtagaaatttaaatttatactccgtagttattatgttttgtcttacaaatttaatgaaggttagataaaaatatgtagttcatgtgtctccgttgtcccgtaattcaaaatgcgataattatcacctgtagcttagtaataagttgtctatcaaactcctgaaacacgtgtgctgctgatatggtttagt

SEQ ID NO: 48356 - DNA, 519 bp, Oryza sativa
gagcggaagcggaaaacatctaataccatgaaaaactgagtcaacacgataattgttttaatcacaaccatgagtacataggcatgtacatccttatttacaatcgacctgtagaaacaaaatcgagaatcaaataaaaccggtaatagataagattataaaaccatatctctaatcgtgatctattcatttatatacgtatttctttctgaggtgttggattcttttagaccggtataggttggatttgaaccaagattgaggaataattacatgaaaaattattaatatcaaagtatgtcatttaggggaatatcaaagcatgttttagtttgatatactccctccatctatacttttaatagtcatatttctaaatctgaaaaatttatttttgataggcatatttcaatccaacaacctattatcttaatgattttctcagatttaatgcatgactctccatttttccacacaagattggttacatgggcatcgagaaatatatatatatatata

SEQ ID NO: 48357 - DNA, 1501 bp, Oryza sativa
ttttttatttttagcatcccgggatggctaccacgtaatttcttttacaacatgctccctggttgggcagttggaaccggtagcatgcggttcaagtttggtacctcccaccccatgtgtctggtctccccctacatgcatgccacgcatgcactagcaattttgcaaagggtagctttatctatatgtattttcaaattcattatatatagggagaaaaaaagacaaaattctaaaagatttatattgaaaaactatctaaattttatctttttaacgactaaaatacaatgaatttgagattaagattttacacataagtgtgatgctattttaagtacttgtacaatttttcctagattttttttgataaagtttgttactccctctgtttcaggttataagatgtgttgactttaatcaaagtcaaactgttttatagacaaatatagtaatatttacattaccaaattagctttattaaattaatattaaataatttttataataaatttatcttgggtcaaaaatattattatttttatccaaaaacttggtcaaacttaaaatcaaagtcaaaacatcttataatctgaaacggagggatttgttcgttcgggttgggtacccacctcctccgcacgaaaaacggaacgatccattagcacgtgattaattaagtattagcaaaaaaaattttcaaaaatggaaccgttctccctcttcttttttccatctatgtataaggtcaatataattttttaagcaacttttgtatacaatctttttgccaaaaacacaccatttagtagtttgaaaaagcgtgcgcgcagaatacaatggagaggggttgagaacacagagcaaagagtatagcgaactacaacatccaaaacatcaatagccaatttaatagtaaattcatataatagttatttactatactattaatatctaatatctagtcccgcattccatacgctcgttacgtcttatagtccgtgctgcagctggctacagattcatagcccactgcccttctctctccctttttatatctttaaaatattaaattcatataatagttatttactatactattaatatctaatatctagtcccgcattccatacgctcattacgtcttatagtccgtgctgcagctggctacagattcatagcccactgcccttctctctccctttttatctctttaaaatatatttatagctcatagcccactgctctcctctctccctttttatctctttaaaatatatttactgcccttctctctccctttttatctctttaaaatatatttatagctcatagcccactgctctcctctctccctttttatctctttaaaatatatttatagctggcttatagcctgctattgtacctgctctaatggagtacacgaaaaagctggtgtgcgtctagttacccaataggcacggcatactaaaccatatcagcagcacacgtgtttcag

SEQ ID NO: 48358 - DNA, 1501 bp, Oryza sativa
attttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatttgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtattggctgcttccctccgcgattgtatcgtacaatatctgttcctcatcgcggtcagccatctattgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaatgtattaggataaatgcgaa

SEQ ID NO: 48359 - DNA, 1501 bp, Oryza sativa
caggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaatgaccgacgtgacgggtctgacaccggtcatgtcgtcagcagacagccacgattccacgtcgcacctgctcccggcgaaagtggaggtagttgtgggccgtctcatcagaagatgactcggacggcaactatacaaatctccgtccatttatgaaaaggtggggtaagtccccacaaaaaagagagaaatggtgcatgtggtatccccttaagatataaaaggaggacctagcccactgagagaggggactgatttttccagatagggaacccagaacaagggagcggctggctcatactttgtagctccttcatacacagatctcccaaaacacaggagtagggtattacgcttctcagcggcccgaacctgtatacatcgcccgtgtcttgtgtgtttcctgtctcgcgaaccttccacatacagagagcttagaatctcaccctgagtccccggccgaaccggcaaaggggggcctacgcggtctcccggtgaggagccccacgctccgtcaatatgttacttcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaataga

SEQ ID NO: 48360 - DNA, 334 bp, Oryza sativa
tatggctttcttatatgcttatgttcatttttttgatgtgagtcaaatatatcatctgaatatgtatgctttttaatctgtgtcgaaataacttataagtacaataaatagtgctaatgtattgaggtgtgatatctcagtttgatctgtcctcatattagactaaatttcctcactattgaatctttactgttggttaggttaattaagctttgaactaaaagaaaagcaaagtcttgccctcagcagatcatactataatgccttttatctcccttgctgaactttagcttagttggcctctttgtctattgtccattttcctctctacaga

SEQ ID NO: 48361 - DNA, 221 bp, Oryza sativa
tgtagaggagaagagatccagggaagggagagaaactgtgtgtagtgtagccaaagggagccaacaaccggtctcgttccatcgaatccgaccgacggaggcgacccaacccagcaaagacacgatcgaatcgaatagagtacattctctacaggggaggggagcgagcgagcaaggaagaagaagaagaggcatcggcatcgcgtcgggaaggcccccca

SEQ ID NO: 48362 - DNA, 450 bp, Oryza sativa
aacttccaaagcggttagtgcacccatcttatctaattaccatgtatttttttgttctgcattaatgctggagaattttcctgatttcctttggtgctagcaaatgttttatttttatttgaattttgaggtcccaagatacatgtattagaaaagaaatctggacaaccagtactatctgcctctatcgtattccagcttgagtgaattgttctgacttcacagttttaatagtttcctttcgtgcattcaggattcacaatttattttctttagatagcctcatatcatattatgctctttcttattgttcagtatatatccctacttttaatctcttagctatttatttgcccatcaatcaaataacgtttattcttcatagcttataagtgtcctaaattttgatggttgatttgaaggactcattcccacctaaaatgtttcagg

SEQ ID NO: 48363 - DNA, 1501 bp, Oryza sativa
aattgcgtgatacgggtaagataatactagtcgtcagatagttgagaaaaatcaatacttagagtaaattgcatccatggtgcatcaacttggtatgtgggtgtaatttggtacaataacttaaaaaatgagcgttctagtgcaacaacttggtaggtaggtgcaatttagtttaagaactttgtaagtgatagtataaatgcaacaacttgcaaggtagatatgattttgatacaataaattaaaaagttatacggcaacttaattatttggagtattttttatataaattcaatttttaagtacttattttgacaatatagtagcgcggatttgtataagtatatttatatttttatcctaataaataataattgaaagtcaattaaagtggatgtaaaaattattatatttcggttgatatttgagaaggtgaagaaaaaaaaaatcttaaaggtaattggatataaattgtactagaacgcacccatttgtcaagttattgtactcagacgttcaattcccaagttcttgcactataccgcacccacctgtcaagttgttgtactgtaggtgcaatttacactaatacttaatattggagtcgtagatgttgtttaagtcgtggaaaaagaaaattcagaaaaatatcatggaaaggaaaatctgtgggaggggaggggaggggacgaggggacagagaccaaaccaaagcaccatgggctgcccccgtcgccgtcatcaattcatcatattctttctttctaactggagtacactagtgctaacactcttaagactaggggataggagtaataaagtacaagtagtagttgctgttgctaattataatccatactaataatcaaacgacctcccctcccttctccttctccttcttcttcttcttcttgttgcaggtcacatgggatagatagatactccttcctccttccccctctcttccaatcctaatcctaatcctaaagaaagaagttggagaaatctcacggcggaatcaatcccacgcgattcgtcgtcgatctggccacggcactccgcttctctcttctcctctactccagcacagcagtatgagtatgaattaggataggagggagggagggagaggaatagcatagcagcagcctgcaggcggaggaattccgcccgatttgatttggatttgggattcttctctttcgttttcgtgtgttttttttttctttgttactacccttcaattcctccctttatttggggccaagccaaagccaaagcaatcaaccccgatttcacgccgcaagattctcttccttctcatgcaccgcctcttaatttcttcttctttcttggggccagaccccaacccccaatcccttgaccaccaagctcctgcttcttgcaatcttgatcgatagtctcctccatcttcttcgtcaagcctctcctccttggatctttcttactacctaggtttcctggtgcaagtgcaacatgg

SEQ ID NO: 48364 - DNA, 382 bp, Oryza sativa
catgttagtggcccaatcatgttcaactctctcgacatcggtaattgaggcggtggtggtcttgctagagcggccgtggccgttggcgggcgctggtgcctcctttggacatcacccgcacttgtccttgcacgtcgcagtggcccaatatcatctggcccaataatagcccacacaaccctaggctgcgctagtgtcgtcggtccccatcccattcggccaccgatcccaatctcaatctgacgccgccgccggcatccctgactcaccgacgcggctgcaccaggcgccgccgccgccgcctccgccttgatcgtaaggaagtaagtttggagcaccatggctctgcgatcggcggccggtaggctggcgtcgtccagcc

SEQ ID NO: 48365 - DNA, 826 bp, Oryza sativa
attgtaaggattgatgaatgagaagtagttggatcagtcttataaaagacgcataactattgttttcctatctccatagagataagctgatcaatatctccatagagagaagctgattgtaagaattaatggattcctatctccatagagataagctgattgtaaggattgatgaatgaaaaatagttggatcagtgttataaaagacaactaattgtaagaattgatgtatgaaaagtagttggatcagttttataaaacacgcataactgttgttttcctatctccatagagataacctgattgtgagaattgatggattcctatctccatagagataagctgattgtaagaattgagaagtagttggatcagtgttataaaaggcgggaaaagatggttggaggaagatgatagtaaggattactattgttttcctatctcagataagctgattgtaaggattgatggatgagaagtagttggatcggtgttataaaagacgcataactattgttttccaagctgattgtaaggattggtgtatgagaagtagttggatcagtcttataaaagacataactattattttcctggttagataagtgttataaaagacgttcttatccccgtagagataagctgattgtaaggtttgatagatgagtagtagttggatcagcgttataaaagatgggaaatagtggttggagagagggttgatggatgaaacgtggttggatcagtgttataaaagatgaaaaacggtggtgaaatggaatgagtaccgttaagcgattaatcgaattacggataattaatcagg

SEQ ID NO: 48366 - DNA, 1501 bp, Oryza sativa
gggatattgtcatcttcctcttctagcattgcatactgcacttggtcagggaaagctgtcgcgatggtatggtttgctttgtgcagttcccctgaaatgatgtcataccggtcagctagacccctgtacgccctgtatacttcttccacttgagtgatcacctccggccgccttttgtagtacatctctgccctttttgaaaaggaatcagcttcctctccaaggagtaagagcatgcacttcactctgtgttccatatctgcatatatatccacaagaccatttcatgggatcagaaacacaaatttctatgatgattttacagcagataagatttcacatacattattggtttcatagcttcaaaaaggccctaattatgtcacgggtatcaacattattttgttttgctagcaagtataactgcaacagaaactgctgaaaacacaggaataaagctcccaaacaggagaaacagtttcctgatatgacaatattctaaagtaaatttaatatatttttaaggcgattgttttccatctagatgtataatgtttctttgtcccctttatcaggttgcatcatatcaattgtacgcatatgcattcacctcagttctggaggttcaggaatttacacattcgatttggtccaaattgatcctcagtcccattcccataagcaatacatgtttaatcttcagatcaacaagcctaagctgattatgattgtgcagatttacccagaaaagtgaagaggttatgtgtattaatttagagatgtgagatctcgtgctactccaaataagaatatctgtagcctcatatcaagaatcacatggatggaaggcttagaataatttcgttattctccccattgaagaacttctaggattgaacaaaccaacaaatctcccatataagtacatacataactcacagaaatcaaatatatgataaaaaagatcaagattatatattggacggtcaccttggagatggctatcaagccatttggactgcttggtgcggatgtggctcgcccaccaccatgaatacgcattgctcgccgcccgctgcagcatcctgcctcctctgtctcttcctccttcaccttctccaaaatccaaagcattagtctttcctgtgcatgaaaactaacacacgagaacagagaagtggcaaatgaaaagagcaagaaaggaggagggaggagatgccattgagaggctcatagccaagtccattcaatggctaaatatagttaagatggtgagaggttaaaggaaaggagaacacacagcagatgcacaaacatgtacataatagaattgcttaaatgcagataggaaaaataataactgcgctgaaatggcagatcaaatgagacaacaggcacacaatactgctacctagctgtgccccacgatggaatggaatagggttctacttctaaattacttgctatattctttcagaaagaagagcgacatttcatattg

SEQ ID NO: 48367 - DNA, 174 bp, Oryza sativa
gacttgcctgtgttgatctgcttgtattagaaccgtagaacttggcatggtgtactttatgaggttactaatggttttgaaaataactacagatattagtgcaagtgcatggtgtaaattccttcgtccggatgcatgcacatgcctctgaagttcttaattgtttattatagg

SEQ ID NO: 48368 - DNA, 1501 bp, Oryza sativa
ttgtgggtggtacttcctccatatgtgcagctctgccgaatcctttttttttgggtgcaaaatcgaaaaatgttcctgaatagtagtactcatccatttaaatgttagtgatggaacagattgaagcattagctgaagaaattcaacctctgctttctgaggttcgtgatagtgatctggtgaaggatgtcgagattatagctaaaggtctggctgatgcatccggtgatttaaggtacttctggaaagcattgtggcctaatacatattatttatacaactatgagttataacatcttgcttgaggtaagtcatgataagtaatgatataaattggagaatttgatataaaccatcaagctatgactttcttattatgaaagagtctacaagattatactagtattcaaatagacctctctaaatatacactgcatcatattatataatgtaccaaagataaatgtgatgataaacttttcttgtgctaccctgcagaaggctgaagtcttccatgcttacccctgagaacaccgatcttattaagcagtctattttcacccttatctttactctgaagaatattgaggtttgcatatatatactcttttaactttctttaggtcagttttggttatttctcagtcagatcatcagactgaaatgtatttgctgtacccgtccttggttacttcgcagagtatcagctcagacatctctggtttcaccggtgacgacgcgacaaggcggaacatcaagctgcttatcaagtcacttagcagactgttgtgattgctcaggaataacacgggggagctttctccattgggaagcgctgatacaggaatttgctattagtgtagcatttcttgaaaaaaggaagaaaatgagaggaaagcgcaggttgagaatgagattagaaagaggtcatttggagagaggggaaccaagtttttgaatagtggaattatagtctctggttttgttttccaagtttcctgcattcccggatattattaaaacaagaaaagcacggggaaatgtgtaaatctccgttagttgtgtagggcatcttcttaatttgtttttgttttttttttttgggaggcagtgtaggccggtttttgtttgatattgtgatgtttcattcttgtgcccttgcgcaaaggtaaccagcaaggaatgcataaatacatgaaaactttgttgtcgaggtgaaccatcttgttgtgtatgggagtcccatgtgttgcgtattactcctacttgtgtgcccagaaacagaaagaattgcgtgggatatggactatgcgagagagagagagagagagagagagagagagtgcagaggaagggaattgaagaggtaagcgatcccgggcggaaggtgtgcagtgcatgccggagttggcgactgcttcaacttaattggctggctatattatttgtgattgtatacacaatagaagacgacgagatcgatcgagcaacgaacagcata

SEQ ID NO: 48369 - DNA, 197 bp, Oryza sativa
aaaaacaggcagtgtttcagcttccaagagaaggcaagccaagttttactatagataggatgggcccccacccaaaaagagagagaaggagaagtggtgcatgtggtatccccttgagatataaaaggaggaccttgcccacttaagagagggggctggaaggggggatgatctggagaggagatcccacgagaaaa

SEQ ID NO: 48370 - DNA, 979 bp, Oryza sativa
ttcctgcagccctggtagtgtatgtagcagtttcctccttaaaacttaagtgtttttcccggtacttgggaggcaccaataggtactgataccacctaatgttaatcttttaaacctcttggcacctcccaagaatccttaggaactcaagataaaaaagttaacttataaaagtttgcagaagggaatcagttttttttagacgtatgagtaacattataatgcttattgattattttgctgttccatgttattgattgctgctcataaagtttgaatttagaatggtcaaacctcctcccgagcttgcagtttctgtttgtcaagctagtacttttttttttctgttgttagatgattcctaattatattctttctttcttttttaagtggtggccatattttgtcagtagcatttggcagcaacatacctgctcggttgattagcttattttgcagttaaaattagattcttacagccaatattctggcatataagaactactgagaaggatttggatgaagaatcatgaagatacagctaatcgtaaccaatctaaaaatttttcaagttcaacttttgttttaaataaaaatgaaattagctaattttgtttctcctcgcccttattaactgcttaaagtcagttacctctgtggtgccctgtggaatgagctgtttaaacaaactagtattattgagttctatcctctctgatctgtagtttcctcatgcagatgtgtgatatgttgttttctcaattatgtctgagactgccatcttcaaatgtgatgcatatgggtgggcttcaatcccttggtcaactttttggttgtacaactaagaacatcgagagccatctggaaactcttgcgtcgcatcaaaatgttggaaacaagaacttttgcaggagtgagacattgcaagacataagcgtaaatcaaactgctcaaaccactttactctccgagacatcaa

SEQ ID NO: 48371 - DNA, 1501 bp, Oryza sativa
tcccgaagggagtcgccgcgtaaggcaccagctttggtctcctattcagcattggctttaaaccctagatctatccccgaatcaaatactgatttgagaagcgggtcgtttttgacaatcggaaccctgtgaaatccacatattttggactcggacagagactgttaataaattgtccaatccaacaatctcaagcacagtgttactgctagtccagggactccggacgtagcaagcaagcacataagaatcccgttttgcagaaatagaacacggaatgcgtttccaagaacaagacagatgtgggagcaaaagtaaggaaggaacttccattagccaaggaatgcaaggagtacaaagctaggaccaataccaccccaccactatcagatctaacggcagcattacatacagcagaagaagaagaaacccgattcagactctactctactctactctactctactctactctactcggcggcggcgacggccttcttgggggacttggcggtggcggggttcttctttggcgacttggcctccttgttggccttctccgcggccctctttgggaggagcaccaggttgatgttgggcagcactccgccatgggcgatggtcacccccagacagcagcttctcgagctcctcgttgttgcggatgaccaaggagatggcggcgtggacgacaagaagggatgaggcagaagcaatccaactggtcgggagaaacgagacgattccatagctcgttttaatgggataaatgtccaccagcaaataaccaaaatttcatggctccatcggtaggcctaatgagcaaaagcaaatttgaatttttaatcttaatttgaaattaatttaaatatattttcaacgtagtttttttatatttgacttttaacttgctaagaataaatagggccaatcacgaaattggaaaaatcatcgtatgtgtcattgaagccccacatatcattgtcacgtataatggtatcttgcaactcatgtatatttgtgatggtatttcccaaatctttcttaataaatatataaaagttttacgtataaattaatttatattttataataaaccgttttggtttaagaggtggacaacattttagatgtacgatatcaaattttgaaaaagaaaaaaaaggaaagggtcagaaggaatacattcatgtgattgggcttcagctccaccaagcggctggccccatctgtaagggaggatatcagaggcggagggactggaggagacggcggcggtggcttaggaggcggcggcgcttcgatcagtcggcgaaggaagagaagaccagcgagattatttatttttgtactacatttgcgattattattgtatacatcccggatcctggatcccgctggctttagaaattagaaatgacgacgacggaatcctcaacagatccaacaacaacaactagtctcagtcatgccgcctctcttctccgcgccggcgctccacc

SEQ ID NO: 48372 - DNA, 1501 bp, Oryza sativa
acggcgcagtacagtagaacaagtaagaaaatgtggtgaagtgaagtggggagtgtagggtatggtgactagtacagtgtataggaataggaggttggttggtgcaaataaacctggtgttcatcttggacatttccagataaggaggcaccatcacaatacctgatcttgaccttgttccagttgtaaaaatctgcatcactatgtatgtgtgaagtgaagtactccaatagcaagtagtagtaagtagaagtgcaaagaggtgagagagagcgattggatttgacctgggttctgggccttgtcgtcgctcaggatgccgacgaactcgacccgggtttccatgtaagcagatgagccaagactggttttcttgcgatgatcacaggacgtgcgattcctgcaccagctcccgccctctaggtggaggagccatttgttagatccgtcgccgaagcctggcagccagtggtacccaggcggggtcccgtcgaggcagacagcgcccttctccttggcgccgtggactagggtgaggtcgacgagcgtggggaggcggtggccgtaggacggggaaggggaaggggtgccgagcgagcgggggtgtacgaggaggaggaagaggagggcgacggcgaggagcacaagggcgaatgcggcggcgtggcggagaaggcggcggcggtggagcgccggcgcggagaagagaggcggcatgactgagactagttgttgttgttggatctgttgaggattccgtcgtcgtcatttctaatttctaaagccagcgggatccaggatccgggatgtatacaataataatcgcaaatgtagtacaaaaataaataatctcgctggtcttctcttccttcgccgactgatcgaagcgccgccgcctcctaagccaccgccgccgtctcctccagtccctccgcctctgatatcctcccttacagatggggccagccgcttggtggagctgaagcccaatcacatgaatgtattccttctgaccctttccttttttttctttttcaaaatttgatatcgtacatctaaaatgttgtccacctcttaaaccaaaacggtttattataaaatataaattaatttatacgtaaaacttttatatatttattaagaaagatttgggaaataccatcacaaatatacatgagttgcaagataccattatacgtgacaatgatatgtggggcttcaatgacacatacgatgatttttccaatttcgtgattggccctatttattcttagcaagttaaaagtcaaatataaaaaaactacgttgaaaatatatttaaattaatttcaaattaagattaaaaattcaaatttgcttttgctcattaggcctaccgatggagccatgaaattttggttatttgctggtggacatttatcccattaaaacgagctatggaatcgtctcgtttctcccgaccagttggattgcttctgcctcatcccttcttgtcgtccac

SEQ ID NO: 48373 - DNA, 344 bp, Oryza sativa
tacataacatgatgaagactacttggcttcaaccatcatgctctcaacacatattacaacgcatatgtaacaattccatcaaaggaatatcgacacacgagcaaatgctatcgtcatatatattttgcacctgtgtttcggaattattctcatcccattactctgtcaagtccaaacagcggcttcagaagtatagagccggtggtcagggatttctgaattgaacaaatagaactagataagcattcatgtgctcgaggaagtcatataactgcagcatgtgttcctgatgccgctcatgcacatgttctaagcctgctctttgccatctgctgctctccaga

SEQ ID NO: 48374 - DNA, 1161 bp, Oryza sativa
tttatcacggctgttcaagaacaactgatgggattcatcaacgaagaagttcttaatcccgatggtgaattctactacgacggatcaacaattcataacgtcggtccttcctcttctgtcataacgccggcgtcgaagtcgtagctatagctaccgagcaaatgaattgtactatatatgcatgtatatatatatttatatatgtacaaatttactttagtgttaatatatattttggtaacatatatgcacataaaatgttaagtgctttaaattatacatatgtgtgtaatatatgatttatacatatacacatatgcatatatacatatatatatatgcttatatattatgcatatatatgtattgtaacatatgtgtgtgtgtgtgtgtgtgtgtgtgtgtgtgtgtatatatatatatatatatatatatatatatatatatatatatataatcaaccatgcaacaaacagggctatgcaaataaaaaaaatggtgcaccgatctttcgtcccggttatttcatccgggactaaagatagctatctttagtcccggattcgtagggggttaccaaccgggactacaaacggtttctccaccagtggatccaaaatgcatgtaaatatttatggagaaaagaaaggataaaacaacaagtacgttgaagcttaatttgagtgaaaacatataccgcactaatacatttttctttttacaatgaggcaggcagaggccataggcagctgaggacccaggcccaaatgcctgcatgctttgctaacttaactctccatactaatttccgtttctaactctcacatgcaaatctttcccgggaattaatccatcacagtgaaggattagtgctatgtgccagagaactttgcattgaagcccaagcagctgcccgtgctacccgggaggtgaatgcgcgactgtgaggctatccacaatgcacaatatcttatagcgttgtagtacgaaatgttcgtgattatgggatttagaaggacctccattccatctccatttgcctggtgcctccaattccgataagcagaagtacacacatacatagttgttccaatccaactgtatggagggctccgtatggtagggtaggccacctggcccagcgctagggcatcttgaata

SEQ ID NO: 48375 - DNA, 635 bp, Oryza sativa
caccaaccgggactaaagatattagaggggtttgacatcacctaccgggactaaagatcaaaaagtagctctaaccttttcaaccggggctaaagataatctttagtcccggtttttattgcaaccgggactattgtggaatttggtcgaccgaccaaagatggtttctccaccagtgtaattagtcaagatttgtattgattagacataattattttatttcattgttatttagtgttgattagacacaattaacatattttattactaattattctttttattttcattctatccaaacttatccatccaaccaaacaaaaaactgcgatcatctcatccacacaaccaatggaaagaacgggacaaccatattttcaaaaaaatagatatatccaaccttgatgatgaaccaacaaaccttaaactttccaacagacccaatactggcaccgcaggttgccattgccgtctctcgtttcgtcctggttcttctcattcccaacctctctcctatgatcggttgtattgtttcctaggagagcatggcatccatgatagcttatgttaactattctcaccttgtgtttggttgtccgattgacatggctttttattggtagtgaactcagata

SEQ ID NO: 48376 - DNA, 190 bp, Oryza sativa
ctttaaagccatgatttgaggttttttcggacggagggagtatgcttgtatggtacatagtctggagagcagcagatggcaaagagcaggcttagaacatgtgcatgagcggcatcaggaacacatgctgcagttatatgacttcctcgagcacatgaatgcttatctagttctatttgttcaattcaga

SEQ ID NO: 48377 - DNA, 1501 bp, Oryza sativa
  unsure (1)..(1501): unsure at all n locations
ctccatcgccttgctacagggtgtgctcttctgttaccggttcacattgtgctatgagcagaaaaggctggtggatttggtggttaacaaatatcgctttgttactagtttgagcgagtcagtgatggcgtacatgcaagagacgatgatcgggtgtgagaaggacccgtcattcgtcaaaggaaggaacctggtcacatatgccgtcggtttaaccaagtctggatcccctgatggcttcctctctggggtgaggatcctggactccctcctgaatacgccaatgtacaagtacaatttctttctcgaggttgaggtcgaggtcgaagagcagaaagcaatggtaaagcagctcctcctacggcatcctacagccaagatggcggcctgcacacactgctgcagtcacttgattgtacgagggcatacaatgccgaggcgagggagcacgctgcaaggatcgtggcgcaccttgctggtgacctccacctggagcagtttccacaagggatccattgcacagcttttctgctcgaaggtccccctacggattgtgatggcaacatccctgttaattacgaagaactgatgtgccaggccttgagtatcttcatgaagctcgttgcacacgaggaactgtcagnnnnnatcaacaagacggagggcctgctagccaagatcatggcgcctttgcggttcggcctgctcaaccacaacgatgaccctaatagtgcgtggttcagaacagtgcatggtttgatggttgtgattgtccgggttgtgtatgttctgtggtcagactggctaggaagtctgccgcaatatctcaggatactgtggaacgccatggatagtatggagaggattctaggttgccaaggatgtgggctgggatcgttccatcatagttccctgtttatgcaagcattggacatttacacatgaatgcaagagcgcatgctttctaacatagtgatggggaatatttcattgagaaattgttactcatcttcactcacagagtttataaggaggccaacatcatttttgggttggcagtggtaggtgaaaagcttgcgacgctatgttcccatggcaaagcaaatgccaagttaatcttacaagtgaaagatgatgccgttggtgatctcacaaaaatacttggtccaaacaaatttcccagggatacaaaataacccccggccaaatcctcgaacaactgggtgttcatcacactggtaagaagaaatttatccagaccctcaaggaacccttaaaggttaaaagtccaaaggtttagtctggtttgaggcaagaaaagaaacacttgctttatttttatcagcatcatatatagggtgataattagtctttgtgttggatcgttacgcttgtcatactgagataaacataatgttgcaggtgcttgtgaacacttcgtgccgaatctgtggacagacaaatgctggcggcagttttatctctgattgtgacgatgaca

SEQ ID NO: 48378 - DNA, 397 bp, Oryza sativa
cggtgctttgctatggattaaagaaaatgtattaatgtgttacccatctttttctaaacgaaatattcatcttaatctaattttatgtggctatccattagattggatccttttaatattaaggagttcaaggggtaatttgtaaaaacttactgtaataagagtaggcggagtccaccacaactgtcttcttttaaatgagcacaaatatgcaaaataaaagtttatgctatctaaagtgtacttttaacatctcaaactgaaaaagaaaaaaaagtgcaaaaacccattgccacaaaagaagggatcaaacccaaaaccaatcgacaattacgagccaacagagtcatagattactcaaaacacgtcatggattactcaaaaacactccacttgt

SEQ ID NO: 48379 - DNA, 541 bp, Oryza sativa
agtaatacagtgacagacgcaggaatttctccagccaaatcaaagtctcatggggttgtttcgatcaatagaattctattctgaaatgaaattattaggatttggttcgagtgatagtgattgcttcttcctaaaattccgagccgaattatatatacgttctagacagagggaaaaagtctcttatttttatttttcgtgtgtttttcaaactattaaatggtaatgccttttttaaaaaaattctatagaaaagttgtttaaaaatcatatcatccatttttcaagtttaaaatagttaatactcaattaatcgcacgttaatagcttgtctcgttttacgtatctcctcgattttctcgttttctgttttttcaaacactctgcatccacatgaatatcatttcagaacaacacatccacatgacgaatcaaatcatatattcttgtgaacacgtaaaagaattgcacgtcaatatattagcaggaaaagagtttttgttacacaaagtaatcagctagactggcttatgcctaaagg

SEQ ID NO: 48380 - DNA, 1501 bp, Oryza sativa
tcccgaatatttctgagaaaaaattgaatgaatagtatattttcaaatttaattcacaacatagatacatgtaagcattattgaggcatctcccatattcaaacatgtcctaccttttgttttcttaggcctctcctaattaataggagattcattttcattaaagagtgagatacatagccggtacttaaacttgcagagtaatattatttaggtccgtgaacttgaaaattacacatttagatccgtgaacttggtttaatgtaccactcccggtctaatcgttatttgaccacgtttgacccccaacatagcatgccacgtaggcaacacttttgtactcagccccctccaaatatacattcgcacataaattgccttgaccagtgcatttcaacctaaatcccccaaaatattcctaaatcggctaaggttttgacggtgaggttagtgaaaggaagccgagaggtagcggctgtggtggccttggcggtgagattagcagcaagaggcagcgcagtgcagcaaggttagtggtggcacagtgcggccggattagcggtgggaggtagcgcaatgcagtttgcacgataggcattcccatggattctccaagctcgtcctcgtcttgaaatcgccggaagaaggtgttgttgattgcccgttgtgcaaggataaggtcattttggagcatagagcaaatgacaattgctaatcgggaccacattttctatacatgcaaggagaagaatgaaagggaagaacgatttgagaaatttttttaggattctgatgtcactatatagctaaaaggagatatatgcgacgtgttgtgatgtggagggggctaagagcaaaagtgttgactacgtgacatgccatgttagcggtcaaccataggtaaatgacgtttggactgggggtgatacattaaaccaggttcacggatctaaacgtgcaattttcaagttcacggacctaagtgataccaccatacaaatttagggactgaccatatatttcactcttcattaaatatggtgttatgtcaacatttttatgatgtggtaaggaattaatggagatagaaatgaaatgagtttcatctagattaaaccatatatacattatttccaatatgactcgtctatgcatgtgttgcctatgaaatagcaaaaatgaaacaatacattgtgtgagttattttaaccatcaattaaatttcttaaatatcttgtttatatgtcacttgaaaacatactaatgaagcctccagtctgcaaggaatggccttactgatatataggtacatgtaaatctcgaggagctattgaagggtgtcatctaccatagagatgggctggtagtcaaatggtgacatcttcttgagttattgcttatgtcctggaagcatttaatttattttgttttttagccaaataataagtgcagcgagaattagtgaaatggaaaacagttgtatcaggtctgccctttgttc

SEQ ID NO: 48381 - DNA, 1501 bp, Oryza sativa
gtaaatgacgtttggactgggggtgatacattaaaccaggttcacggatctaaacgtgcaattttcaagttcacggacctaagtgataccaccatacaaatttagggactgaccatatatttcactcttcattaaatatggtgttatgtcaacatttttatgatgtggtaaggaattaatggagatagaaatgaaatgagtttcatctagattaaaccatatatacattatttccaatatgactcgtctatgcatgtgttgcctatgaaatagcaaaaatgaaacaatacattgtgtgagttattttaaccatcaattaaatttcttaaatatcttgtttatatgtcacttgaaaacatactaatgaagcctccagtctgcaaggaatggccttactgatatataggtacatgtaaatctcgaggagctattgaagggtgtcatctaccatagagatgggctggtagtcaaatggtgacatcttcttgagttattgcttatgtcctggaagcatttaatttattttgttttttagccaaataataagtgcagcgagaattagtgaaatggaaaacagttgtatcaggtctgccctttgttcttcttatatatagggggagagaagtaccagggaaccacattccctttctcaaagatggaagcaacatctctagatcttcgcttcatcttggttcttgttctacttctgaatccaacatttgcaggtgcaagggtggatccacacagagctcaagtggtgcacaccacacagggtaagttctgaaaaattcattagcatttgatcatgttatcacataaataaagtagcatatgtgtgattaagaggtacttgtgtatgatacctggtaatttggattctacatttgcccctagacaggtgagttctttctcgactattttttgacgttattggtataccttttcttgtcatgtagcctctatctaaaaaaaaaagacttgatttctggctaagcatagaggcaagtaaatagccagaagtcaaatcttttttagagagagggagtatgttgtgtcttgcaatgtttgttgtgatttactctgtttataactagtgctttgtgcatattcaacagtgaaattatagatcagattccttctccatgcaagttctgaatggtgatagtctgattgatgataagcattataacaagtggtagttaatctcttttttttcacagaggattgtattattgacattggctgggtagtgttctgcaccaaaaggttctgcaaatttagttgctggggtgaaggtcttataaagaaggggaaagtccgagactattggtgcagtgattttcacggctgcaactgcttgatttgccgtggcatctaaaaaagcaggggctgttttgttaaccgtatatagtactaaaaggtgtatcatcatgcttaattatgcatgggaatagtcaataataagtcagttgcttcatgttctactgctatatgatttgat

SEQ ID NO: 48382 - DNA, 1501 bp, Oryza sativa
tatgttgcgagctatatacgacaccacaagaacttcttaacactcttaggcgttgtttagttcgcgaaaagaaaatctttagggtgtcacatcggccgtttgaccgaatggtggaagggattttcgaacacgaatgaaaaaattaatttcataactcgcctggaaaccacgagacgaatttattaagcctaattaatccgtcattagcaaatatttaccgcagcaccacatgatcaaatcatgacgcaattagactcaaaagatcgtctcgcaatttacatgcaaattatacaattagttttttttcgtccatatttaatgtttcatatatatatctaaacatttgatgtgtctaaacatttaatgtaacagaatttttagaagtttgaagagaactgaacacagcctaaataaagccttattttgcaacagatgtgcgtccgtctagttactcgtctactacttttgtttgtttttctttcctgaccagctgagctcagcaccccgtaatactgtagaatactgtagtattgtagcgttatcatgggccggccattttgggcctagatgggcctgttgtgatacgtgggctgctctttatatctacgtttaaccttttgttattttgatgagaaatttgcatatatgccatccatagaaattggctttgctagaataccatcacttaaattggatttgatcaaatgccactctcaactagggtgtattcgctggaatgccatcttaagaccattttgtccttaggcttcttcttcctcccatcaatgtaggaaaaactcgcccatggccatcgcaagctatggccgctaacagctgttcgcgtgcccccgttgtcttcttgctcgtggcagtgttgacacaaaatttgtcgtacacacgaaggcctcaatgattttcttagctctggtgcagatcctatcaatccggtttagggcgtgacaattaatttgattctacaactaacaagaaaaaaaataaaaaggttagatcatgggggccaatcggccaaagggtcgatataataccatgtgccaactgaatcctgaataaacttgccaaccgaatcatctataattacgacgttaattcattatttgactcggtcttgactaaaggtaattgcctaattttttgattgggctcttaatccagtggcacggtgattgggcccaattacaggtattttgttgggtttatgggtccaatattccataggcttggttatgaatataatttttcctcccctttatgtttatttcttctcaactttggtagttttgtcatatacatccaaatatacatcaacactcataaaaattattagaaataaaccctaccactattctggatgttttatactttcatatttatgcaggtatttgatagtgtaaaattggtatttaacaaccgtcaacaaccgcctcgccggacgccggccgctcggccggttgccggcttggcggcttgccgctgccgcagg

SEQ ID NO: 48383 - DNA, 470 bp, Oryza sativa
aatcggagggataagttgagtcggatgaattccgcatgaaaattaattaatctgaatgaaattaatagaatgacgcatcagcataaacaaattcagcatgaacattcgctattgaaatttttggacagaattatcctgagttttcaaaaacattggccacttgtagacatgttcactactaaaaaatggccaagggggccggttcttaaagggccataggtgtcggttttccacctggcacctatgggtcagcattgatactagcaaccggcacctataaaaaaaataaatcggcacctttagcattgctcgagccaaaaaaaaaaagagctggctcgtaccaagccgaactcactaagtgctatcagtgtgcatgcgcccatcccaaaatcaaatcccaaaccccaaaatcatccacatatcgtccccaatataaattgacatcacagaatgaacatattcaacaacaa

SEQ ID NO: 48384 - DNA, 565 bp, Oryza sativa
cgctcctagtagtatctctatataattcatagatttttcttttgttttgtaaggagtactccctccatttcatattataaattgttttaacttttttgggtttaaccaagtttatagaaatattagcaacatctataataccagattagttttattaaatgtagcattgtatgtattttgataatatgttgttttgtgttgaaaatattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcacccattaccataaccatattttttctcaga

SEQ ID NO: 48385 - DNA, 508 bp, Oryza sativa
tttgtgcacccctggattcaactcccatgggagcgattttttcaagatttaacggctttgtgctttcaggggtaggtaacgtatccgtcgacagcgaggcgcctgtgatgactttgtccactccaggatgaattggccggcccagtcttcaaaaatgctcatagggatagggtttgcgtgcgtgcgatcataggggtgattgtgcgtgcgttgtgagtgtctgttttgtaccatgtaattctaaaaaaaaaccatcaacaagatccaagtgaaaaccgaagagaaaaaatgaaacactaaaaaaacccattaaaacacttcgatctaactaatgaaacatccaaaccatttttgttcactggcatcgagtttcgcaagcaggcgtgctaagacagccgctagcaaaaataccatttttgcaggtggcaaactaaagaggatagccaatgaaaacatgttttgggataaaaaaaatttgaaattcgagatgtcatcgtatgagggtagg

SEQ ID NO: 48386 - DNA, 206 bp, Oryza sativa
caaaactaatttaatgttcttgattatgtaattttttttataaatttggtcaaatttaaagaactttgactaaaagaaaagtcaaagccttataatatagtatgaaatggaggagtacttcctagtatcatgcaagaattgtttgttttctccatcgacaatagttctaattgctactccatattttgttttctccattcacaaca

SEQ ID NO: 48387 - DNA, 313 bp, Oryza sativa
tagtcactagtaacgacattaattgttataaagaagctgtcatatttagtcatgtcagtgagatatcagctaggagtaccaagattaatgtttcccaggaaagaactttaaaatcctgctgcaacgggtacgtaggacatccagtaccaatagtagtgaagcgattgtcaccttaatttagagtctatttgaggaatttaaaattttaaaaagcagctgattggtaaccattttctgagaatctgaagaagctggtatccaagtttctaacttctagtttattttttaatttttacaactataatttcgcaga

SEQ ID NO: 48388 - DNA, 550 bp, Oryza sativa
caatcattaaaccggcacctttagcattgctcgaaccaaaaaaaaaacagagagccggctcgaatggagccgacctcactgagcaccatcgccatgcgcccaaatcaaattaaaatcctcaagtcacccacaaatctccaccaaaattgattgacatcacaaacatactccaataaaatcattcacaaatccaccaaaacatctaaaaaaatcttgtgccggcggcccaaggcttatctacttcgtctgtttcatcgccggcgggccatgttgtgcctcccctcccgccggatcgggcggaggggagcgcgccgctgcccgccgtcgcccgccgcctaccctcccgccggatcgggcggaggggagcgcgccgctgcccgccgcctcccctcccgccggatcggacggaggggagcgcgccactgcccgccgttgcccgccgcctcccctcccgccggatccggcggaggggagggcgccgtcgcctcccatctcgccgccgctgacgcctctgccaggacgctgccccaccgctgtcgcgcgctacaga

SEQ ID NO: 48389 - DNA, 274 bp, Oryza sativa
acgtttgagtacatatgttgcgttttagttttagttccatatattttagcagatctgtagcacacagcacatatgtgtagatccagagcatagaatataaaaatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 48390 - DNA, 1501 bp, Oryza sativa
tagtagtattagctgcatggttgatgccctgaatggttcagtagacagagatgggctcatgatgtttagagaacttatctttttattaaatttatactacaaccaagtaattgtcttccacggaaagatgatgcgtgctctctcacaatagtccaattttagacaaccggtaaacagaacaagttacttatattggattagttgttgaaacattggaatggctatcacggctaaagttacccgttactttctgtttatgttacctaatgttgaaacataggaattaacgagatcttttacggtgcttgaaaggtccctcccatacctcttgtagaaatgagtatccaccgttgattacagaagaatctcgaagggtagattggtaacaaacaatgacacaaatacaggtagtaattgtttacagaaaaaatcgttggtcgttagatacctttatgatcaactagttttgcgttataactccaaagagatggcaaagagatcctggagtgttctttactctgcatcgcttgcttatgccatcagatgttgcatccatgccgtcgttcatttggtcaatcacgagtatttctggttgacttgctgtttttaccatacagaggctacacgattgtggggatgatgcagaattactcttcttagtagatgatgccttctagttccatttgacaacgacaaattaaatctctcatgcacactcttcagatgatcagattcgatctattagtcaatttacatcacatttttgttccgcgtcaattgttgcagccaaaaaccacacaaatcgaacaaatggtcattcaaccagacgataaaataatgattcaatgaaaattaccgtaacagatgaactaatttgccctaaaactaaggaggacataatgggaagccgattgctattctaaccttccactttcgtacccgatccacaactttaagtaccctctcactagtacctttaatcacagttcgctagattctatttgatcaatgcctcttatacataccaagcaacgtagaaagccactactttcaattcaaactacctgtcgaaacaatatttcagcaatataaaggggtagcgtacgagatctaaaagtggatggatgcggagacaaaggatttaaacaggttcaggctctttcaatgagaggtaataccctattactatttgagaatttgaatccgccaagtgtattgtagatccgacgatcaggggtgtcaatatccccctagaaggtctcctgcccaccttatataggatggaggtaggattacaacatagaaaccataaccaatacggtatcggtatcctaaatttactttacaatattatcaaatcaggactttaggccgttctataatatacaaggtaacgtaatacccaagtcatgatccgttatatattctatagatacaagctatcccctataactagtcggataaccataccgtgtaggtatggggtacctatagatggcca

SEQ ID NO: 48391 - DNA, 500 bp, Oryza sativa
acatagtaggcttaggtgtgttatatatatactagtttgtacctctttccaacttctactctctcgtttttcacgtgcacactttttgaaatgttaaatattgtgtttatttcaaaaatattctataataacaaaaggttatatttttaagttttttagctaataattagttagccatgccaactgctctattttacgtgaagggaaaatttttgaaccgctactatatattgaacacatccttaaaagacattgagaactttagattcacattatatgttacagttactattgtaattgtaatgttttttcttcaattaatgccccaacagctctagctagggcgctaggtggcggatcgtctgatattgcgcccaacagcaactcactagaatgctttagcttttgagaaggaaacaaataggtggaacactactcccagtggatgatcccgaagtattggcattagataatgtaacagctttgttgtgatctctaga

SEQ ID NO: 48392 - DNA, 1114 bp, Oryza sativa
ctaaaagaatagattcatctcattctatgaaacttctttttagataatgaaaagattctcagccttagcttcaaacaagctacaaccacttattactgaatggggaacataaaaaaaaatcaaaagactagacaataactaatgatatcaacacaaaatatagaagacatttattcaaatttatttgtaaatctccatccgatgttggcaaatatctgcatgaccattatttctagcttctggtacgtagtatatattagttccttgtcctcatcacacctttacacctttatagttgtggtcaaaattggagcagtacattatcctgaatagtacctgtatataagatttcattagggatttgttaaaaaccatatcatttctacttagccaaagaacccgacatatagtagatgctactagtagaatgtgtttctttgttttttagtcaaagtgtacaagccaattcccagaaacatgagaagtactatttggaggtttcaaaccaaaagaaatatgtaatgatctccacaggaatctagcaaacaatggcactcaaaaaaataaatgatgtatagtttcactcttcattaaaaaacaacatctcatattgtcattccaattcattcattattgctaaattatccttcgttaatattactcctttgaactgataccacataaaaatctttattttaagagatatttttaatttccataaagttttgttgcaacggtacaagagcttggtaggtgtgtgtgatttagtataagaacttgaaaaatgagtacacgggtacatgaacttgacaatcaagtgcattttagtcaaaaacactaatatatacctttgattaattctggtattataatagatcattggctcatggattcaattttgtgttttaccatgttcataacctgagacaatgaatatgttgattagtcgaattgctcggaaattatattatttgcatgcatttacttttgaatttcggtttcaaatcgatagattattttgttattataactatccaattaaaaacaatacattatagctatctgatagggcatgaaactcagaaaccctggccatcaaacttaatttttcgga

SEQ ID NO: 48393 - DNA, 303 bp, Oryza sativa
tattgccttttcgagtagggtgtctgtttagtcttttgcacttttgttgggctcggatttagctatttgattagggagtccctagccttttgcacctttttttttgtctggtcggccaaccaaattttattaagaagaagagagggttacaaggtttacgagttcgacattaggccgtcgagtcaggcaacaattcaattggctgcagccccaaagaaaaaaaaagactaacagctaatcacattgcctaaaagttctagcctccttccatactatgataacctctctgatgtctcaaatagc

SEQ ID NO: 48394 - DNA, 210 bp, Oryza sativa
caacgtggtgtagcgttgatcagtggagattcattattactttaattactcaacagttttactgttttgctcaataaaatgttttacaactgcctttatgcaaatagcctcaaacccctccttgtatccccttgcacgtctgcatcgttggtgtggcttgctgagtacggtggttgtactcagccttgctattattccccctttttcaga

SEQ ID NO: 48395 - DNA, 248 bp, Oryza sativa
tcaattaataatacattttctagaaattaaattaaagttaaatcaactcaatcaagtgaattattgagggaattaaaaatttcctttaaaaatcattggccgggaatattttgtaatattctttgtgccctaatgtactctccggaattttccgtgaattttcggagctcgagaaatagttttaatagcacaaagatcattgcatcaattaaaataaaaagaaaacaattaaaatcccccttcctctc

SEQ ID NO: 48396 - DNA, 178 bp, Oryza sativa
  unsure (1)..(178): unsure at all n locations
ggcccacctgtcgggcccgtctccctcctcccgccgatctcgcgctcgcgccgccgcgccgaaaccatttttttgcccacgtncccgccttccccgggccacgtcgaccacgcccgcgcgtgcgccgcgtctccagcgcccactcccctctatctcccactcgcgcccgcgcccgaga

SEQ ID NO: 48397 - DNA, 1501 bp, Oryza sativa
  unsure (1)..(1501): unsure at all n locations
gccggagccaacgcccatccaaccaccgccgccgccgccgccacccgccggccacgtctccctgacctgcggccgtgtcggtgtcgccattgcctccttggccatcgccggcggcgcctgtgcacggaacacgtacggacacgccatgacccggctcaccgtcgtctccggctcgccgtcagggcggttcaccggtcggcttttcccgtcaccggcaagggaagccatgcaaaggtggcgccatcagctagtacgacgagccaccacgcaatggttttttgtctttgctgtttctaagcaaaatctttgcagaagcttgaagctatcagtgagcccacaagagtacggcttactaaggtcaagtgtaaaatggaaaaggttggtgagtgagatcgagtgatcgcgccagtttcgatggattcggaattatgggggaataaagatgagatggtggggttacttttttttttgtgtgtgtttttgggtttgaataagaacaggagtcttggtgaagattcctgggatttttctcacgaaactgcatgtgtttgtgctgctctcctgtaacctgtcgagttatttagttttcagggtgatctgcattggaattcatgtctttttctttcatgtttcagaactaaaaggaaggtttatctgtagtatcacattttttttgtgataaatgagagtggaagaaattcgactttcatataatatcttaatagaattccatgtaatgatcaatgcattttttggattctatccttttgtcgaagtggaatcgtagaacagaatgtgatacgatgagataaaatgcaatagaaacaaggatagcgaacgggttacctactcctaagggtcaaagcaagccctttgattcaattctttattcttacattaaagaatgaatcaaatctccccaagtnnnnnnnnnnnnnnnnnnnnnnnnnnnnnnnnnnnnnnnnnnnnnnnnnnnnnnnctgaggaataagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtctaattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtt

SEQ ID NO: 48398 - DNA, 366 bp, Oryza sativa
aaataattattatcatcttgtagtttggatcatcctaataaatataatgcatgtatccaatagaattagataacatgagagtggaggatttaaaaaagtaataatttaatggagaagatgctatagttaattgcatgcttgcatgcatgccttttattatgtaacatctaagaaaagtggttgtgtcttatattatggaacggagggagtatcgttagaagcttgagaagtgtgcctataatccataagctacttaaagagcttgaaaaacacatatcactaattatacactcaccaattaatcttatggatgtaagcaaacggcgtagcccataaatctactaaagagcatattctgtctctaga

SEQ ID NO: 48399 - DNA, 393 bp, Oryza sativa
attgatatgctttaaagaaaatttaacccagtcattggtaggggtggaatgggtctcccatgggttctttcacaaccctacctagcccacatatatcttttaggtcaaaaatgtatagaaactcagctcaccgcattttagacccagcccttattttttgtactctaaaaaattgggccattatcacccctagtcactggcaaacattcacaaccatcaatcgacaatcgcgataaataacacataattgagcacacggtgagagacatacttgtgttttagtttactcaagaagaatgttgcaaatggcagatcaacaagtatgccctcatagattgcctggagtcataaattaaacagacaagcacacatcagatcatagtccaaatatca

SEQ ID NO: 48400 - DNA, 152 bp, Oryza sativa
acaggctcccatttacttcttccaatgatttctattcacaacaagcaactagtgaaaattttgtctctcaggtggtgatcttcaatgctgtttaattaattcaaatagctttaagcagcatattttctcttaacactgtttacatgttttgc

SEQ ID NO: 48401 - DNA, 344 bp, Oryza sativa
ttgttgctttatgtcaacagtctgcatgcacgatcaattcttttttcatcttaaaattatttatgatgcatgcagttctttgattggccatacatgtatgaacatggaactaatattattttatttttctcgcaaaataattttatactatttattttttataactttttttaatataatgtatattatgattaaaattcatatgcaatcttcttgaatatgccaagagccatccctttcccacttcgttctggatgttcatttgtggatacttgaattcttaaaatgcacattaaattattttgattatgaatatcttacatatattttatttccaaaccagg

SEQ ID NO: 48402 - DNA, 1010 bp, Oryza sativa
tcatcttcatccggatccaatacaatagttgatcccatcggtgtagaaattgacttgcaatccgccatcttgaagcgccttaaaagatccttggtgtacttcatttgatgcacaaacgtaccttgctttatttgcttgatttgaagtcccaaaaagtaagtcaactctcccatcatactcatttaaaattccctgcgcatagtctcagcaaactccacaaccaaagggtgagatgaacaaccaaagatgatatcatccacataaatctgaacaaaaagttgatcatcaccatgcttaagaacaaagagagttttatctacttttcccattgtaaaacctttatcaagcaaaaaatttttcaatctatcataccatgcccttggagcttgtttcaaaccatacaaagcttttgacaaacgaaaaacattgttgggaaaatcagaattttcaaaaccgggtgattgttttacataaacttcctcctgcatataaccattaagaaaatcacttttcacatccatttgaaacaatttaaaaccttttggagcagaaaaagccaacaaaagtctaattgcttcaattctagaaacatgagcaaaggtttcatcataatccaacccctccatttgagtaaaaccctgagcaacaagcctagccttatttctcacaatcaaaccatcctcattttgtttgtttttgaaaacccatttagttccaatgatattatgaccaataggaggttcaactaaagaccaaactttgtttctttcaaaattctctagttcttcatgcatggcatttgtcacgcccataaattctcgaaccaaaatttctaagctgaatgtgcattaaatccctgtccaggaccagccagggtacataaacgacaattgttgacatacagacccacgtcttacaaaaatataaaagattacaaatgcagcgggaaagataaaagcgagctaaaccgagaagcttgacttcaacagtgggcgactccactccacagg

SEQ ID NO: 48403 - DNA, 1501 bp, Oryza sativa
catatcaatcaagcatataagacataaagtagctaaatcaggtaagatcggctgaaactccgatactatctctctcaacaatcataaaacaagctagatattataattatggatattactcaatagatcgaacccaaccgatgcagcattaaacataaagataagtataagatctagacaagatgatgaaaatctctaagagatggtagacacacgatataatctagattaataatgaaacataactctatcgactactttctaatagtaagaaccagccgatgacaagttatatagcgcaactaacagagattacaaagcgtatgtgataactcgacgaattacataaacaagattagagtattataaagatggaagcactaatcccaagaacgcaagccgtcatgacaagtttacctctagttgaatatcggaatcgatgcagctcaacccgaaagcaagaactcgtcgaaatagaacgaaagtgaaaagggtggcgatacgccgaaagtgttattgaactgttgttgtaaattacatgggttcgggtgatatttatatgcgagatacatgatatgtccttgccggacacgactcttatctctaacaaactctaagatacacataagtctttgctgcagactcttgcccaaacatatctccaaggaaactattcaaaatatcctaattaatcgatacaattgcctatatgagagcttatctccatcatggcaatccttgtgtagcacgtcgaagcagtttcataactgaccccggcaaaatcgtccttatcgggtgtatcggccatatcgactatcctctatccgatcgatctcagccgatgaaatacccagccgatgccttcgcagccgatgcacactctgttctttgaatctaactctttgccaaatccactatgattccaatgccgaacctggttcatatcttaccaaatttggtcgtcaacacatgccccccaagtccactatattggtaatgttgcggattttctcaatcacctgctctgactataactagggtttcccactccgattctgttttggccgttaccgcgctttcttttaaatagtaaccaccggcgtcagcttccgttttaaccgccctagcaaaaaaactttccccaatctcttcctcgagctcttcagcgacctaaaggcgattccctgcagcgccccctccgttgccaacaatgtcgagctccgccgatccctcgagcgcgccaaccgctgagtatgttgaggtaagtaccatcggctatatcccccttttttccgtactgaatcggttcttccttcgctcaatcttcgattttcctcttctatagcatctctctcatcaagttgcagttcccaacataaccgatgagcattagtttttccttggcccaatcggcaatctagaccccactgagttcataaatggtgaaaccaatcggacaccctttagatttgccaaccccgacttaaccctttggaagaac

SEQ ID NO: 48404 - DNA, 285 bp, Oryza sativa
ttaaaattatttctagagctctgaaaattccactaaaaatcatgttaatgaatttcgacctgtagaactcaagaaaaagtcccacatgtcaaatccgattattatttgcattactttcttagggttttctcctgatttgcaccggtattttcttagggtcatttataaattacaattttggcttgggagggaaacttcgtggtgtgacactagtcctcctctttcgtttgccccttttcccgagctctctagtgcgccgtagagtcgccgccgcgtcgctttagc

SEQ ID NO: 48405 - DNA, 1501 bp, Oryza sativa
ttctagatcgtctcctccagtgatcggaaggcccatggaggtttcgtcgcggtcacgtcgataagctgcagactgcacagctaaagtgcttttccagagtctgcattacagtaaatgagaaggagagggcgggagaaatatccagcttcccgccctcgacccagcctataaactggctactcatccctacctctcttcttgctccaattcgtaaaagccaccatagtgtagtgctcatcctccatccacccaagtccatcgttccgcccacagctccacaccatcaaccatggtccaaccccccgccgccgttgtccaagcccagccggtttcggaggtcgaggcgggagatcccgtcctggtccgggatttcttcaggcttctttctctggggtcggaggcatccgttccgcgagacggtgtcgtctgctgttacatggacgtatccgctctgttcctgtactacaggaacatgagcggcgttctggtgctggtgccgcatgtccgtccgatgtgcgacgccccgctgatggtgcagcagctccagaagatggagatgcggtcggattgggaaatcccaaatctggccgccctcaaggacgtcgcgaccgcctcagatgctcttgggcgcatgggcaagatgatgctgcaggcgcgccgcgtcctcaagactctgaagaattacccggatggcgaggagggattggagatactcttctacaacactcttctgggggaggcgctcaccagggcgcgcgaggccataccagccgtgataacctccgctgacctgctcgtgttcgacaacggggaggtgcggctgatggcgctctccctcgctcaccaagcgatgagcaccgtcgaggcttgcctcggtgctgtccacgagggaaagggcttgactgggcgtgagatgcaccgcctcgttaagaaggtccttcgcccgctgagctacctcaggaaggtgaaggtcatcgacctcccaaggttcaacccctttgacgtctgagttctgtcttggatttatctttatcctgcaatccagctagttttttttcttttgaggggaactaagaagtggaaacaagaaatgtttgagctagtatgtttgcctttcatgtctcgttctattttagttgtgatcctgagttattgttatcaagagtgcaagatcttctgatatttatcgacctatctcaatggaaactttattattatgtgcctgcattgtgatcctctttgttatactttgtttgaagtatgaatgctgaatgcattttaattatgccaatgtgctgaccctcttttctatgaaagagaaattgcatcaatgatcaatttatattagttccttgttaataactgttctgttatcccctattctaaaaaaaaaatcaactgttctgttatatcttgtggattggccaatgatgagatgttatttgcaagcactccgataatttgaagtgcaatagcgcaaaatgttgtgagtcctggaact

SEQ ID NO: 48406 - DNA, 1189 bp, Oryza sativa
gggatcacctgggagattgaaaaagatatgcaaaatattgtacttcgaagaaaaatgagaacatcttcagataagctatatatttgttatgcgtgacagtgcattatagtatatattaggtgtatcacgcacttggaagaattcttgaccatgagatggaaaacctgtatgcatccattcccatctccttcatcatgtgcacatcttcctgcaatttttcaggatgtgagtactgaactagtccttccaatgaaacttagaattgatctctgaagcgatcgcgccataggcagactgacatgtggtatatcttttatctgatagaaacaaagaaactaacagaaacatggagtgcatatttattgaaagtccttacaaaatgcctgttaaaaaatgcccaggacggctacttaaaaatggtaattgctaataccttgtagagatggtaggtgttgtcagccacatccccgttgcttttgtcagcgattttatctgccatattagataatggtcaattcaaaataatgccttattgctttttcattcttgtcatttacagttaaacatgcctggatgctgatatgtgaaggtgtcccagatgcttggtcctctgcccccctctgctgctccaccctcgcactgcatgtgtgaagcaacggccgattcttcaggtttcagacccgaaacagttaattgaccactgaatgcttattggatgtttagatttttttttgctggaatgaccgaaggaggtcattcaatataattaagataagaagaaaaggttacaagaaaagttttacatcgacggctggctgttgaggaaggatgtgcaccagagtacacgccctgaaccatgtgccaaccgcccaaacacacgctacagtgagggaagccaagcaccgaaccggccatcgctatgtgagaccgatcgccactggaccaacaacaccacgacgacacgaagactctaaaacgaagccctcacgagggtcacgacgccgaaagacgccgtcatcatccgtccaaagaactggacaatgttttcacccagagctccttaggagggatacctcaacaatgccctcaggagggttaccacgcccgaagacgtagtcactgttggcccaaagaattgggctaagctttcgctcggaaaccccctaccgctgtggtccgttgcccaatc

SEQ ID NO: 48407 - DNA, 1501 bp, Oryza sativa
agaataaatgataaattgtctcatttttcataaaaaacaacatctcatattaccattctagccaagttatccttcggtaacactactcctttaagcagataccatataaagatcttaattttaagagacatattgagtttccatatgatccatttctttaagtataaccattattgattaaaactaagtacatagatcgaatcgagaattgaccattttgattaaggttctatcgaaaaacgtcattttcttctgtcaaataaatatgaacaattgaagcacacaagttgtgcctatatatttatcatattctggcctactaatgttcttctaaaagaaacattgagcgaaacacaactcataacatttgcaatcaaagaatttctcctacgaactatagaatacaaagacaggtacctatccttaaaggaagtattgtctatcaatttatccttccaattctgacttgttcaacattattaactatccaggatgccatatttaagaaactattcttaactttttatgagacccgacaaaaagggaatcaccttgttttctctcaacttgatttattgattgattaataaaacattttatttccaaagtacgtttttaatagtattttagtaaggttaaagattcgtcactatccccatctctttaatcttatatggcccatgtatatgtacggtgtgcacatgtcttccatgtaattacattgttttttttttttggctgtagggttttgaagtaatgaagtgaaaaaggaggagtaaattttactttgcgtcgcctttcattttggatgtttcaatttgaatactctttaatcaatatttttacttaaaaaaataaaacattggtaataaaaatgtgacctcaagtaaaatttaattaaaaaagagagagaaagaaatagtgaatataatcaactcctctctgttggatctcaagaaagagttgggcgcgagagcaccgacgacccaacaacacaagacgaagcgagcgacgagacgacctaaccccaaagcgaaaaaagttgctgcatccttagcgcgcaagcgaaagcgagagggagctcgcgcgcgcgcgagggatcgatggatcgaccccaggtgatgcccctcattcagcgctcaccctttctcctcgatccgagctcttgtgttgtttttctttttttctaggattttgatcgatctcccttaggagggagggagggagggagcttgtcccagatccagcggtttcttggattagggttcatgggggttctctccgctcggatccaggttaggaggtggttcgttttggattgggttctagaatgacccttggtttggttgatggtggcgggaggggattcttgatcacgcgcggcgggatctgagctgacagaaatcaagatttttcgttttcttttaggacaacttgtgccaattctgcttttcatttcagatctggttgtaatctgaagagacaataatctgacaccata

SEQ ID NO: 48408 - DNA, 1501 bp, Oryza sativa
ggaccccgggcatgtccgccggtctccaggcgaagacgtcggcgtttgcccacaggaaggagacaagcgcgtcttcctatttgccgtccagaagaccaccgattcgtgtggtcttggacgggccgtcgcccagggcaacctccttgaccgggacctcgtcgcacgtgatcatccgctgcctcggggcggctaggacggaggtactgagcctctcgttgccaccctcgggcttggacgcggcggcgaggtggtccgcgcgctgctccatacaagcaagcgcgactttgaggttgccatggacagagatggggccaccggggcccggcatcttcatctggaggtaggtgtagtggaccgccgtcatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccgaagcaccatccccggggccttgatggcgtcaaaggctgcgggggaaaggatgttgagggctgcacccccgtctatgaggacacgccccaacttcacgttgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgctgccagaagctctcgcttcatggccttgaggctctgacgagaagcgtgagcgcacgctcccccatcgacgatggcgatagtggccccaggctcctggaaccctaggtcatcgtcgccatcgtcgatgtcctcggcgggggccttctgcttggcctcacttcgccggttgccggagggagccgccggggccttgccctcacggcgttcctgcctcctctcctcctcccacttcctcgtccgctcagccaaacttttgaccgcgcggcagtccgcgaggtcatggagggaggtgttgtgcacggcgcaccacttgccggtcgggcgctccctgctgggagcgccggcctcctttttgtcgctcgcaggcctcccctttcgggtggcccgcgaagcgccctcgacggcgaggacgtgaccctcgtcgtcggaatgggccgacctctttttcctcctcctgtcccgccgccctgaccgagcggcggatccgggggcggccgaagctgccacaccggaaccggtggagttccaggtccaggcctcctccttgcgagccacacggtccgcgagctgaaaaagctctgcggtggtctggggctccttggaggcgatcttttcgagcatgcggttgtgccgcacgccccccctgaacgcgtagattaccgcgtgtgcggggatgcatggtatggtgttgcggacttgacagaaccgctgaatgtacgagcgaag

SEQ ID NO: 48409 - DNA, 1501 bp, Oryza sativa
gcaagtcacgtgcatagtaagaaggaacaaatctagcccgcatgacccgtttcaaagcatcccaagtttgtggcatgttattaggatttttcttgccatgttctatccaccaaaccgaagcaaaatcggtgaactcactcgtagcagctctaactctagtgttctcaggaaactcatggcatgcaaatttttggtcaacagcaatctcccaagagaggtacgcatcaggatcatattttccatcaaaaggaggaattttaaatttaattttagaaaaagcatcatcattgttgcgtacctcgcgtcggcggcgaccacccatacctcgtcgattgttgtgtagccgtcgacgatctcgagcatctcgatcatcttgttcagtgtcagcaatatattcatcctccaaattatcctcgacgtactctccgtcaatgtcatcatcattacccccaccattgcctccagcattgagagcatcaaaatgcctcacaagagcagcaaggctagtgtcaatgcgggcgaccgctatctccagccctgtaagcttagtgttggtggagatctgcgtggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctagacctgccatggtttagaaatgaaggacaacaaaacaatggaggatgtaatgtaaaccctacacaactattgggatgtagcttttgcaagacgctcactctcacttcactcgcagcttgtctcacaagctcttaccagttcttaccttgcccacaggagggggacagcaacccacaagttagcaaccgtggaacgaggtgtatcggtgctgtagcaacaagacctgtcaagctgtagtcgggtttgtagtggagctgttggtgggctgaaagcaatgctcaagagaaaactagaaaccacgttagccaaagcaaattgaataatcgctcaagggtatagtgtacagtgctggtcctaggctagttgaagtagagacgcgagcctaaccacaaaggacgccacaaaacacaaacccaaacagcaacgaaaacaagaaccggtggtggaaggtggtgacaaagggggaatggtggggtgtgctcgctggatccttttttttttttgcttgctctctctagtgctgaggagagagacacaactttttttttcttttgatatttttttcacaaccaggagcacactagaaccaaccacagaaaatcttatctcaaacggacaaagtatgaagcttgtagaatttttttcaaagttctatgcgaataggtcccgaagcttctcgccacaaaaacagaattttgcaagaggaatttggcgattttaaatttgccgaacccggatgtaactttttttgtagatgtccgtggatatattataagcctaatttcga

SEQ ID NO: 48410 - DNA, 1501 bp, Oryza sativa
aatcacattgcctacatgtatgaatatgatcaacgagaaggtgattaaattatttcttggtttctatgttaggagtgattgagccttatatttaggatatgaggagtataacggtggctctatttttttttctctcatatctttcttaattaacttttgtatgagagccgacccttctcattatttattctctttcctccataggtgtttgtagacggtttagagtttactactccttccgtttcaggttataagacgttttgactttgatcaaagtcaaactactttaaatatgactaagtttatgcacaaatataataatatttataataccaaattagtatcattaaatcaataattgaatatatctttataataattttgtgctgagttaaaaattttattattttttctacaaacttagtcaaacttaaagcagtttgacttaacctgaaacggagggagtagtagagcaagtttaatagtataggcaactactagctccaattcatctatagccaatctaatagctcattcatacaatagttacatactacactattgatacttggcccacctgtcatacacacactatatcttgaagtccgtgctacagctggttacaaatctgtagccgctgctcttctatcttctcatttatcttcttaaaatatgtttgcagctgacttatagtctgctattgtactgctctaatagcacgtattttatttattgtaaaagaatacaacccaaaattaatggaaaaaaaataatattgtactcatcagcgtgccatgcggggcaagttgggtttaccaacgacgcacacgacaggtcaacccaccgtttgctgacgtgtacaatcctccggtgcatcgcctgactcaaaaggcaaaaaggacttcccacgtggcgccaccccattcgctaccgccacccgttccccgtccccgattggtccacgtcatcaccttccacgtctcccccccaaccccaccacaacgccctcgggtttcttctagaagcttttaaaccgcgagtgagagagagagagagggagaaaagacgagacgactccgactcgacggcggcggcgacgcggaggcgaggcatcgccggcgagcgcgcggaaggaggaggaggaggaggcacaccctctcgcctgaccctagatccgcgacccacccgcggggagaccctaggcgcccttggccgctcggtgagagggcggcgcgggaggggacggcgatggcggcgccgcggtggatagggccgctgcttcttctgctgctgcacttcgtggcggccgtcgcggggtagggtttccgatcagctcagctctccctctcccgcttcgtgtgaacttctcttcttttttatccctcctcatgatctgatccagtttatctcccaatcgcaatgggctctccttttttaactttttattattaaatcagcttgagatctgtatgtatcatgttggtgcgcattctgttgagga

SEQ ID NO: 48411 - DNA, 324 bp, Oryza sativa
gttgcgatgaagcctggtatgaatatgccgggactgacgtgctaactccaggagtcagcacgacggctccggctagggacgagtgcctagaggctctcatcattccgacgggacggggcgaggcgtgcaaaaggccgcctgttgccacctaacccgcgatctgaccggtctgtgaccggtcacacactgtgacctgtcacggaccgaacgagtgtgctgcgctgcattaaatgcggcgtggggcgctcgtctaacccgcaataaacgcggttaggtgagcgccgctgtgctcacctaatccacacacatggcgccaaacccaca

SEQ ID NO: 48412 - DNA, 257 bp, Oryza sativa
aaaaatattgtccacgtcatcatgcatatcaattgaaatacccaatatttcaatgccaaaagcctttggagttcccttccccattttcttgtgaatattgtttactgtgatttgttgaaggacaagatttaacccttgttgcatcgacaccatccacattagtgttcccttcatatagtattttcagctaaaacatcctagtgttatttgccatgaaaaaagtgctaaagttactgactgtgaagaactattgcaga

SEQ ID NO: 48413 - DNA, 1501 bp, Oryza sativa
tgtacacatgtctgtcaaagcaagaatgggaaatatattaatggagaatgattacatggtgcgttacgggcatgttcatataacatggtaggagtatagaagtaagaagatgcatgatgctccgttcaaaaaaaagaagatgcacatgtacatcgagactatcaactaaattaatttattttattttttatgtttgtgtctttgtagctagagaggtctagtacgcgagcaaagatcctgtcttttgttctttgttcaggccatgcatcatcattttgtcgctacgtccacattcagtagtgtgtggtaggacgtacgtacatatacgagactacgactacgtcgtcgatctaacactagaataatataatcgtcacgatggttactaattggttaattaactgcttcggctgtacttctgatgctacgatgtcactttaatttactaccttactttaccgactcattatgcattcttcgtaggtgacgtttcatattatttttacttattttctatttttatctgtctttggccaataataagatgcctaaagcaaagtacccatcttgtttaatttcctttgtttaatactggaaattaataagcaactgtagctctcttttttaatcttaagcaacatagagttttttttaagactcaagttattaatatttattaaggatagagttcatgggaaataatttcagtgcagtgcatcgtccgggtagaaaatcttatagcaaaggaccatccttacataaggtaagggaaaatgaactgcgagaacaaccttgcaaatgaaaccatacatcagttactgctgcgacaataagttctcagttttctagctgagaactaacataactagtttgcaagcggtgccataatataataacataagacatgctttgaattattgatcgttgctcatatttgaaaaacctgggctttgtttgattagaattccatcaaacttgccaaattatacctttgtttagactgttggatatccactcccatcttcttcatttttttttcattttttatcaccatcctacaattaattaggtggtgaggttgatggagatgaagataaagttatgtcacataatataaaaaaaagtttgattaattgatttttaattattatagacttgaaagtgagtttatctgatgttctaaagcaacttctatataaaaagtttttacatgaaatataccgtttaattgtttgaaaaacgtgctaacggaaatcgagaaaaatatatatctttaattagaaaataacaccacctaagaaagaacaggatgtagaagaagatgaaaaactacggaggaaacttcaaatcggacgctcgattttgtaaaaaaaatcggatggaaaatgtttcagttgatcaccggtgaaacattaagttatacatggtgaaaaaaatcagctaatgaaacatttaaaaattatgtgaaacacaacaaagatacacgtggaaaacataatgc

SEQ ID NO: 48414 - DNA, 1501 bp, Oryza sativa
cgacgtccaagaacatgaggaactatgaggatctggctatccaggttgttcaatctgaaaatttggaggaacaaagttctgatctgaagactcaaaatccagcgcgggataagagtctgactgggggagaccatgagaatacttcatcaagccaacgcccgacagcgttcatgcaaggtgaaataacagttgaagatgatgatgcagtggagattgagttggaagaggatgaagtgaagaaggccggtcaatggactgttcttgcgaggttctattcccttaagttccctaaccaggtagcattgtttgaggatatgcgaagagcttggcgcctgcgagcagagatgagttataaatctttgaaggataatctgtttatagtatcctttagtgcagaaggagatcacaagttcgttcgtggcttcatagaggcgatgcactgctagtcgcagactttaacgggttggtgagtccttctatggtacccctagaaacagtgcctatttgggtcagaatctacgatcttccccttgttatgatgaacaaagaaagaggtgtaatctatggcagtaaactaggcaaggttcgagaggtggatgttcaggaggacggctgtaataaacatgattttttcagaatccgtgtggatctcccagtcaatcgtccactgaagaggatgttagctatcaaaatcaaggtgaagggggctgaggaaattcggagatttaatctgagatatgagaggataccacacttttgtttcttctgtggatttattgggcattcagataaggagtgtgaaaaaaggcttgcaaatgaggaagatcccctgatgttttctgttgaacttcgctgttctcctttaaaaccttttgagaggaaggtgagtaaagtgaaagcttttcagagttatggggttcagaggaagttgtccttcagaggtgcaggaagcgcaagctcttcttcggctggtcagatgcagagagttaatatccacgaagatactctaccaagagttgatgcatttgatgggtttgattccaaagagggaaaaggggaagaatcggttgatgcacagttagcggataaagctaatcttctgtctgtttctgagcagaattcctcgaagaagaggagtgagcacaaagtcgggcctgtggaggagtctgcctctctgccgtcaatggaaatgatcccagcaatccgcaatttgaattctcaccaagaatcccttgaagaaagctctagtgcagactgtattagtcctactaagaggaaggctttgacggctcctgttgctaagggcttggggactgtaaaacaagctatcctagagtatgatcagaccaatacaggagccgtgtcaggggtgacaccaagagcgttgaagcgccttaaaaagggagcggatatgaatgctaatggtaaagatatggaagcaaccagccccggggctgctggtaaactggcgggacctaagaatgggtctcgccaggagcaa

SEQ ID NO: 48415 - DNA, 1501 bp, Oryza sativa
agttatcagcaacattcgtatgtaggacgaatatatgatttgggaggacaagttatagcagcaaacagtgcccctgttataactcaccttgcagaggaactagggtctgatttcgaagagatggatacacacaaactctccctgattgacagccaaacaggaaatattcgagatcttgaagtagctgaggactatgtatccatggtatctctgacgctaaaattacaggtgagttgttctagaataaaatttaaatttgaggtaactggataataagcatctaattatttataatattctctctatttcttgcatgcgtgttattcaataattcttacaggatgaagcaaataagtcaggccgagctggacttcatgctctcagtggattggcatccgacccgacccatgaatttttgaagcaaaatggaataaattcaatgccaaaatctgtagcatatggttacaccgcttcgggctatggttttgttcaagacatgccctatgctttcattcaggagtttactagaacctctatggctggtaaaatccggcgtttcaagcatggttacatgagcatgtgggagagattaagtaaatcattaccatttgaagttttttgtgacacgcaagttctgaatgtcaagcgcaacagttgtggtgcaaatgtaaccatcaagaacaacaatggtgaaaaacaagttttggagttcgacaaaattatactatcaggtgctgttgctttcaagaacagcaaaacatatcgatcctctagtcttactggtgagcatattttaaattcagtttggctggcattgaagctatagtatttcagttgccttattagtatgtatgatcttttgttcagatggagaaagtgaagtggtggaactaaacaatcttgaaagagaactattcagtaaagtacagactatcgactactatactactgttgttaagatcaatggattcgagcacataccaaagggattttactactttggagaattcatggaggatccaacaacaataggacaccctgtggcaatgcaaagattctttgctgacacaaacattttcttgttttggtcttatggaaattcagcagacatcaagggttcatttgtggctaaatgtgtgactgatgtcgtgagttctatgggaggcaatgttcagaaagtaattttgcaacggcggttcaagtatttccctcatgtcagcagtaaaggtatatatgttaataatatttctcctgttgcaaggtcttcttttttctcgtgataacattggtaatttcctgcattgcagacatgaaagatggattctatgagaggttggagtcccagttacaaggttttcagaacacttactatgttggaggtttgctagcatttgagcttaccgaaagaaacgcttcgtactccatcatggctgtttgtaagcactttgccattgatggtgagggagaactgactccttatgtcaaggtgagcaagaaataa

SEQ ID NO: 48416 - DNA, 545 bp, Oryza sativa
tgatccgtgtgggttacaagatttctccatgttccgcatcagaaatgggcgcgcttctctttttgtttaggtctaagggtttagtggagtgaagtgtgtgtgggttttgggcttgcagatgcttggagcgctatgtctagtgtttttttttacaagtaatttagtagtacacttgaacaccggcacgtttgaactggcaccagcattttgttggcattggggattgctcatttccaagtgtaagaatgaggcgtgattggggcatacttgcaacataggaatttcatgggaaacaattcatttccataggaactagagggaattcaactgttccgcgcaggtcctgttgtttaagagttcagtgtttcaacttttaaatgccttttgatactggaagcaggggaataaatagatcccagttaactgaattacgacttaaagtgccaaattcgatgaatggttcaatctcaatctgactccttgttgctctgagaagtgcagctacgatctaaatgcacagcctaaatacaatagcatccaaatat

SEQ ID NO: 48417 - DNA, 1501 bp, Oryza sativa
gcaatattcagtaaattctcactctagcagacaaatttttacaaagttacaaatatagccttccaaaaggaccatttctcactctagtagataactttttacaaaattacaatcatagccttctttttttttctctttacgtagcataattctcactctaagctaattttttttaacaaaattgcaaccatagcctttcatttttttttcttaagtctaattttttccttttctttcttccctacacaattctcactctagtagatttttttttacaaaattgcaaatatagcctttcaaatggaccagtctcactatggtagatattttttggcaaaattctatataattctcaccctagcactctccaaatgagtagtcccactctagtaattaaatttgtacaaaattctatgtatttcctgcgttattcttattgtagtagatatttttttacaaaatcctgcatagttctcttctcactctagtaaatacatttttacaaaattgcaaaacctatgcttcaaaaaggagccatggttttttcttactaggggaggaggggttacctccgtgatggatggtaagcttagtttctgtggtaaaccataaaaaagcggatacaatttattaaaaaataatcaaaattccattttaattccgttgaacttggtgaggttgccaagctcttaccgttactgaaccccggcgatgaacaataaacctggttactacggtaaccatcgcatgtgaaaccctaaaacgtggatgccttcttcaatgcataaaaaactttttcttaacataatctttctactacctccgtttcaggttataagattttctagtattgcctacattcatatagatattaatgaatctaggcatacatatatgcctagattgattaacatatatatgaatatgggcaatgctagaaaatcttataatataaaacagaggaagtagtaaataagctctctacgaagtgcagaggtaaaaaaaataatgccattgacagtcttaccaggcactcagtatatgaaaattaaacaattgaacaacttgataactgaatactactattagactatagcaatatctatatctatactcctttaaaacacccaatggtgatggtggatggtgaatggtgaatccaccacaagccatcactactgccatatgggtcttcaaatagtgggtaggtggacttttgtcccttccccaacctcaaaccatcaaacagagagaatatttttttaatatttttgagggctttaaagtgttgagggttctctttttaaattcccgttgcaacgcaccggtatttaggtagaaaaaaaatcaccaaacgtgcgggtcctattcgcaaaactccccgttccgtttgatttaacggccggagatttttcccacaaactcgttaacctccatcttctcttctcctctcacgagctcgcagctcaagcgcacccagccatggcgactcctcagatct

SEQ ID NO: 48418 - DNA, 1501 bp, Oryza sativa
gcacaaatccagaaaataaagttctgcagcagtaactgctaaggttaaatttcatccaggaacatttagttccatttgtacatgatcccaaccggcgaagctatagcacagaatgatgtatcagttcataccattttgaggttgtgtagacaatcaaatggcgctaaaataccgcatttcaggggttaattttactcaaaggttacaatttcaggatctcgaaaagcacatgttcatactaggggttacagtggattgaacatcaatcagaattatcataagcatatgagccataatctcccacaaaaataatttccaggaaaatggcatatggtgtgatctctctgctacctattcttatccatgctggttagtttactacagtccttgtcctcttgcttaaacttgaggtcactcagacaaccatgcggggtgcaatcctcaatgtaatctatatcatgctctggtcgcccatagctgttttccggcatctggtaactgactccatcactgattgtttctctatgtgatgacgatctttctgccccttccaaaccctctagatgttcatgctgatgttcatcctcatggtcgtgtgcatgttcttgttcttgtctgccacagaacgacagttcatatgcatgtggtccctgaaccctcatttgcactgacctcagtagtgctgttttcctcaggtcacctccatggcacatgtcatttggagaagatgggaaccggccttcattttcagagccacgacgaggattagagcagacgaccgacgagagtgagcagctgggcagagggtacgggtttgcggataaaagaccagattgtggtttctggaatcggtgtggggatgacattggactagttgaagggctaaccattgcatcggtttgacttccattgggtaattgagtgtcgtagcaccggtagtcatctgaatcttcagacattggtgagtattgggatattatttcatccctgcaaggagacatataacaagactcatggtgaaacacagacctgaactagaccatgatatgtgctgagaagtataagagctaaatttgattgaacaaaactagcaatgcattctatcgaatatattagctaattagaaaattatattctggatgatatttaattatcttactgtaaagtacttgtgtcatcagcatgtgtatctaagtgtgtattcatcggcatgttgaaaaatgttacttgtgccagagtttctgtcatcaaacaaagtgctccttccacatggcctgtgccatggatatgtaagtttgtgggcatcttgtttgcttagcatgtgcaggaacatgccaaagacctatgtttcatgagtttcaatgtcaacatgccggtgcaagtgttcaagcaatcattgaggagatcaaatcacgctctccagaacaaccagttcacccagaaagcatacagacaacagattgctgtccagattatccatgagcaaacagtgcacatgcaa

SEQ ID NO: 48419 - DNA, 1352 bp, Oryza sativa
gtttgtccctccgtcgagccgttctcgtccgtcgtccgcattcgtcaagcgagccgctgcagccccgtcctcgtcttcgttctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgtgcggttctcggccccggtacccgtgtaccggtgtcggtagtcgttcacgcgtgcgggtggtgaccgtgtagtgtccgtgttagtgtgcccgctcggtagccgcgtggtttccacgtgtgcaggccgtgtggtgtttagtggagtccgtttgtcggccactcgcctcggttgacacacggggtctgcttccgtcgacccgagaaccgtctttgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttcttttttatgtgttgttattgcttctttataggcttgtagctttgcttgtgtgctccgcgtagctttcgtcgttccggaggttcgcgaagcgtggtttgcggtcgttgccgaaggttcggaaggccgttctctctgagcaaggcaagtcacatcatccttgagcatattgaatcccagtttataaaattattttgatttaaattaatgcatgatcgctttatttaaattcccgcgttatcactgttttatttagccatgcctatttacctttgttaagacattattattgctactgttattattaccttgttcaccctagaataaacaaaaccccaactagtggacactctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 48420 - DNA, 926 bp, Oryza sativa
atgtcaatcgacccccgacttcatccatctccatccgtgtacttttgtttatgaccagactgagccacaaattaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaagttataaaaccacctaatattgcctaattaatcagcgaagcatctacctaaattcatactagtggaaccatgaatagagtgtccactagttggggttttgtttattctagggtgaacaaggtaataataacagtagcaataataatgtcttaacaaaggtaaataggcatggctaaataaaacagtgataacgcgggaatttaaataaagcgatcatgcattaatttaaatcaaaataattttataaactgggattcaatatgctcaaggatgatgtgacttgccttgctcagagagaacggccttccgaaccttcggcaacgaccgcaaaccacgcttcgcgaacctccggaacgacgaaagctacgcggagcacacaagcaaagctacaagcctataaagaagcaataacaacacataaaaaagaaagcacacagttctttaggttataacaaacattaagagacttgaacgggtcgattcggagctcgtatgaccaagatatgatcatccgaagtttaatgctgttatatggagatttgcggattattataattaagctttgcaactataaaacatgtgtaagcgctagcctggaaaagacaggaaggctgcgccgttgaca

SEQ ID NO: 48421 - DNA, 1501 bp, Oryza sativa
tatgttcattgcatagctgataggtaaatctagtgtgtatcggctattgctccaatacatctttatactaagatatcattatagattaaatatattaaacaagtgtcggtctactattaggaagacccaagtagattgagatcaagcttaatatgtttagtcttagcgagatcttaatataaatggcagatttagcatgtcaagtaaataaataaagaacaagataactaaaccaggtaagatcggctgaaactccgatactatctctattagcaatcatgaagcaagctagagattatggttctaaatattacttattagatcaaacttaattgatgtagcattaagcatagagagaaacataagatctagtaaacaagccaatgaaaactttttcgagatggtggatatactatatgatctaaaccaatgatattacctgattctatcggctgatttcgatgatagagacgagccgacaagaccagatagtaaaatcaatctagattatattgcatttatgataactcgacgattcacataaacaagattagagtgtcataaagatgtgagcactaatcccgagaacgcaagccgcaataacaagttttacctctcgccggagatcgaaaacgatgcagcccaactagagaacaagaactcgtcgaaacaatgaaagtagaaaaaggtcgcgatgcgccgaaagtgtattgaactgatgtcacgtcctgataaattcgtcccgaaattaaaaatcattcgctaaaaggaataatagaattaattaaaattcggaaagaaattggcaaacactaaaatacgtacaagaaaaattcaaatgtggcccggagaatttttgttaaattcgccttggtctaaaaggagccctcaaattttacttgaattttcagagcaccggaaataattattaagcaacaaaaacaattaacaaagtttattaaaaataaaaacctaaaaatacccctccttcctcctttgggccaagtctggcccaaagtccttcctctctcccctcgggccacgggcggaagtctccctttcctccctttctttctcttcctctccttctctcccttctcttgggcccctttcccctgggcccagctccttcttccctttttttccggggctgtctctcccccccccccggcctgcccggcccaagccgcctccccttcttttcttcatgggccggccgcccggcccaacccgagcggcgccctcccgcccgtccagcgcacgtgcgcgcgcgtgcgcgccgttgccgcgcgctgaccgcgcgcccgaccgcgtggggcccacgcgtcaggcgcgtcgtctccctcctccagccgcccggccacctctctctctctctcccggaaacctagctcgctccctcctccaaatccgcttgattcaattggccaattccaaaattaattggggggttttaatccccattgaatcctcttcaattgcccccaaattcccccttgat

SEQ ID NO: 48422 - DNA, 1236 bp, Oryza sativa
cgaggccgagggagaagacggcgcggtcggactgtgctccggcgaggagggagaggcggctggaggcggccggcgcggaggaaagagaagggcgacggcgggaacgcgcctccggcggtcaccgcgcgaaacggagggcaagccggggtggaggaggtggcggcgacgctggaggaggcgacggcgctgtcggccggtgcacggtcgaggcggcacacgcggctggaggcggcccgcggcgtgggaaaaaaaagaaggctgccgggagatggctagggaccacggggaggctcgggagggggctaaaacgagagaacgggggatgaggatcccattttatatgagagaagagggagccggccacgggggaggtcggaacggcggcgggaatggcggccgacggccatggaaagcgaccggacttggcgcgtccgttcccggggattgaaggcacgaatcaagggggaatttgggggcaattgaagaggattcaatggggattaaaaccccccaattaattttggaattggccaattgaatcaagcggatttggaggagggagcgagctaggtttccgggagagagagagagaggtggccgggcggctggaggagggagacgacgcgcctgacgcgtgggccccacgcggtcgggcgcgcggtcagcgcgcggcaacggcgcgcacgcgcgcgcacgtgcgctggacgggcgggagggcgccgctcgggttgggccgggcggccggcccatgaagaaaagaaggggaggcggcttgggccgggcaggccgggggggggggagagacagccccggaaaaaaagggaagaaggagctgggcccaggggaaaggggcccaagagaagggagagaaggagaggaagagaaagaaagggaggaaagggagacttccgcccgtggcccgaggggagagaggaaggactttgggccagacttggcccaaaggaggaaggaggggtatttttaggtttttatttttaataaactttgttaattgtttttgttgcttaataattatttccggtgctctgaaaattcaagtaaaatttgagggctccttttagaccaaggcgaatttaacaaaaattctccgggccacatttgaatttttcttgtacgtattttagtgtttgccaatttctttccgaattttaattaattctattattccttttagcgaatgatttttaatttcgggacgaatttatcaggacgtga

SEQ ID NO: 48423 - DNA, 253 bp, Oryza sativa
tcagcatggggggcacaatatacctcatctttctctagaacaagttgctgcattgttcaagacaaagcagccagtggttgagccgattcagcaaattcctatagggcaaccatcatttattccacagcagcagtagatggggatgtcttaggctcctggtacttagttcatccctgaacaatccatccatttggcacatcaatctccccaacatcatatgggaggtaatgtaaacatccttattcaccttagg

SEQ ID NO: 48424 - DNA, 396 bp, Oryza sativa
attctccatggttaattatactctctggaattttctcggatttttcggagctcaattcctaaatgatacaaagaacagttcagtaattatttgatcaataatgatctaattataattgttaagttcttttcttgtttaaaatccttaaattataaattgttgtttaaaaggaattattagaaataattttaaaagcttaaaagataagacctaattttaatttgttaaatctcaatataaaaatgagctagataaaattttattaaatactttgcttgttcctctattttctagaattttctaggaattgtttgagcaagggaagtattttaataaatgaaacatcatttcacgaattattttaattggaaaagtttttaaaatcctcccctaagt

SEQ ID NO: 48425 - DNA, 1501 bp, Oryza sativa; identical to SEQ ID NO: 35016

SEQ ID NO: 48426 - DNA, 1501 bp, Oryza sativa
atgtatgtggttagaaccattttcaggttcccttcaaaattaagattttcagaacaacttatctataaactatgtaatccgtagcttttgatgtactgcgatttgcaatattgcaatgatcaaggtagagagcatctgaagttgatgtagaacgttatatttagttgacacaatgacagtatgaattaccttctgttccatgacattgcaattcatgtcgactacctggtttgatttccagcaatggatccaaaagctcgcattcttgtgatttacttgaaatgattgtagttgacgtattgcagttcaccgtttgctgacggtgtacagcttacacaaatcactgagagagcatgttggaaacaaacacgcagtagaaatgtttaatgatcagagcagaattcaagtatttttagccaaaaatgggggaaataaatgaagcatacaacgaccaagtactcctactagtacagaaataggtacagtttgactcctttaaatgtaggtcctatctgattcgtatctcttaaccacaataccagatatcttaaccccctaaccattaaaacgatgcaatttaatttctatcgacgggtgatacccgtagaccggatatagagagtattagggtacgctggtacaagggtctacgtaatacgacatcaagcagacaaaagacgaagattatactggttcaggccccttgataggtaatagccctaatccagttgatgtgagattatatgatggaaaacacaggttacaaagggaacaatggaactcgatggatccgacgagatcgtagtcgagttggttcgactagatcctcggcgatttggctcctgcaggctccgacttcgtaggctgtgggggttgtattggctctgagattcgatgccttaggtcctctccggggggtcccttttatatcgcagatcaggcggtttcccagtagaactcggagacatcagaccttacacgatacattgacgacccagtcttgtccgagtagaactctttctatccgtaaactccgtgaaggatttccttaatgtatgcagagagtatccatatgcgcgtgggtatgccataccgatatgcgacgtatatcgaagggtagagggtgtacctaacccgtaaccctgacagtagcccccgacttctgcttaaatgaactcgtgtaaccattcgcgacttctcgtgtctaaggctgttgtcgttcccggtgtgaggaccgtagagacaggacgtagtcgagaacaccatgtgaagcccaacggtcacgagtgaatttaactgaagtccaaaaaactgccgcgcgtaacggacccagaaatttccggcggccatctctctcctttccttggaattcgcaccgtcggtagtgcgtctatttaaatggaattttggggatccattttgaatgtccgcctattgtgaaagagaacattcccgcctgcaagcgttctttgtcttctccgctcccacaagaaaccctagc

SEQ ID NO: 48427 - DNA, 401 bp, Oryza sativa
gggcccagccagcccagtgaaggtggagtactctgctcatccccacaagccacagttctccctccaaaaaccaaaaaaaaaaagttggaaaatactgcttccttctactaccccagcaatacctacagccctggaacattggccatgccaaaaagttaggctttctttccattcattcattcattcatcagctagcaaagcaaagcattttctcagctcaagttgcttgctcctcttctttctttcttcctcctccccttccctttcaggactcctccccccacatcagtagctttcactgcccaaaccctctttgtgggtggcaaccctagattattaatgtcctcctcctcatcatcaccatctcctcctcttcttcctcccctgcttctctctccaga

SEQ ID NO: 48428 - DNA, 1501 bp, Oryza sativa
aagatgatggaattaagaagaagagtcgtctagctatacagtagtgcatgctggatcacttaatttatgatttgatcatcatttgctcaacacattcctggtttgattgattgaccaggatgcatcagctgaccggccgttgatggatgtatagtgtgtgacaacgttgaagattaattaagatcaaagtatatggcatgtgtgttagaatttcgtaggtgagagtaagatcaaagctagcgtgtatgactggctgttttttctttaagagtaaattttgcaaaactataaaaactttaaccaagccattgcaaaattcgtacagagattttgagtgacatgtcgcataacaacggttttagtactaaacttatataaaaatacattattaagacgatgtattgcagattaataaattacagttttaataataaatttacgacaaaactatgaatgttaaagtttagatgtccatgtcagtactgttttgctagagttataagtatacagttttgagattaattaaattggcattcaaatatttagttttacagtattttttcgaaaaatctatagttttccttaaaagggttaaactactatatgaaatcaaataatcaaacatattgatgcattggttgcaaacatttggtggaccatttcgaaggataatcatcgatgcccctaggggctaggtggccaaggcatattatttccatcatttacccttctacttaattataagaagcatctaaaatttgaatattaaaatttgattttgtagttaattataggttttttgtcgtagtttatttttcagcatttaattttaaattaattaaaacaaatatatataaaaaatcaaaaaacctagacaacggtatcccgttggaatgggatatccttctatgagacagtacctgatacctgataagtgataactgttgtggtaccagctacatggtacccgatacctgtgatacatattacctagtatatatgatacctagaacttgatacttgtgatacttgtgcaaaagaatagttaatatgtctatctcgttggtaccagctacatggtacccgatacctatgatacatattacctattatatatgatacctaggacctgatacatatgatacttgtgcaaaagaatagttaatatgtctatcccgttacaacgggatcccgttttatagcagccctcacaaaacattacatgcaaatacttttttataagctgttatggcttattacctccggtctaaaatataacagctttcaaccatgaatccaaacatctagttgtgcagctaaaaatccttataagacgaaggaaagcataatacaatcataaataaaacgatgacggtcaggaattccataggttagtctatacctaccaccacaacgcccatgcacgcgtatatatattgctcacatcgccaatcacaatgcaagcaaagcaagcagcagaagagctcacgaagagattgtc

SEQ ID NO: 48429 - DNA, 1501 bp, Oryza sativa
tcccaatatttcggatctcttgagatcgaccacagatttagtagaaattttgtaccctttggcacgtcatagcccatcacttgacattgctcctggcactccctcatgaaaagtggccccggggtatgtaaccgtacagtctccttaataacaaactgcaggtaagtgagtttatttatatcatcattacttaccatctttttccacttgaaaacctccctaacttcgtcttgcgccttggacatcactgttggattcctcattagttctgtcatagcccactgtaatactgttgtcactgtctcacttcccccagccaaaatatcctaaaattgaatttggaaaaaaaacattaggttagaaaaatgaggagaaaactcatgtagttttgctgtagctaatggcaaaaatcttacaaaaattaagaacttgattgtttccatgctaactggggactcaagagagccttcctgctggatccttaggagtacatctatcaagtcttccttatgatacatatcttgtgctctcctctcctggtgttcatcaataatcccacctatgaatgcaaacatcccctcccgatatatctctgctttgcgagcagttcggctcagagtgtttccaagctggagagatgggcataggttggctgtgcagaagcttgccgcaagatgaacaccctcatcttggtagtactggaatttgtcgcgaacctcttgattctcaaacctagtaccagtgatgatgcgaatagctgcgtcggtagcatagtcggcaagcttcttactgaggttcactagatgtgcttgatcacttgatatggacttcacaaggcgtgcagcctcctcttcccggatggcgcagaaggactggacacgcttggcacacaagagctcacggatgcagatcttacggagctgcctccattgatcatcatagggcgcgaacacaagcccctgtcctctctttgtaatgatcttcattatctcgctttgcggtctcatcgcaaatatgctgtcatgagtcttcatgatatccttggcagcctccggggaagaaacaataatgaatggtacctgtccaaacttgagtaacatgacaggcccataccgtcgtgatagatcatgtaaggagcggtgtgggagatcaccgatcaaatggtgtatactacccatgatagggagctgccatgggcacggtggaagccgtccggcttgcttgcgggagctgaacatagctttgtagaaattaatcaggagtaggaaaggaagaatgatgagcaatgagtagtatatgagatttgccatgagcaaggaagggatcggaaatgctgcatatatatgaaatcggtagtgagttccgcacttattaattgggactccaacaagttgcttcaagttgtttatttaattatgtgtgcacattagtgacgtagtgcagagaacagaaaattatgttaagtcgtttctgggttctcattgtctgttatagtttggtg

SEQ ID NO: 48430 - DNA, 312 bp, Oryza sativa
cttgcttgttaataatgtgatatggccgggatatccgaagtgaaaattattttttctcgatcgacacgatgtcatagaggtataggttcaaagtgaaacttatttttgttctaagcgatgtggaagtatatattcaataatcacaaagtgtaacttttctaaaattaattaattaatttgtatgtttcattttacaatgtgttttgatttttttataaataaaaattttaaagtttgatgaagtttttcgaaaaaacgtactaatcctttttaatacaactagtagtatgcacgtacgtactttgcaacaga

SEQ ID NO: 48431 - DNA, 967 bp, Oryza sativa
aggtagcggtcggaaagggcaaaatgtcaaggtgagtagtgaaaccaaaacaaatatattattaaaatatattcaatgttagatgaaataaactaatttggaattatacatgttgctaacattttctataaacttgattaaacctgaaaaaacttaatagaaaaagtcaaagcgataaataccaataaacggagatcagagtacatgcgatgcaagttatattatacagtaggtagttacgatgtagttttcacaatctattatattattaaaagagctttgaaagaagacaccacgtttgccgtgggggctagaattcccacattaatccaagaaaaagaaaaaaaaagaaaaaggagagtccaagtagaagtccaatttaaaaatagctgaaattcggaattaaaaataagcaatattgaaagaagtttccatataagaacccaatacgagattaatcaaaattcaaaataaaaataaaataaaatccaaaattagaaacgaaaaggagagtccaagttagaatacaatttaaaaatagctgaaattcggaattaaaataaggaatattgaaagaagtatccatataagaacccaatacgagattaattaaaattcagaataaaaataaaaataaatccgaaattagcaaaagaaaataaaagaagagttcaagtaggaataaaatttaaaaatagctaaaattctaaattaaaaaaagcaatactgaaagaagaatccatataagaacccaatacgggattacttaaaattttgaataaaaaataaaataatatccaaaattagaaaaatgaaaagagagttcaagtaggaatacgattttgaaacaaccgaaattgaaaataaaaacattaaaataacataatacagtattaactatttttttaaaaaaatctaaaattagaaaaagaaaaaaaaagatttcaattaggaatacaatttataa

SEQ ID NO: 48432 - DNA, 1501 bp, Oryza sativa
ttcccagtttgaatacacaagttcaaaaagctgggcccgccactacatattagctggtctacgttagaaaaggacgcactcacacgagacaaagatattggagaaggaatctcaaatgttcctagctatggactgctaacatatccccaacagatacattgcacacgaaataatattatgaagggataacatatctgacttttttcttgtattgtttagtcaaatgcatttatcctctcatgaacaataagctcagatatcttgctacctcgtcatcacctatttgtttcgacatttatttttttttttttttgatatagaggtacaatgatgagcatctaatctactgacgtggaagattttattttgtaagaaataggggtattttttgcttaatatatcttccatacatcagcccaatctgtacaatatagatttcaccaaaggtcagcactagatatatcaaacaaaagactcgtatctctacaaaattctcgtgtcagaaccaatagcaataaccagacataaaataggaataactcagagataagcagccatttcagctgacttaacacagtttttccgataccctctgctagtggaagctcatgcacaacttttgcaaaacctgttaggagatttgaacatctatactaatataaaaaaaaggagttgtacccctccaatcctactagccaaatcactcggattaatccctaccgtccatccgcgtgcacgaattcaccaccgcatatactaatataaaaaggaggggttgtacccctccaatcctactagccaaatcactcggattaatccctaccgtccatccgcgcgcacgaatttaccaccgcacgattccacacgcaaacttcgctcctcctccacacgcgaagacttcgctcctcctcctccacgcgtggacttcgcttctcctcctgcatgtagcgccgccgcatcctcgccgtcgccggagctcctccccgcgcgtactgccaccgcatcctcgccggagccgctgcccacgccgacatcttctgctgccgccgccagatccggcttcttccctaccgttgcggccggatccgacctcggccccatccgccgccgccgccgaggtcggcccctcccgtccctgccgccggagtacatccatgtttccctcctcgctgtcgtccacaggctccgccaatgcaatggcctctaccttccctcgaccaccgtcttctggacaaaaaacattctttaagacctgtcaatatgaaaagtacttgccattgatgttctcattttttacaaccaccaaactataacagacaatgagaacccagaaacgacttaacataattttctgttctctgcactacgtcactaatgtgcacacataattaaataaacaacttgaagcaacttgttggagtcccaattaataagtgcggaactcactaccgatttcatatatatgcagcatttccgatcccttccttgctcatggcaaatc

SEQ ID NO: 48433 - DNA, 649 bp, Oryza sativa
atggcacactgacacgtttccaacgtagccaccattatatgtcagtgtagcaactgcctcctgttgccattggacaatgagtgagctcactgtaagtaggtcatacctacaactaccttattttctataggctttcacaaacaaatagatgaatcaaaataagtatttccataggtgataagagggagcttgcatgttctattgagtactgaccgacaaggcataattaggataacattcttatttatgccagggcaaaataatggagttgtctaacgaatgatgattgatgaatccttttgttcttctctttctttttctttttccatccatgcagccgtttaatccgtcatttttaagtagtcaaacagctatagatcataggagtagcagttagtggtccaagatgtaagagggccgtgacaactttggcacacttggcctaagtcaactgctataaaaactgctcgaaaatgaaatagcaactagagtcagttctttcaacttaaatagagatttgtggtattgttttctaaaatttttaaaaaagaaatttgtctgtatttaggatattgaaatcatgatattttttatgagatttgttttccctcacacacatttataggtcactgcgccaaatcagcactga

SEQ ID NO: 48434 - DNA, 1501 bp, Oryza sativa; identical to SEQ ID NO: 30357

SEQ ID NO: 48435 - DNA, 745 bp, Oryza sativa
gtagatccgtttggaaaaacggaaccagtataaatttagcattccatttttgtataattttaattttggatttgcacttttacagttgagtccctgtaatttttatatttacatttgagtccctatgaccttatattgaggtccttgagtcggtttttgttaaaaaaaaggcagaaaggtgcttaaaaaaaagaagaaaaaaaagccacaccaaaaaaagaaaagaaaagaaaaagaaaagaaaagcaggaaagacaaaaaaaaaaaagagaaagaaagaaagaagaaaaggagaaaatcattttgttatcattgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctgcacagttttgattacggccgtaccgcaagtgtttgccaaggcatcgatacacccaacctccattggggtgcttggttgagtcggtgtacattaccattccgcttgctttggtaagaacttgtaagagcttggttaaaagcttgattgtgtgtgatatttgagctgccactacctagtagttgataggagcgtgcatatttttgtgtgtttcttgtttgctactaacca

SEQ ID NO: 48436 - DNA, 672 bp, Oryza sativa
aaaaattatttgtccatattgtttaaggtgcgtccatcacataaatgatccgttttactgttcatattttttttgtagcattgtgcttggttattgcagaaaatgcatattgttttcatttttcaatggctttctgtcatttcctattctactagcatctatctagatcatcacatgacaagtagaattttattagtcaaactctttctgaatggttgaccatttacacatcggagattgaaaattgaacctagcacagttggtaggaaatatggtgtgcacacctaccatggtagtttaaattctttagctcaatttagatttctatttcttctcacttaaaaatggcatcaagctcctttttaatacctacttctatcgtattacgaataaagagtgaaaaagagccaccacgtttcctcggtgtagaaattatcatgacatacactattttgatcgcgagatatgacatgcatgacggtgtggattgactgatacaaaacaaaactatatttatgaataatgtatatcaaaatgagattctatttttaaaatctagctacatacatggttgcgtgggaaaatccattaattctcatgcattaacacactagataaaaaaagtatatccaataactttgtctttacccctttaaacgttcccagtggtga

SEQ ID NO: 48437 - DNA, 1501 bp, Oryza sativa
ggccaaagatccttgctatatatgtccgcgcggctgggacgcgcgtgtgcatacaaatacaaggaaatgctctctttgcgccacagtcgattggaaagtgatcgcacatcaatggatctctgatacggccggatcgccactataaaacaggccatttccttcacggcggggggaggcagcagagagagtacagaggcacgagccgagggcctgcagttcacgccgccgctgccgccatgcccagccttggcagtagtccctagagagacatacacagagacacaggagagaaacacagaaacacaaggacaaggagagcggacacaggctgctcatcggcaaccatcacgcacgtcgtcttggccggagtatctcggcgtcctgcgggaacgagcgtgctctgcggccggcgacatcggctgccgtacctcggcgtccggcaaggaggcgcgtgcgctgagccgctgaggaagcgcgctaaggaggagacgatcaccagggagacgatgccgctccagttcactgccatgggtaactagcctattttcttatcatccctttgctccatttcagcgcatgcacgccggtatgaagctcctcagcagagaagatgccggatgcaccgccatcgtcagagtcgccagagttgacgtcgtctgcaagtctccgtcaaggtgaagacgatgtttctatatggcgcggcgatgttgaagacgatgtttctatatggcgaggagatgtcgccgagatgctcggacgtcgtcaccttgctggtcggcctcttctctgcaacgccgtcgacgtccgctccccctcatcaacgctgctatcttcttcacattcattgccttgctgcctgaagagaacgccggccggagcaccactacttggtgcctgcaaggctattggattgtaatcttagagcatttatattcttttttgtttcgttgcatgtagagttcggttggagtctgaattctagccggtagaatagcatttttctgttttagcaaattggctcccttcttaagctgcgttaactcggctcgaatcgtggaatggcgcggtcagtagttgatccgagattgtcgtgatttgattcttttatgcatgtaacaaactccgtctggagatgaataaatagaagagaaacccgaaaaagctgcactgtattacgcagtgccaactctgttcgtcagttgttctgttcgactctgttttttcggaacttcttcagttagctgtagctgcacctacaagcgtcagagtgtgtgtttcagagagactgagagccagttcgcatgagttttttctgacatttggtatcagagctttgctgagacgatccggtaatgtcatacacaccgcctggccgtcgtggtggcggtggcggcgggggaagcgacaacggctgcggcatcactcccgctagtcgatgcagggcacactgcccgtctcttgatcctgtcgaggacaaattatatagactgagcgctgttga

SEQ ID NO: 48438 - DNA, 1501 bp, Oryza sativa
ggagttcctggaggatgaaggctttggtgtctagctcgtgcctgccgtcaagcgcctgtggtcgtcgccctagtcttccgctatttctcgtttgtctttgtgtgtgctgggccttcgctgcccctgtaataaattatctatttacgcttccgcttgttaaactctgaattgtatcaacttttggtgtaccttgcctcctgggacaagggttaatgcacgcacgcaaggaacgcccgttgggtcagttccggtcgtgacaagttggtatcagagcccccttgaccctaggacgagccttagatcccaagccttagcaatattttcaaaataaaaatcccttcttatttgtgaaaatcctctattctctctctgtcctgctgcttcatttatcgccaaaatctgacctttaaaatgttgcttttctttttgtttttgtttgtagatggccggcagcgtcagccgtcgtggtttggacatgactggcttcgtcttggagctgcggggcatgtgcgtggtcctggggtatccacatggagtggactaccaggccaggccgcttccggagcaggagggtgacgatgcggagccccacgctgcttgggaggtcactgcagtgatcctcgctggctctcccgagcggacttcgctgacagtcaccgcgggtggggattccttccccgccgcttgccagagcgccgctctcctcgccatcggcactcttcaccagcgctacccggacgagttgcagcactcgccctaccgctaccaccctcgtcgcggaggagcccgcgactacgccaccttccgggacgctagctcggaggatgacgctaccatcgtgcacctggcgcgcatggtggaggcgtacgacgcggctcgtatcgacttccatcagatggtgcgtcgtgggatggtcgagaacaacatgaagatcctggagctgcgtcaggagaacctgcagctcaagaaggacctagatgcggtggaggcgcagctgcatcagctcaagatcgcccagggagagatctgccgccccaagcatcgccgcgtctaccgcagccagaagatcaccgcccgcaagagcacctccaggcccgagcttgttcgtcagtccctggcgtggacttgcttcgtggagacccctcgtgccgagcccgcgcccgtggttccccaggagggggaagcctccggcgttggtagcacggaggatgcgctgttgctcaccttccgtcctggcccgtcacagcagtagacgagcagttagtaggcttgcgcgtgtgttctttctcgtttgtcttcttgttgggttgtgtggggcacggttatgccggtgtgtggtgtaactttgtcggagcctgtctttattttatttgtttaagcaacttgaactttaatgaaccaatttaatagcagtaataaattcaagaattatggtagtcgtgggtggttagctttaattgtcagctctctctgtttgctggttctgtgtggggttttcaga

SEQ ID NO: 48439 - DNA, 1501 bp, Oryza sativa
gtcaacataccaatagatgggctgcagctcgagaaacttcatgaggataatatcttcagattatatcaaggcaatcagttgtacggagaagtcttatagaaggaaacaaaatactggcatgcatttattataaaatctcaaatctatgtgtatggcaagcaacgcttaaagtacagcatcaactgatttatatgcacctaatataatctttcaggatgaacacagatagacagaaattgtgcagcaaaagaaacagtggatgcaataacatagtatcacaactgaatagaaattgttccacaactgaactcagtatcacttcttccaagttttcagtaaatattttgtttagttttgatttataaataaatatatggaatatgttcatggaaagactaggtgagaaggaaagaacaaataatctagaactggttcaaacatccatagcagcaaatatattttcttaaaaaataattaaattatggatacaaataaatcttcacaaaaagttcctcagatgtatgatagccatacaacttttttgctcgaacaagggtacatccatgcacatgcttcttttttgatgagctgcgaatctgtaagaaaaacgatgatatcaaaaaatacaacagggtattcataccataaaaaaataattggacttcaaaatacctgcaaagctttctcaagatcactcaatagaccagatataaatgaattacctagagaaagggcacaaaagagtcaacaattcatccttgtcatcaagcgatgttcttgacattaaaagcaacagttaatcagggagcatcaataccaacatttaaagcaaataacacatttaggctatttggttagaaaaagtaaggcctgtttgatttctagacacagctgcccttttggccagaataaaatctaagagatgctcaccaaggcacagacacatacaaaggattcagcatactgtctaaattatctaaatgtgttgcagatgcatacaaggccaagctttggacatatgaagtaacctttcaaatcataaatcaagttcataaaaattgcaatggtggataagaggaattagtgtctaaaaagtttgtgacatagcagtaagactcagttagaagatgaataaataaataaataaataacaagcaatttaaagtttctggtgatgtactaatgtggatatgaaaatcatcagaaaaaaagtttcaggtaatgtggatagaaaatcattggtacaattccaaatagaataatccatgtaacaaattgcacaagcaacagtaatagcatgtacatgatgcattacaaagaatgaatcacctttttcgacgttatgaagaaggtcctctttgcaaggtacatacagaaatggaaggacctagatacagaaaagaaaaacaactagttggaacaactaaggatgaatggaatagtctgaataactttctggggaaaagcaagatgagaaaatcaagtatatctgtattcattc

SEQ ID NO: 48440 - DNA, 1501 bp, Oryza sativa
gcttgggatctaaggctcgtcctagggtcaagggggctctgataccaacttgtcacgaccggaactgacccaacgggcgttccttgcgtgcgtgcattaacccttgtcccaggaggcaaggtacaccaaaagttgatacaattcagagtttaacaagcggaagcgtaaatagataatttattacaggggcagcgaaggcccagcacacacaaagacaaacgagaaatagcggaagactagggcgacgaccacaggcgcttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaagccaattccacgataatccaacagttccaaagtgtccaggtgatatgaatattcccaaagtctagagttgtaaaaccacctaatgttacctaattaaacagcgaagcatctacctaaaatcatgctagtggtaccatgagtagagtgtccactagttggggttttgtttaatctagggtgaacaaggaaatactaacaataacaataataataaggtcataacaaaggtaaataggcatggctagataaaacagtgataacgcggg

SEQ ID NO: 48441 - DNA, 1501 bp, Oryza sativa
acctccacggacgcgggggcgttgcggagcggcagcctggtgaaggtggtggcgccgccgccgccagcggcggacgacgacgcggatgggcggggaggaggggatggcttgaggggcctggctgagcctcgcttgctccgggagcccttggtgtttcggcgagcctcggcggagaagaggcggaaggggaaggcggcggcggcggcgacgacggcgacggccggcgccatttcgtggctgtttgagctgagcgagatttttctttttttttttcttttttggttctccttgagccgagcggataagatgagtggcgtgcgatctggaccgtccatttccagatcgtgcggcaggcgatgcgtcatcagcttgagagttccgttcttcttgtgtcgactgacacctgtagcaacaataatggtacggtgagaaaaaaaatccaaattgatagtactagaaattaattgcagaatcatcgtttggtttacaataagccataaaacgacacatgagcaaccaaaaataaattagattaaacttttatatacgtataattcacagttcaaaggctaatgttaaaagaaaaacaaactgcaacataaaaatcctaaatttaagttttaaaatttaaaattcagttttagtgaaatttgacacggtagtaaatctttatctgaagagaagtttatctgctttatctgggagggatgaaagttgaaaggtaggagtacgtttcagttgtgattcttatcaagagagagagagagtccagtacaccacgctatggcgccatgcttagcctcgccgaaatacattaccgggagcaatgctacacgtattaaaattttcttactagcagattagatacaccagaacagaacaaaaacagattagatatggagtcgctgccgtttcgtttcgtcggtgcgtcaagtgatttcacgagaatctcttgcccttcggcctatataatggtttcacgcgcgatagtctcgtcctaatctaacgaaaaagataatgaaataatagtactatataccagtatatcattggtccatggataggataaatccaaataaagtgacgtcacccaccgccggagtagggacgacaactaccaccagccacatcgccctccttaagccctcctcctctcctcctcctcctcatccccctcgcgattacctctcctctcctctcctcccccattcatcgtccccctccgccgccgccgctgcaggtatcctctcctcgcagattggagatttcttgtggatttcgattgatttttgtgtgggcgatggactgactccacctggtttggattagtttgggagttcttcaatctttgatcttttatttatttactgtgcgcaatcaaatcggaaactttctggctggtcttttatttatttctctctcactcgtcaattcactgtggttactgatttgtttgctgctcttcaggcccgccgctccgctgctggtcctgctgctgcca

SEQ ID NO: 48442 - DNA, 1501 bp, Oryza sativa
ttacacttacattcctatcaaaatcccgcgtttttcctattcctatgttttctcattactaagggcccttttgaatcgcagggtagaaaaaacagaggaataggaaaacacaggattttgacaaacaaaggattgaaaaacacaggaaaaatataggaatggtcgtttgattagagcgcaggaaaaacgcaggaatcggatgagagagatagactcaaaggaaattttccaagaggttggagctcttgccaaatttcctccaaaatccacatgcaatgtgccattccataggaattttataggatttggaaaacttcaatcctttgaatcaaagggccaaataggaaaatttcgtataggatttgaatcctacgaaattcctaaataaatcatttattcaaaggggccctaagattcaaaggggcccttaatgtgctgtcaatttagatctaatctaattactaatgacagattaaggaagcggttagttttgatatatatacctgatggggatcaccaccctcctctaggccgggctcgccggctggctcatcggcggcgcccttcttcttcttcttgcagcgaacgacgacggcgtggcgcgggcggtccatgcgcgccgccgcctgcgcctggagaggccgtcgcgacggcgaagtgggtagaggagccacacggttccatctacaagcaagcagtcgaggagccgccgccgcaacgtgtgcggccatgatcatcgcttcaaggtactcctgctctttgttttccttttggtactttccttcctcgtcccataatataaggagattttttatggtctaacggtaccgtgcggtaccaaatcctggccgttggatctggcccgatccaatagctggtagtgtttggtaccgcgaggtatcaaatatgtccatgttgcagtacctcgcgtagacgagaggtgggagggcaaaaatataccttcaagtgtaatagatgggaggaatatacgggccacaggtggaatttctcacactttccatccttttctgcgctgccgccgcgtttctctcccccctccccccggcgccgccgtgttcctcctccggcgagatcgattgtggcacaacttcgtggtcctccgccaaccgccgcctggatcgacgccatcaacgccgccgctgcctggacgtcaactccgccgtcacctcctggacatcaactccgccaccatcgggaacgataacttggacgctgccgccaccgagaatgacgactcgaacgccgcatccacccttgctcatcttttctctcccgatcctacccattgtaggatcaaggaggccgactagagggggggtgaataggcgattttaaaacttaatggcacttaaacaaaactaacctaagttgctaggcaaggtaaagtgcaaggttaactaagcaactaagttaagttttgcaaacctaggtgatatgggctcaaatatgtctctatgaatgtaaatagcaaaaatgtaaa

SEQ ID NO: 48443 - DNA, 1501 bp, Oryza sativa
  unsure (1)..(1501): unsure at all n locations
cgtgtagcattgctcccggtaatgtatttcggcgaggctaagcatggcgccatagcgtggtgtactggactctctctctctcttgataagaatcacaactgaaacgtactcctacctttcaactttcatccctcccagataaagcagataaacttctcttcagataaagatttactaccgtgtcaaatttcactaaaactgaattttaaattttaaaacttaaatttaggatttttatgttgcagtttgtttttcttttaacattagcctttgaactgtgaattatacgtatataaaagtttaatctaatttatttttggttgctcatgtgtcgttttatggcttattgtaaaccaaacgatgattctgcaattaatttctagtactatcaatttggattttttttctcaccgtaccattattgttgctacaggtgtcagtcgacacaagaagaacggaactctcaagctgatgacgcatcgcctgccgcacgatctggaaatggacggtccagatcgcacgccactcatcttatccgctcggctcaaggagaaccaaaaaagaaaaaaaaaaagaaaaatctcgctcagctcaaacagccacgaaatggcgccggccgtcgccgtcgtcgccgccgccgccgccttccccttccgcctcttctccgccgaggctcgccgaaacaccaagggctcccggagcaagcgaggctcagccaggcccctcaagccatcccctcctccccgcccatccgcgtcgtcgtccgccgctggcggcggcggcgccaccaccttcaccaggctgccgctccgcaacgcccccgcgtccgtggaggtgacgctggaccgcttccccaccgccaatcccgagcccagagcttccacttttactcgccggaatggcgagcggttgggcgacgacgaggaggatgaggaggaggaggaggatgaggtggagctcggactccgtggggccaccacgtttgctcggctccctctgcgggactcgccggacggcggtgacctcaccattgggcacccccangngggggggcccctcaagagggcntgaggagtcgcgccatttctggtcaattggtcgaacaccttgccaccgtaaagnagaagaagtaggagcaggtgggtttcccccaaancccccagcttggacatcttcgagggagcaaagggcagggaagctcgggctttcttacccgacgaggacgacgaggacgacgacgtcgtggtgttcgacccagagtacgacggctacagcgacgacgaggagttcgtcgctactgctgtcgagcagagtccacgaggcgacgccatcgcagttgcggagcttgaaaagctcaaatacgacaatgacgacgacgacgacgacgacgacgaggttgtcgtgttccacccagacgacgacgaggaagtcgacgtgttcgaggactacgacgacgacgaggaggaggagacgaaggagaagggtgtccccgccgtgatgc

SEQ ID NO: 48444 - DNA, 1501 bp, Oryza sativa
cctctccaggcgcaggcggcggcgcgcatggaccgcccgcgccacgccgtcgtcgttcgctgcaagaagaagaagaagggcgccgccgatgagccagccggcgagcccggcctagaggagggtggtgatccccatcaggtatatatatcaaaactaaccgcttccttaatctgtcattagtaattagattagatctaaattgacagcacattaagggcccctttgaatcttagggcccctttgaataaatgatttatttaggaatttcgtaggattcaaatcctatacgaaattttcctatttggccctttgattcaaaggattgaagttttccaaatcctataaaattcctatggaatggcacattgcatgtggattttggaggaaatttggcaagagctccaacctcttggaaaatttcctttgagtctatctctctcatccgattcctgcgtttttcctgcgctctaatcaaacgaccattcctatatttttcctgtgtttttcaatcctttgtttgtcaaaatcctgtgttttcctattcctctgttttttctaccctgcgattcaaaagggcccttagtaatgagaaaacataggaataggaaaaacgcgggattttgataggaatgtaagtgtaaaacagaggattgcaaaacataggaaaaacacagtaatgatcatttgattggaccgcaggaaaaacacaggaattagaggagagataaagactcaaaggaaagtttctaagaggttttaccgcatgttagaattcctccaaaacttgcatggcattagacaatctataggaattttataggattccataagatccatttctttgattcaaatggctacgtaggaaaaatttctataggaataaaatcctttaaaattcctataaatttcctttaaatcacagggggcctaattgttttttcttctattttagtctccatcgtaccagcaatatcgtaagtttcaagacgtaattgaccagctccagcagtgtgcggccgaattaagagctcgtcgatcactcaaaaaggacaatatggtttgttctaagggatgtgcttctgtgctcagcaaaaaaaaaacttgcacgaaagttaaagctaatcagcggctgtgattaaaagggagattagcacttaattatcattagcgaggggtaatttcgtccaaagatttttgagcccatatccagcccagtccatctgaagcgatccctacattctaccagtccaccacggcgccgctcctcaaccgcaccgccgcgccgattttcgccttgccgtcattgctctgccctcttcttcagttaaaaggatacctgagcaggtatggcctgagtgacagtaaattcagtttcagacttaacttgtctcctcaaagatttgccttcaagttacagaacagagtcaatgccttattgctgcaactcgacttgcaaatttggttgtacatatacacatctggcacaagcttcatatttaca

SEQ ID NO: 48445 - DNA, 1501 bp, Oryza sativa
actaatccccacgcatgggaaatagagtgatagactagcgtataattatttaagtattagctaaaaacttttaaaatatgaattaatgtgattttttaaagcaatttttctatataatttttttcgtaaaagccatattgttttacagttttagaagcgcgcgcacggaaaatgagtgtgtagagggttcggaacctcaacaaacgaaatcagtgtaaggagatgtataggggcttcgaataaacacatcatggttcaataaaaaatgctaatagtagtaatacaaaggaattatgagatggttatgaattgaagctgtttcagtaacactacaatcagaattaaacatgcatttaattatcagcgcatatctaatacaacattggaagtggcatttccactccaagacaaaattctaatcttcagaaatatgctgcaataagcaatttcgtagcggttatataatttaatttagcgcctcaaccttcaactttaggacttgtgaatatgaacgtaaaagttagttgcgttagtgcaaaatcaaaagttttaatcgagataaacaagttcaataataatactacgaactttctttcaaaataaaatatcatatataagacattggagatggatgtgtgagctcttgacattgtggctatgtgctataacttcaaatgtactccctccgtcctaaaaaaaaacccaatcctaggtttgaacttggacaggattgggttttttttatggagggagtataatataaatataaattagtttgttgcaaacttcatccatatataataagcaccgtgaattttactgaaatttaaaattgtaggattatgtcgtaatgttactatgaactttttgtcttgcctgttgcaaaagctgatcatgttttatttggtgagtactgtaggatggacaaggcaggatgttaacaatgactcttctcttaagagctaaagatgctatcgagttggcttctagaattatggtaaatatgctatcttttaatatataatatgttagctgttagatttaattgggtaattgatccatttaaatcaattaaattaaataaattccaaggctcgttatgctaggaatttatgtgaattcattcttttatgggatatcaatgggatgaagagttttgagaattaatccatttgattaaggaattggtaacttatatcaattagtcttaattgatggatggttgatggttgtgtagtggaggatggttcatggctagttgatgacaattagttgctctattcctcttgctattccattggtgatggttgtgtagtggaggatggttgatggctaattgatgagaattagttactctattcctcttcctattccatgactcttactcttcatcttccatttcctcttataaaatgagaatggatttgatctcccgcgaaagaggaagacacactttcatccattttccaaagctgttgctgctacggtaatcccatctcga

SEQ ID NO: 48446 - DNA, 1501 bp, Oryza sativa
tctctctttttccgctctcgccgcgtcctcccgtgctctctaccgccgccgtgccgctctccctgagctctgccgccgccgcccatctccggtcgcacgacgtcgccactagcgccctcgccgcgccgcaccaccgccgctgatagcttcgccgccgcggaagctacctcggccgccgcctcccgttgctgaaatcccaccggaaatcgtcttcccccgccgccggtgagcccctccattttccccgccttcggccggcgttgccacttgccgcgaaccacctctctccctctaaatcctttttttttttgctttcctaggtcactccggatgtcgtccacccgctcgactcgccgtccactgcttgccggcgtcgttcgccgttgtctcctctcgcgccggccaacctcggtgagaaacccccctctcctcctctccttcaccggtgcgtgtcgccgcctcctgtgcacgccgtcgtcctcgcgccagtcgccgccatctcccgcaccgccggtggccgcgcgccgctgctgccttgccatggccggccggtcggctttgtgccagggcgagccgtgcctggccgccgccgcgccgtccgatcggctcccggccgatccggaccgttggtcccgtggactggcggtggaccacccgcgtggtcccgatccacggtgaaccggcgctctataagcctgcttgccgcccccctcttggatgacgtcagccctgggcattatagcgcaataaatcaattaaggccttttctttattagtaaaaacacagagaatcttctaaaaatcataactaattcattcgagctccgtttaagtccattcaagtcttagtaaattcataaaaatgcaaagagtctattaaaaatggatttgtttcctgtttcagtagacttatagcatgttttgcttgtgtgctttgtttgtcgcatagatttcggtcgttttgtcgatccgcggtttctcgaagacgttgttgtggtctcatcagcgcgagagcaaggcaagtcatgtattacaattgatcatattgtacccaatttacaaatgtcccgcatttctattaaatgttgcattattttacaatatcatgtgggatggttcctattactcagccatatgttgtttaccttacgccattgataacttgggttttaaaatgactagatgttggtttagggaatgcttagccgtgcttagttcaactagtacacaatgggggaatcacactaatgcatagactttgattattggcatagctttggattagtgccaccgcaatggtgttagttaattaaaatacactacatggtgggctgtgggtgcatggttttgctagtcgtgcctatggcgattaaggaccggtttgcgggaaaccctggaagaattcatcgtacttaccacaagccagcgtgggcaacggctgggcttgtagtgtagctttcctctagatgacgtacctagccaagggtgggcgtgatggagt

SEQ ID NO: 48447 - DNA, 1501 bp, Oryza sativa
aaaggcgaagatcgattcgggaacagagtaaaaatcggctggagtccagatcggctacgattgggatcggctaagtcctagtcagactaggataaatgatacagccgattccgacaatacgacttgtgtacgacatcgggttgagttgatatgcttcaagatgattgccacgcatggatagagtcctgagaaggcaattgtatctattaattaggatattttatataatttccttagagatatgtttgggcaaaaatctgccgtaaagacttatgttatcttagagtttgttagagataagagtcgtgtccgatatggacatagtttgtaattctcgggtataaatagaccccgaaccccatgtaattacaaaaaacacacacgttcaatacaatctcggcgcatcgccaccctttttgtttttgttttatttcgacgagttcttgcttttgggttgagctgcatcggtttcgatcttcaacaagaggtaaaacttgttatgacggcttgcgttcttaggattagtgcttccatctttatgacactctaatcttgtttatgtaattcgttgagttatcatatatcttacataatctctggcattattgttatttaatctacaatcggctaacatatgtcggtagagagcagccgattaggttagatatcaatattgacctagattatataggatatccaccactatatgaaacttccagcggcttgattgtctagatattgttcttctttttatacttaatgctgcatcagttgagtttgatctactaagtcgtgtttagaatatcaatctctagcctgccctctggttgccgattagagtagcgtcggggtttcagccgatcttatctgatttaactacatttgctttatgtgtttcattgacatgttaaatctaccgtttatgtcaagatcttattgcatctaagtatattaagcttctgtttggtatattctgcttgttttaatatcttaacatagagttgtatcagagtattagccaatacatgctagatctatctgatcggctacgctatgaacatatgtagtcttgttgttaatatatatttcgatctaagtgatttatactgtctcggcatggcgaccgatctatcccaatcagttgattcaagtatatatcgacagcaggattatatattgttaatatgtacagccgatcgagtagatttagttctttattatctatttacaaccgccgatcgatttaaacatgacattggctcaaagataaatgatacgtcatcggcatctagccgatcggctatcatttatggatttaactacggtttctttgtctttatttcttgttgattgcatgaccaaatcaactggcatgctagcatacccaaaggcaagttttagacctgcactggagttaagcagatctcctaggcctcatgtttttcatcaacacgcttttggcacgcctggtgggaccgattagaagtcagaagtcctctca

SEQ ID NO: 48448 - DNA, 1349 bp, Oryza sativa
cgtgttctctctacattggttccacaagaattttttttgggtctgcagatgcatatgttgtgcacacttgttcttgcaatgtgtgggtggtttgctcctgtatgctgtagcgtattactatatgaaaacctaagtaagcattgactaagataaaatagtatcgtgttctctattagtacttaaaaactctgcagaaaatactgatacattcaaattgatttaggctgaagctgtctcatcaggagaatccttgaaactaagtccagaggagcggctgcaggaccagagaaagtaaccatatatcagccactctaaaatcatggtaggtaatcaggagattaaaatgaaattgaaatcatatcctggcatgattcttgtgtgatgcatatactagtatgtgtaggagttgggagttgcattctcatccattagaatatgaacaagagcatctctgaattagtaaaaggaccatataataatttcagctgtagaacatgtgtaactaataggatataaatattttgatttatctaacaagtagaaagattagttatagttcaaaattatgagtgtgccagctgaatttcatgcttatggctgtatttgtttgctttgcaggcgacaagggtttattgcttcgtgcacaaggttcctgtctgcggcgaatgcatccgcttcccggagcatcagttatgcgtggtgagcctctcggcctgttgcatatccttggattccagagtacagtagagtgattgcattctgaataagttaagctatcatgagactatcacaatgtttctatattgttttttatggttgtatttcacagtttcagctgccttgttgggtaattgggaattgttggttaatgatatattgggcttgattacctttaaacctacagtgatgtaatcaaaatgttcacaaaaccttgtgccactaacttgatccattatcttaaaaaagtttagtaggtgaggcaggtgatgtttagcagatttcattttgtgtgagcttattactttgattcgagcacaaattcatgtttggctaggtatatacatattggatatgaggtacatttgagatcttttgattctgtcaggaggaattggaacatgccagctacatctgataattctagatttattatagcagttttcagattgactataagataattcatgtaatcttcctgagttatttaaccacatagcttcctaagatacatcaacataaatttgatattctcaggtggtaaaataattattccataatccagtttatagctctgtttggatcagctctatttgcatttttaatgtaatagtgaccactgaaaacaaatg

SEQ ID NO: 48449 - DNA, 1501 bp, Oryza sativa; identical to SEQ ID NO: 30350

SEQ ID NO: 48450 - DNA, 318 bp, Oryza sativa
ccattgggtgattaacttaggcatgacattccaattggtgcatcgaaatgattcgacattgaaattaagcgacaaaaagttatgcccatgtgcacgcccaacgtttgatcggtgaaatgtagctgtaatgcatttgataaattggagtcccacaaacagatatataaatcacaacatcgcttgaaacacacacgggcaacactgacgcgcctatattagcgtattggcaacttacgatcgataacgcgaagcaatcaacagaattagatgcccagaatccaactactctactcaagaaacatcaggcaatccaccgac

SEQ ID NO: 48451 - DNA, 1501 bp, Oryza sativa; identical to SEQ ID NO: 30330

SEQ ID NO: 48452 - DNA, 1501 bp, Oryza sativa
attttagaaatgcacgagaggaaaggccagatttggaggggaaaaaccgagccaattcggcctcaggtcggctgcctgaggtttgaagaagaacagtgcacagggaagcaaagtaaactttcagtcttgggccggctgaaaataaaatagagaaagaaagagaagggggaagctcggctgtgctaactgggctgcacaaccgtgctcccaaaggagggagatgggctagaatcagtccaacggcttaggggaagattaaaaactttttcaattaaaataattcgtaaaatgatgtttcatttattaaaaatactttccttgctcaaataattcacagaaaaatctagaaaatagataaacaagcaaagtatttaatgaaattttatctaactcagttttatgttgctatttttcctagattattagagtttaacttgtaagcctttaaaataatttctaaaaatgtgttacagaatgaattattaaattaggcgattttcagggcgtgacaagcctacccctcttaaacggaatctcgtcctcgagattcagaagaactagcaaaaagatgagaatgagctgacttcaattcatcttctcgctcccaagtggcttcttcttctgaatgattgctccactgaaccttacagaaccgtatgatgcgattcctggtgtttctcttattcaccacaagaattcggactggcttctcaacataagttaaatctttttgaagctctatatgctcaggatctgcttcctccgtaggtacacgcaaacatttcttcaactgcgacacatggaacacgtcatgtattcccgccattgacggaggcaactctagttgataagctacttcacctctccgactcacaatcttaaaaggtcccacaaatcgcggtgccaatttccctttggtctgaaaacgatgaactccccgcagcagcgtaacccgtaggtatacataatctccttcttcgaaagtcaaatccctacgacgattgtctgcatagctcttctaacgtgactgggcaatacgcaacctttcttggataatcttcactttttcttctgcctctcgcaatatatctgtcccaaaaacttgacgctcaccggtttgatcccaaatggagcggtgtacgacactttcgaccatacaatgcttcatatggagccatttgaagactagcttgataactgttgatataaccgaattcggcgtacggcatattcttatcccaacttccaccgaaatctagaacacaggctctcaacatgtcttctaaaatttgattcactctttttgtctggccatcagtttgagggtgataagtagtactgaaattcaaacgagtacgcatctcttcttgtagtttccgccaaaacatcgaagtaaactgactacctctgtctgacactattttcttgggaacaccatgtaaacatacaactcttgccatatataactctgcaagcttatttcccgagtaggttgttttga

SEQ ID NO: 48453 - DNA, 329 bp, Oryza sativa
ggcgaattcgagctcggtacccgtctaatatgaaacacgggtgagtacgacgacattataagactacaatgattaaagggcatcacaatcaatgaatcaaatcaaacccattaaaaaacaaaactcaaaccaactagttactcccaaaggagaactggagatcgtacagtcgtgcaagtttctgtttttattgattaggattatacttccaagagcacggcttgacacatttttcacatatgccatatctctacactacacatgacgcctatttcattatttaaaaatatctacaccacaactatcatattcgcacgaacagagaggta

SEQ ID NO: 48454 - DNA, 379 bp, Oryza sativa
aggacaatgcgaacgaagataatcaattgaaccacattcaaagcaacgatttggaccacctcttttcctgttcctgacattattcatagctcgagcaattctgttagcaaccaaagccaaatcctcctcctcgatttgttcgagttgataatcggatgtggcattaaaagcagcaagaaaagaaggcatagatgaagaagcatcaacaatcaaagaagaagaagaagaaaccaaaacactcgatttagaatcaactttgcgagaaagaatattcatctcatgtgttttcaatttagtataaagtgaatccaaagtcaaagtagacatattaacagactcctcaatagatgtaactttcatctcccaaatagacatgtcg

SEQ ID NO: 48455 - DNA, 1501 bp, Oryza sativa; identical to SEQ ID NO: 30339

SEQ ID NO: 48456 - DNA, 852 bp, Oryza sativa
gctgggccttcgctgcccatgtaataaattatctatttacgcttgggctggttaaactctgaattgtatcaacttttggtgtacctggcctcctgggacaaggattaatgcacgcacacaaggaacgcccgttgggtcagttccggtcgtgacataatgtttctaagcaggctaagcaattatatctaatatctagttgaaccaatataaataaagctcaactagtcaaattgtaataacccaaggtatgaaggaatgaagtaatcaagtacaaaagggccataacaaagaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagaacaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggcttaaattgaattatgacgcaataatgaattatttttgaaaaggaaaagaaggtttattgcgtcagcgggctagggtttcggtggaccgggcgcacgggcggcggttcacacgaacggacggccgagatcaacttgatccaaaacggacggccgagatcgatcgggtccacggcggctcacggcggacgaccccga

SEQ ID NO: 48457 - DNA, 795 bp, Oryza sativa
aggaagagttcttcaatgaggctgatggtgtggaggagtaggtgtagccttggtcaagctgcctgtggagtgaagccgtctacgccgtttaatttatttttccgctgcttagatctttattgattgagaggaactatctacctctgtaatgacattttatacgcttattaattagagtaataattgtactctattatcaatttgttattgtgtgcctcggctaattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatacacttcataatcccttttaatggttctcattcaaaatttattccagtgttattagtaccgtacatctattactgtactaatggcttatttatcagcaaaagttttacaatattgttttatttaatcttgctgcaataaaataaagttagcatgttgattttataactttcttttatttcttttgaaacctgttattcaaaagtacaaaatttgtgaccttgtttccaactgttttaacttatcttgcaagtttggtttactttatttacttacctttttactctgatttttctaaactttattcaaattaatccaaaaacttgtgctgttaattggatagatgtcttaactccctcctttcacttgtctttaga

SEQ ID NO: 48458 - DNA, 1501 bp, Oryza sativa
gaccctaggttatgccaaatggttacccatagaagccctctaaaaatattggaaaagtagaactgttctcctccctttctcttttaattaaaccaaactaatggcacatacacttcataatcccttttaatggttctcattcaaaatttattccagtgttattagtaccgtacatctattactgtactaatggcttatttatcagcaaaagttttacaatattgttttatttaatcttgctgcaataaaataaagttagcatgttgattttataactttcttttatttcttttgaaacctgttattcaaaagtacaaaatttgtgaccttgtttccaactgttttaacttatcttgcaagtttggtttactttatttacttacctttttactctgatttttctaaactttattcaaattaatccaaaaacttgtgctgttaattggatagatgtcttaactccctcctttcacttgtctttagatgccgcgctacaagcctgagtacctgtttggtgttgagggttttgtccaggagttgcgtacgatgtcctttgtcataggatttgggactgcccctttttatgctcagattcctcatgatcgtcatgaagagaagtgccgagtcaaagtcaccttgaatagtaatagtgaagatgtcccctcagtgatgttcgaagctggaggaagaaactacatccatgcatgtcaggaagtggcaaggatcgccataggagagctccgtgatcgctacagtgatcggttggctgacactgagtatcgctaccatcctcgtcaaccacagggaagtgaccgtggcagctaccttgagactgaaggaattgagaatgatgctaccacaaggcatttagttgagatgctgtgggctatggatgaaagccgtgcagagactgtgttagcggctcaagatcgtgaagattggaatcgtggtaagatttgcaagttagaagacaaggtggatcgtttggagaaggaactagccgcgttgaagggagaagcaccaccgcagaaggccaggattcgtcttaccgcaaggaagagagctctatttgtccctcgctatcaattggcgccaaaagttcgtgtggtggagaaagaagttgccccagcagatcctccggtcatcatcataagtgatgatgaagaagaagaatccaagcgcacccattccaagattgagtgggtagcaactcaagatgatgaagacgagccgaacgagcctacaatcgacctccgatgctcggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctatcctaag

SEQ ID NO: 48459 - DNA, 1501 bp, Oryza sativa
acaaggaaaataaatgcttctatagaaaaatgtccagcacattcacttgtataagctaactctaatataaaaactggtgatacacgcacatgtgcatccgaatcaagctatcatatcgcccaatcggaaataataggtcagaaatattgatgaaaatgcatttatatatagttggaggtaaagacacgttgtttgttaatagggggtgtttagatcgaggggtgtaaagttttggcgtgccacattagatatacggacacatatttaaagtattaaacgtagtctaataataaaacaaattacagaatccgcctgtaaattgcgagacgaatttattaagcctaattaatccgtcattagcaaatatttacttagcaccacattatcaaaacatggagtaattaggtttaaaagattcgtcttgtaaattagtcacaatctgtacaattagttatttttttagtctatttgatctgacaggataaaaatttttgagaagggatcaaaacagtgcctaggagtattaatttgaaacggtgttttcagacatcccagcagtagtcagatcaatctgaagttcagtactccataatctcgaaaaatgtgttcgcttaaagaacatgtcacctggatcgtgatttgcgaaacacactaaattatctgaaagagtatactatcaatcttgtgtaactttaattttttagtcgaaaaaatgctatatattcaacattaaaatgttaagaatgtctaattaattatatattgaagacaatgccaatgtttgaaatactatgttatacttatatatatttaaacaaaatgaataagtgaatatgattgtccttactcttgtcgtgtacactacaacaaacataccttgtaaagatatttttcttatactatacatgcacttttaaaatgcctttaaattagtatagagacatttctgaaataccttatgatcaacatactgtcaatataaacgaagatgcatttataaaatgttttccagaggcatgaaattatacacaaccatagaaaatcaatgtgagaaatattgataaaaatattatcactggctactattgccaatttttgaactcaatatttcttcagtaaatcgtttctatattcaatgcattaaccatcttaatatcgtatcattactgataaatgtgtgccctatgttacttatatatagttagttggcatatattaacatgggttcaaatcctgattaaaatgccttacatatcaatcaagtttttaattatagtaaaaatatatctctataaaataaattcaacaaaattagctaaaatatctgtcagtaactcctgctgattcaatctggcttgtaggtatcatcatataacttttagtgataaaataagtcacaattatcaaaataaatgaagcatatataacttatttaaataagatgaattatcaaacgtcatactaaaatccaacagagccatgtactaagatattaacaaaa

SEQ ID NO: 48460 - DNA, 218 bp, Oryza sativa
  unsure (1)..(218): unsure at all n locations
gtttgactgcgacaccataatgangtgtgtgaataagctatgacanggtgactctcncacttacacatataatcatcgtccttattctcataatagtattcgttattctctctanttcctcctcccnnccnccncccccaggaggtttggatttgcatttgcanctaccgcaagnagcncatcactcaacgattcgctccgattcttgggggaaaaga

SEQ ID NO: 48461 - DNA, 1501 bp, Oryza sativa
tgcgctccagctccgcttggagctcccccgaggtgagggcatcggcaggcgggccccgagcaggcacaaggccgacggcggggctactcggcgtcacctcccggtccctagtagcgaccacgacgtctgtcgaggccgtcgcaggggacgcgctggtagttgcaccggtcccaccttgcgtcgccttcgcccgcgccgccctgcgaagagttttctctttctcataaagctaggtgatcaagaattcgtgaataaaaaaacttcaagaacgtctacttacttctcgccgattgtcacatgcctttgcctccgttgaggaggagttgacgcgtccgagggctaagtgagatacgacggtgtgaggtccagtcatttcgacaacgtgttaaaaaacaagagagacttaccgccgggcttggtgccttccgactggtcctgagtacggaggagaatttcctccccttcttcgaaacgtagtttccactcgtggtagcagcagcagcagcgtcggacgcctctttggtgacgccctccttcaacgacgtcgccgtctggtggtccacaagtggcccgatgacgtccgtcagagggagagcctgcataacatgaagtcacaatgcgatcttggggagaaagatgtaaaggagtcatcgagtacactcacgttgatcgcagcctcgcgttcagccggacccttctcccaaagggggacggggacgtcgctcgctgtcgctggggcgctgatcatcacctggccgacgcggcgtgccacggtgtcgctgtccaaacctgtagatcgagaacaggaactcgataagtcaggagaaacaggcattcccagaatgaaatctgaaatacaaggaaaaataccccgaggagagacccgagtcgtgtcctctggcccataatcgaaggccggatggatgcgggcttggagcggttggatccgcctacctacgaagtcggcagcgactttgtaccccgacaacccccgtattcggaggtcatcgatgatgtcgatgaaagactggagggagggagtcagggcgggtttggtggtccactctgggatcttgtctggttgttcttcagggacaacaaggacaagatctgagttctcttgtcagggttacggataaggtataccctatatccttggacatatgttgtatactgatacggtagacccgtgcatatatgaataatttctgtatacgttaaggaaatctatcacgtaatagaaacaggatccacaaatagagggagtcctactcggacaagactgggtctttaccatatcgtgaggggtccgatatctctgagtcctatttggagatcaactgacccgctgtcacgcccagaaattcacgaaccagaatttctaagctgaatgtgcattaatcccctgtccaggaccagccagggtacacaaacgacaattgttgatatacagatccacgtcttacaaaaatatattagattacaaatgtagcggaaaagg

SEQ ID NO: 48462 - DNA, 1501 bp, Oryza sativa
tgggcatcctaggcttattgggacacaattcggttttctcggttaattcggttaactgagagcaatgaccgaattacccgaataaatttcagtctttcaatggccaagaccggactactaaccgaatttctcggtcttggtgtcggtcttttcggttcggttcttcggttcggtcttattttgcccacccctagttacaagcccatagacccattgtaggtgatgtaacaccttgtttctgtgattgcgccaaacaagatggaatgcgccaaacaagcccataggctcattgtaggtgatgcaacaccttgtttctgtatagtattttctttttaaaaaaattatgggacccatctgtcatacatctccttcccctctctctccactatctctctcacagggcgcgcatgggtgggaggtgggcggtggcgggggcggctgtgtggcgagcggcaacggcgacgccacctcctcaccgcaaccgctctgaaacgaccgacatattccacaagaagagtagaatataagtctatagcatatatcttcataaacatcgtttactcagagatatgcacatcagagtagcatagcagaaacatcgtattggttccagttattacaataccatagatacagctcaagacaagcctcgagcgataacagcgtaataatacacaaaccctaaaagctcagcaaatatgcagtacactagaaattcacaagtactgctacagatattgctactaaccatattaacgttactgctactactacaaatactactactgccactgctactaccatagccactacaggcactgtatgaaccatgcatatcatatcataataaacttattgtttttgccgtcgctacgtggccgcattcctcttgctacagtgcaacagtgatccctccgttcgtagccgcacgatctgatacgtttcttcgatctagttatataaaaattattatagtcaatctcagcattatcatagtcctttctggttgtcatccatgacttgagttccttcacttccaaccaaaattttcattagaaattagggccgtgtatagttctttgggccaaaatttttttaattatacgtacacacctttgaagtattagatgtagactaataataatacaaattacagattccgcctgtaaattgcgagacgaatttataaagcctaattaatctgtcattagcaaatgtttactgtagcatcacattgtcaaatcatggcgcaattaggctcaaaagattcgtctcacaatttacatgtaaactatacaattaatttttttcgtccatatttaatgccctatacatatgtccaaacatttgatgtgatatttttggccaaaaatttttaggatctaaacacacctaggttgggaacatagagtatgttacgaccgaaatggcaaacaataaacagtcttcatcagcaagcaatgcagcagtatatacacacaaggacaggtgaggtgagttg

SEQ ID NO: 48463 - DNA, 1501 bp, Oryza sativa
acaaacatcaagcattctttcccatttaccattacacacttagacacaggacttccacccgaaaacccgagcctgtatccatccttgttaggatgagcggtgatggtcttgtaaagggcatctaatgaatggtatgccttcatgcatccatatttcaccaatgtgcccaacctttcattctctttttaagagcttgcatatcatcaatattagtagcataagagttcaaatcaatattgtaccacctagcacaaccattgctagtagaagggttagaagaattagaaaccacatttggttgagaggtgctattccaaagagtggcaaattgaacttcaagatctttatgacttttgtctaaattagcaaatttttcttgaagagtttcattgacatccctaaggctagctaaagaaccattagccaaattaagctcattagcaagttgttcatttttagcacattctttagctaagctctcctctaaggcaaggtttcttttcttctcaagaataagcaattcttcttgcctttcgagtgactgttctttactatccaaagctctcattaacttagccaaatgttgcatagcgggtttgctaaagctcttaagcacatcatctaattcattatcactttcctcatcactagaatcaacatcaagagaagtttcagagggcttttgagtcatcaccttgcggccttgtgccatgaagcaagagtagtgataggagtcgtcgtcgtcatcactcaagttgttgaagagacgctccttgcttgaagaggatgacttgaaggcgacggtagcaacaccaccttctccttcaaccttgtcttttgacttgggcttgggcttgacctcgggatcttcttcatctctggagtaccacacttccgccatgtgcgcctccgccacatgagcacgctccggcttcttcttgcctcccttcgccttagctttatttgacttgggacaatcggcaatgaagtggccatattcgccacaattgaagcatgctctctttgattgcctctttcccttgtcatcatccttcctccctttgccatagccactcttgcgaagaaagtgcttgaatctcttgacaataaaagtcatttcttcatcttcactttcttcacaacttgactcttcttcttgttttgccttcaaagaaacttcttcaccatttgtctcacttcacgactgtcacaccctgaagttctcctcctaagcctaaaattgaatttataaatcaccctaagaaaatgccggtgcaaatcaagagaaaaccttaataaattaatacaaataataatcggaattggaagtggaatttttcttgagttctacatgtcgaaatacgctaacaagatttttagtggaattttcagagctctcgaaattattttaaccaattaaaattgagcacatgcaattttaatcccaggaaaaatcatttttccttctttttcctttttctttcttttctttttttttctt

SEQ ID NO: 48464 - DNA, 1501 bp, Oryza sativa
caatcaaagagagcatgcttcaattgtggcgaatatggccacttcattgccgattgtcccaagtcaaataaagctaaggcgaagggaggcaagaagaagccggagcgtgctcatgtggcggaggcgcacatggcggaagtgtggtactccagagatgaagaagatcccgaggtcaagcccaagcccaagtcaaaagacaaggttgaaggagaaggtggtgttgctaccgtcgccttcaagtcatcctcttcaagcaaggagcgtctcttcaacaacttgagtgatgacgacgacgactcctatcactactcttgcttcatggcacaaggccgcaaggtgatgactcaaaagccctctgaaacttctcttgatgttgattctagtgatgaggaaagtgataatgaattagatgatgtgcttaagagctttagcaaacccgctatgcaacatttggctaagttaatgagagctttggatagtaaagaacagtcactcgaaaggcaagaagaattgcttattcttgagaagaaaagaaaccttgccttagaggagagcttagctaaagaatgtgctaaaaatgaacaacttgctaatgagcttaatttggctaatggttctttagctagccttagggatgtcaatgaaactcttcaagaaaaatttgctaatttagacaaaagtcataaagatcttgaagttcaatttgccactctttggaatagcacctctcaaccaaatgtggtttctaattcttctaacccttctactagcaatggttgtgctaggtggtacaatattgatttgaactcttatgctactaatattgatgatatgcaagctcttaaaaagagaatgaaaggttgggcacattggtgaaatatggatgcatgaaggcataccattcattagatgccctttacaagaccatcaccgctcatcctaacaaggatggatacaggctcgggttttcgggtggaagtcctgtgtctaagtgtgtaatggtaaatgggaaagaatgcttgatgtttgtgagagaaggtaaagcaccacaagcaagtgaggtgactagtcttgtgagctgccagggacccggaacatccggacaaaccgggagaaacatccgggtgggagtctctgtctctcaaaaattcccaccaggaagttccggccagtttgccaggaagttccgggccaatgaccatgcacaagacatgaccggaagttccgggcacaatgcctggaggttccggaaagagggtctttactatgattcatatgtaatttccaaaaattcatagggcaaagtggttgcctattttaatgggaattacaatgatgagtaccgcacttgtgtgtgggtgccaaaggctttggtaactaacatcaagggacccaaacttagacaagtttgggttcctaaatcccaagcttgattttcttgtgtaggcatactcctccgatggttcaagttgggttgtggacagtggttgcaccaatcata

SEQ ID NO: 48465 - DNA, 1501 bp, Oryza sativa
gaaagttgttgagggcggcagtggcagtggcactcgtacttctcccaggtttacaaggcaatcaagcaaccgtcctgttcagattagggatgttgacagtggtcaaggaagtgatgcacctaatacaagaggacgggggagaggtggttgtcgcagttctagggctggaagggcatctcatgatttccctgtaggatctcgtgagaatcccgttcggctctacaaaactcttggttttgacaccactcctttgcaccacattggaagacccaagtccaactaccttcatcaacttgccaagtgtagaagagatcgtttgattgatccagagacacagcctgaggagtcacaagatcctcgcttaaggactttcactcaattggattggtataactcggtgattatggctagagaaaatccagtggttgagatgaagtggattgattgggcttacatgaggaagaagaacaatgaagtgttcaaccaagtgatgcaagtgtgccacaacaagaatcttggagatattcttgccttggagtatgattggaatgaggaggtcattgcacagttctatgcgacagcattctttggtactacaaggaagggaaccccttatgtgaagtggttgactgagggtgttaggcacaagatttccatggcacagtttgctgagatgttggggttagatgatgaggatctcaataggcccaacattcatagtgaagcacccctccccatgatcaagaccaagttcatgtatgcaaaggatgctcctaagacttgcatgggatctactcatggattgcatcccaactacaaggtgttgtactccatctttcgttggtctttgcttccaaaggttggaaatactactgctttgctatccaagcatgctcatctttcagtcgcatgcgctacaatcagcctcccttcagtgtgatgaaattgatttggtatgagatcgccaacaccattcttgagcctaagcggggttgcatctatgctcctttcattatgaagatgattgagacagtcaccggggtattctacatcaaagatgggcaccataatccttttcgccctcatgctccaccttcctcttctccagtggtccctcgatctgttccttctacttcagctggttcttctactagtgccccaccaagttcctcgagttcttctcccatcaagaaggcacttcaggcaattttctgtatgtgtgctaagactgccaagaaagtgaagaagatcgaaaggcgtcagaaggaagatagaagattggctgggaaagaagtgtcagatgattctgaggatgaggtctatgttgatccatttgaggcttatgaggcagcccacaacgttgccggtgaaggtctatccaccttcttcaatgaagaatcttcccattctgatgatgatgatgatgatgatgatggtgatgagggtgacaccgaggcagctgctgaggatgctcccactgatgttgatgagggtgtcactg

SEQ ID NO: 48466 - DNA, 1501 bp, Oryza sativa
ttgtgaaaaagaattacaaaacttgctttgcgcaaaagaaccatagccatcctttgaatacccctgtcatgtgcattgttgctgtggtggcttgctgagtacggttggtactcacccttgtaatatacaaacttaatcagaggtcggagatgaagcttcggaggatccctacgcttactaccaggagggtgatggagacgatggcgctcagtaggtcttagttacggtcgttgcctgtggcaatggcgtgccgctgccttgactctgctgccttacctacttctgtttttggaatgtattccggaccgctcggtccgatgatttgagactatgcctgcgggcttatgatgtaataattcgcactagactctcgtgtatgtgcatttggtatttcagctatgaactcgtgtgtactagactacttgatccagggaaatggtactgtttacacgatagattcctgttataaaaacgggggtccacatgaagggatggggtcaaggcaggcttggcggtccaaaacggaatcttgtctagttgttcctcagggacaacaaagattggatccaaattttctatctgaagatagaaccacctcgcccgccatttgctacgagaagaggggcacttgaaggggatgtatcgcgacttcaggccatcccgaagtcggaaactaacacacccggacacatttttacgttccatccagcgcagctcgtagtagaaacgaaagagatcaagaaacagctctaccccaatgtagacctcacaaagatgggaaaagatgctgaggaaggccatggagttggggttcagatggagcagagaaagaccgtagaaattcaagacgagaaggaaaaactcagaaggcggcgggagaaaaccgcagagaatgtagtcctcaaccgcaaccatgcggcccaggacaggttcaggttcaatacctcctggttccctctccatggtcccgcgaccggggagagcgccttcctcctgcaacttcttcagggacgcgctggtggaagtggacttgtcgaggtccattgccgccggagatcaccggaggagggaccaagatgagcaagctagggtttgtgcgggagcggagaagacgaagagcgcttggaggctaggaagtttttgcaacaggcgggctccaaaatggatccccaaaactcccttaaatagacgcactaccgacgatgcgaattccaaggaaaggagagagatggccgccggaaatttctgggtccgttacacgcggcagtttttggacttcaatttaaattcactcacgaccgttgaacttcgcatggcgtcgtcgattactccttgtctctacggtcctcacgccgagatcgaccagtcgagaacgacaacaaacccgacatcagaagtcgcgatcggttacatgagttcatttaagcagaagtcaggggctactttcagggttacgaataaggtataccctctacccttggatatacgctatacatcgata

SEQ ID NO: 48467 - DNA, 836 bp, Oryza sativa
cacatccttcgtaccaggaaataaattcaatttgcagcgatttctattctgttctggtaaatccaaattcatgttcaattgctaaattaacaacccaagtctaccaagaggtttatacggtgatccaaatacttagtttttgcactctgaatgtgttttgtgtttctgcattttattcacaaggcgagtttgaagtattatcgaccactcctagattgagatgcaatattctcattatggcaagtgaagatgcaagttggcacatctatctaagaggagaagcatgcagaaaacaagaagcacatccaagttgtcaagagagagccttgctcctatctagatcacaaggtgatcaaatttttcggtgaattttgctaacatgatattgttggtatttcttagcgactaattcccagcagtagcactagaaataatcctggtatattatggttacagatatgatccgcaagcgcatggatatatcattgtagcatttcacccgggagtattccaaggtatcgcaagagaagatatgataagagagaactatgctaacaattcatatattacttatatacatcaaagtctatgcaggggttaattcagttcaaagggtagggtgacacacagaagaaagaactaagaactactctcactaaaatatagtttaagctaagtggagaaagaataagaaaaatatcattcctgtacttctagtatacatacatctttagtctatacttgctagtatacagtcatgcaaccaatacctcatacccagtgtcctcctggtgtttcgagaagccacccctgactgccgagttccttacgacagc

SEQ ID NO: 48468 - DNA, 385 bp, Oryza sativa
ggccaaccattccacagtttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtgtacagacggaagacgtgacatagtttccaacccatcctagccatagacaagagtaccgactcaatcccacctacggccggaacccccgggacaggcaggcaggactgagcccctagcagcaggacaccggccctgtgccatgacatctcgactaccgggccgcagctcgtgtagccttcatttgtcctagtg

SEQ ID NO: 48469 - DNA, 449 bp, Oryza sativa
  unsure (1)..(449): unsure at all n locations
ccgctaatgacgcccttagganngatcaacttttggtgtaccttgcctcctgggacaaggattaatgcacgcacgtaaggaacgcccggtgggttatttcaggtcgtgacactgggattcaatatgctcaaagatgatgtgacttgccttgctcgctttcccaaacgtcggcttcaacttccacgaagagcggatcttccgaagctatagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatagccatttgaagcttatatgctctttaattgaatatttgcgaatttcttcatttaaattttaatttaaaatcggatttattgcgtcagc

SEQ ID NO: 48470 - DNA, 417 bp, Oryza sativa
atgccacttcacaaacatgcaaatttaaattcaatttatacaagtggaaacaaaaataacaaatttgactatgaagtgaacgtgcaattcacgatcaaatttattatttttgtttagaattatataagttgaattttaactcgcatgttagcttaaagtggtggacgacaccctcgtcagctactacaagagaaagtcaggaaagagtgagagagaaggaatgagaaagtcaggaaagagtgagaaagaaggaacgagtgtgtctatctcgggaagaggaggcacctcagggttcatgccttgacttaggctcggtttagatggcaaaaatttttgttttaaggtatcaaatcagatatacggtcctagttgtaatgctgccagcggccggctagggcgaccagtagcaggccagga

SEQ ID NO: 48471 - DNA, 1501 bp, Oryza sativa
gtttaattaggcgacattaggtggttttataactctagactttgggaatattcatatcacttggacactatggaatggttggattattgtggaattggacacacacacctcccactctattcaaaaccctcaaaatggttttaggctgggctcggggtgcatggttttgatagtagcacctcggccacataaggaccggtcttcgggcctctattgcaaagcactaccgtacttccacatgtctagtgggttaggcttagtttgtggctcggtctggttataaacaaaggtacacggatggagacggacgaagtcgagggccgatggacatctctaggacaaatgaagtctacacgagttgcgtcccggtagtcaagatgtcatagtatagggctggtgtcctgctgctagcggctcaatcctgcctacctgtcctggaggttccggccgtaggtggggttgggtcggtacccttgtctatggctaggatgggttggaaactatgtcatgtcttccgtccatatgccgtggtggtatgtggcacgtggttacacgtgaggaagacgtgtcttgtgggtaaagatgtacacctctgatcagagtataacctattcgaatagccgtgccctcggttatgggcaagcctagcaatgtacccaagttagtgttttaaattcttaaagcctgcttaacaactaaaatgtggaatggttggcgtgggttggcttgggacgagctgggacccagggtcgggttgccagttcggtctgaatcatcgtaggccttgggttaaggcaggttcgtgtgggtccatggccttgattaataatattgtatagctctaggatcgtgtttacaaagtagctttgagcaacaaagtgacttttaatgctgtttactgcaaaccctaatcccctatattataactcccttgtactcctttgcatttattctgcactcgtgggtgtgtcttgttgagtacggtggttgtactcagtcttgctcaatttttcccaaacccagaagaggtgttcctggatgatgaaggctttggtgtctagctcgtgcctgccatcaagcgcatgtggtcgtcgccctagtcttccgctgtttttcgtttgtcttcatgtgtgctgggccttcgccgcccatgtaataaattaactatttacgcttccgcttgttaaactctgaaatgtatcaacttttggtgtaccttgcctcctgggacaaggaataatacacgcacgtaaggaacgcccgttgggttaattccggtcgtgacacccggtcagaccggctgcacaccctcggtcagaccggcctcggaggaatttttctgaaaattctaaaattgattttgcacgtggatatatgcctattggatcttctggtcgtgtgtctcagtactggattactaaatttttattattatctaacccagtactgaagctttcgacttcttctggtcgtgtgtctcagtactggattactaaatttt

SEQ ID NO: 48472 - DNA, 1501 bp, Oryza sativa
agtcataatctgttacatatttcatagatataagctatcccctatgactagtcggataaccatgccgtgtgggtatggggtacccataatctccacacgaagttcataagaagtttttccaagtttagattgcaagaaaactcgatttgaaatataacatgcagtgttaatcgcctcatgccaaaattttgtaggagttttgtattcatccaacatcgttctagccatctcaaccaaaacacgatttttcctttcaacaacaccattttgttgaggaacacgaggagaagaaaattcatgttcaagacctctttcgctgcaaaattgttcaaatgaagcatttttaaactctccaccattatcacttcgaattcttttcaaagaaccagaaaattcaagctccaatcgaagaaacaaaccacgaaagtgttgaaaagcttcgtccttagttgccataaagaaaacccaagaatatcgagaaaaatcgtcaacaataaccaacacataccactttcctcgaacagattgcactctagctggaccaacagtgtccatatgtaaaagctgtcccggtgcatccgtcatcacagaaacaataggagcatgtgaagtagaaaccatcttagcatgacgacacggggtacaaaccaaatcacgatctttcttaagtttaagcaaaccacgaataagatccaaaccacttagcctagtgagatgatcaaaaccaacatgtccaagtctacgatgccaaaacatcacatctttatcaaacttagcaaccaaacatgttatcacaggtgaaacaggattttcaaaatctgctttaaacactcttccatatcgagaaatattcagcacagaatcaccatgagaatcaaaaactttactttcagttttcttaaagtgaacctcaaactctttatcaacaatttgcgaaaccgaaagcaaattggactttaaatcctcaaccaaagctacattcttcaattcaaaattttcatttacctttaccaaacctgtagtgagaacggcacttgtagaagcatcaccaaagataattgattcagtattagatgccttctttagggaggagaaccaatttttatcaccggtcatgtgccgcgaacaaccggaatccacgatccacacgttctccttccttgccaccaaagcctacacacaaacagaagtcgaagcttcagtactggggttagataataataaaaatttagtaatccagtactgagacacacgaccagaagaagtcgaaagcttcagtactgggttagataataataaaaatttagtaatccagtactgagacacacgaccagaagatccaataggcatatatccacgtgcaaaatcaattttagaattttcagaaaaattcctccgaggccggtctgaccgagggtgtgcagccggtctgaccgggtgtcacgaccggaattaacccaacgggcgttccttacgtgcgtgtattattccttgtcccagg

SEQ ID NO: 48473 - DNA, 176 bp, Oryza sativa
tctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataatttcccccccagt

SEQ ID NO: 48474 - DNA, 276 bp, Oryza sativa
cccctgatgacactcgcttgtgccatggatgaaaaaaggactttttagggtttttctttttgtaaaacctttttaactttgtttatttcttaataattattatttgtgctctgaaaattccactaaaatttatttacgcattttaggcttttaggaaatatacaaaaatcctccaagccttattcgacttttaactttgcacattttaattgttggaggctttcacacggattttaattattctaggcataatttcgaggatgtattttagagtcg

SEQ ID NO: 48475 - DNA, 967 bp, Oryza sativa
ccccttctctgtctccccatccctaatatgtttcctaatatttcagttctgttatcccttttttcactttgcaatcatttcgttggcccaatatttttgtgccatttgatgctaatgttgataatctaattcagtgcttgaagtgtccatctccatagtatcaaatttgaaccctgcccagaattactatattgattgcagagcaacaaatttgtgaaaaaaatggaagttaaaacaaactgcttatgtgtgttgatcatttaattgttaaagaagcaaaaagacattctttgtcaccactggtttgaaaaatcaaaatgtagtgtaacataagcttgggcgatttgcttctaaggttgagcagagtaggaaaaaaataagtacgagttgtcacgcaggtagtgatgggatcaaaacaaatttgcaaacttagttactgaaaaatttcctgtcaattgttgttcatttaaaatataacaaatatgctttttttcttgactctccgttgagaaaaatatgatgtcattatatatccatatgcagaacaacttctatcaagggcgttgcctcgccgttgtttcttccttaaggaatcgctggtgattatccattcccgtatcactgcaaacagctgctactgtcccttcctgtatctcattccctgaattgaaggtacaaccagtttcttcactattcccttaactcctacatatgggatctgaagtttttagatttttcataatggtgttcctatttggattgtcgagttttcagattttttttaatgggattcctgtttaccatgcaattctgaattggtgaccaaattttataggttttacatgtgtgagtttatcactggtgctgctgatgttatagtcaaatgaacactgcattgctaatatttttgagttcccctggtgctcctgctgcacatgcccatgtattctatcattatcctttaaga

SEQ ID NO: 48476 - DNA, 258 bp, Oryza sativa
  unsure (1)..(258): unsure at all n locations
atagcncctttgaattgattgcccgtcgtgtgatggatatcggcactcttcaccagcgctacccggacgagttgcagcactcgccctaccgcatttagcaaagatttaagataagtaaaacagtagagtagttaatcatcaattttaatcaacactaaacagcacacccatgctgcttaggcccaaccaaacctgaacaaccaaccccggtcgtacagatcaaacctccaaaccatgaattattcattccaaaccagg

SEQ ID NO: 48477 - DNA, 186 bp, Oryza sativa
aacctccccgtcccgtggcggctggagagaggagaggggagagagggagagatgaggaagaagggtagggtgggaacgacatgtggggcccatgtgggccccaccatttttaattattttttatgtaactgatatgtgggtcccaccagttttattatttttctggatgaattgccatgtaagcgc

SEQ ID NO: 48478 - DNA, 1501 bp, Oryza sativa
ataatttatcagtacaaagcaatcgcacaacacttatgtttgaacaaccaagcgaatgaaagccacaaaagtgaaactaaaataaatatttagtgttaattcctttctgaaagtaaaaaaaaatagaaatcaggagaatatttgtcaccaagtgatgaatgcagagtcaaatgttttccttttggaattatttcagaacgtgtaccacgaatgagaaagtttttttttttcattacctcaaccatagtcacataatagaactcacaaaaagaaactaataagccatatcgcctttgaatctcaagtctgaaaaatggaacatcctttttttttcttactttttttctttgcttttcgggtgaagacatcactaccttggtgcatcatgcataacatgtagacacatctcaccactgtaagaaaagaatagaatgagtagatgacatgggggccaatccatcccatacccaaactattaactcggtacagtgatagatgtatcacgacctaacactcacactcggacaacctcacttggcattgggaaaaaaaataaagaaaaagtcccctcctctaaccactttgcattgcctatacggaagaaaagttacctattcttaaaggaccattgagtcttataggatacaacattaattacttctataaaagagattaacacaagttagagccatgatcaaactagtttaactaaggtctagggaaactaaaactttatcatgtacactcacacacctcaagtataactgtaacaccccatgttgttctccctaatagctttccgaatatagttatgcgcaaacgttaatctccacactatacaccacaccaacgaatcaaaactgaataatttttttatacctcctagctttacttattatgcaatcaggtcttattcgtagaagagcatatatatatatatatatatatatatatatatatatatatatagtaacaacataactccagaaatcacaaatacaatgagatagagatcagtaatcgataaaataaatcagaagtgtgatgcaaagaatgacccaaacccatcctactgtgcaccagtgtgtcaaattttattggtttaaatttaactcaaattttacttctatttttcccatcctaaggaaaacatgatcaatattttaagttgtcatatttacttcccatggacctactgcccactcacataccaattgtaacacaccagataaccacgtaccaagagtgccacaccaaaaaccactcaaaccactaacttccaaaattattagaaattacggcagagtctcccctgtaaatacggacatccacgacagacaattataagttaaactaataacaatatcattcccacaatacgatccatccttataatccatggggaagaaaatattagaaatctaaaagattattacaagaccaaaccaggatataatttaagtgtcattttgaacctgagcctgtcgaacaaccttgtgtg

SEQ ID NO: 48479 - DNA, 1501 bp, Oryza sativa
atggaatcaatatcaatggataggcttgagcaacaatatcggaacacagtttcaacatagcatgctatgcaatttatctacaaacaaaacatttcgcaatttgattcaacatgttcgaataagggggcggtggactcaaccttagctgtaaatccattttcattataagcagaaattccaagtcctcgctagcaagccaaattagtagcaatatgaggttgacacttatctataaagtgattataggcctaataccaaggagcacaaaacccctgatttattcttcaaaatgactcagttagatgaagatgtcatgacaatagtgaagttcgatgactatgctcatcaaactcttcaagccaaccatctctttggtaacctggtgaaccacattagtggctacatccaggggtcgaacgacttggattattctgagcacttcacacttcagaaagtcatataataatatgtggtggagaatgcgttaacgcgcaacggctttcgtgctagttgctcaaagaatcatataaaaatttataaagagtgaattccactttaggctaggtttagttacctatgttgcacattagaccaggcattaccgtattagtaagcctcttcacctagaactaggtattgttaccaattttgcaccttgtaccggtggcccacatgtcattggatcttccttctccttcttcctcaaaactccctgagcccaactctctatccacactggtgagctgagcttgtctcttcagccagtaccagcatatagcggccggccagctatcccctgcagacctgctccaactcctattacacggccagctacagccttgcacaagtgctagcgagcacacaagatgaagaacaatgagattgaataattgaatcaatgcatgcacagggcagcctgagaatgggtgattgtacgaacggtgctggagcagagccactgcattgtcagctctcctctatttgcctaggacttaataatttcctccaaatcacaaatcgatcgagatcgtcgcgaccctcggcgaaggtcgagcgtggctgcagcgctaacaaagtttgagcgcgcttagtcttctcatccagcctcccctctctcacggtctcacctgaagtttgtctagagcatcaagaataaatggagatgaagcaagataacagaacaggagcatcggagcatcgcacaaggtgcgcgtcggcaagattcacttgagaacagcgccagtggaagaactggcccaaagtgaaacattaatgtaaacttttctgctccaaagtaaaaactgagttctatccctagtccaagttgtaacttaagtaaaatatagtggtccaatatgaaatttactctatagaaatcaagcaattaaaaggttatggaagtgcattggccatgggactgtaaatcctctttccttcactgggcctgggccctttgggactgttaaatcctctttccaaacggagtgtgtggtttgattcc

SEQ ID NO: 48480 - DNA, 344 bp, Oryza sativa
  unsure (1)..(344): unsure at all n locations
cgggcctagatgacancctcttgaacagctatacacctaccccgcttcttctatttataaaccccaaaaaagaaaaagaaaaaaacaacccccacgtagagaaaaccacccgcgcccgcgcgcgagttgataaaaagcgcgcgcctcgcctcgcctcttccactctctccaccactcccacccccgcgccgccccggccgccgccgccgccgccgctcgccggcgccatcactaccacatgacacgcgcgcttcgtctcactctcacctagctacagcttctcgtcatcagctcgccggcgcggcgcgacgcggcggcgaaactgagagagagagagagagata

SEQ ID NO: 48481 - DNA, 1501 bp, Oryza sativa
cgagctctgctattcgaatagattcggtttactcacactgcagtggatgtacactttacccgcactccgcgactgcccaacacatgagcctcatcccaacacatgagacgcgtcacggcaaagcttttcgataacctcgcattggcagtacccgctccatgaactttagccctcatgcactctaggcgtcatatgtttctagcagtgagaggagttctggcgctctcgagaagggaaaaacacacacactcctacgttgcttcttgtcgttgaacccagtccatcatgattgttctcttatgggtatccttatgtagtattgccaagccaacctctgaccatccggaacgggcatccgccatccacctggccatccgaaccgggcatccgccagcagactgcttgccgcatcacacacctaaaagaaaaccactatgcagggatactgcctccgctcagctatctactccgctaggtctatacccatacgagaagtgcggttgtacgggggtcgtttcatgcttaacttcatggctcggtccttaactgaccagggacggcactagccttttccggacaccacccaaatcctccaaccgcccagtcgaaaacagttgtttaactttattttcctttcacaaatcatgtcatcaatatcatggcaatgtggcgctcatgtctccacatgccgcatctcaattaccttcccaaaggtaattgcccaagcatatagcatttgataaatatgagtatgcatgattctagaatagcattcctaagcaattgtcataattgactagggactcatacgtaatcatggttacaaggattttaagggtaaacaataatcaaggcatggcataatcacaagtaggatgtttatcattgcatgcaattttatttgtaaacaaaacaatttcgcaattgggatcaacatgttcaaggaatagtgatgacttgcctacttaggatagtccttattctcgatataatcttgatcaaccttcacctcctggaagttgcagacgttgcctcacgactaaccgatacaccaggtctataatacgcgagaaaaaccaatattcaaacaacaagcaaatatgcacaagcaaaagataattgttggggttgatcctagggttgctcatactattcgtgtttgctaatggatttcaatcatgctagggctaaggcttcttaatctttctattgtcatcgtggtctatttaggagttaaccaacatagcatttatgggatacatatatatttggctaatcggtggtttagtctatcaaatggctatggaaggattatggctatgtatgcatctatctaaataggacggttatatactagaggttctgttgttagatggatttaggatcggtcaaataattattgtgaatcatttgtattattattttattgatggaggctttattttaattatgtacatattttacttgtcaaaataaattataaaaggttaacaattaccca

SEQ ID NO: 48482 - DNA, 1501 bp, Oryza sativa
ctactactacgacttcaaacctcctcgacgacagcgtcaaccccgatatcaaccagggagcttcaacctcaacgatgctggtgtgcactcaagtcggcgaaatcgtcttcccggtctacaccacgatgccgatctcgactggcccagaaatcaccaggatcaagaacgatgtggttacgaccccggtcgactccatgtcgaaggatcctcccacaggagcggagaacggaacatcgacaacgtctgcacctaagaaggattctaacgcggccagttcttatctttccaacaagaatcacgagccgacgaggacaacttccgaggcaacaagaatctggtgtcctattcacaagaccaaagggcacgacttgcaggcttgctcggtttttctcgacgtacaagctgaaatccgtgcctgcagggagcgtggaattcgacgtgcttctcccactcgtgatgttcattgtcccattcacaagacaaggactcacgacctctcgagctgtaaggtctttctcaatgccatgaagacgtcacctcctaaggtccaacagtcaaaaatctctcctagagaggcggacaaggaacgaggagcggctgctgtctcagatcgattcgtcagggtaatcgatattgatccccacgagccatctgtcttacatctggtcgaagatcaggcctcatcatcaacaagtacaccacgcgatgtatacgccatcggtgggactagcacgtctgcaggtggcaacacagaagcggaggatcaattggctacgccggcccaacatatcagaaccatcaacgcaatactgagggaaaccccttatgatcccgtcctgaacgctgatctcgatcagtggacagaacgactacgggaatcagtggccaacttcagtaacacattcgaagaggccgctgccagggcaccaccagaacaaccgccgactggcagcctaacggggaatagcctgaacagcgaatgccgcctcgtcaagccacccctccgcctcgtggcaccagtgatctccacgaccatctaaaaggtcgccgataagtgcggcgcacgcaagacaacaacaattgttcctgacatcgcgtctcttcgcgacatcgcgagaacgaagaccaaggaggacatccgagcgagagccgagaccgtgatgatcgccacaaccaccgtgaacacgctaatcgtgagcaacggatgtcgggcgatactggtcgaggacgccatcgtaatgatgacgacggcggagatcagtgccgggacaacaacggtgggcgacgacaaggttctcgagaacccgaacatgatccttgtaatcgcacaccggaaccgagtgactcgtcgtcatcatcatcatcatcctcatcatcctcatcatcttcgtcatcggacagacatccacgaaggatgtatgatcgccgacaacccactgcccccagcggcgggtgtagggctttcagtcgtgctctacgagatgtccgatggcctgagaga

SEQ ID NO: 48483 - DNA, 1501 bp, Oryza sativa
gaggaacaacatcggcttagagtcagcatcggcttcgaagtcttgagattagccgatgagagttgtcaagccgttagttgtcggattcttgctatattcggttaaggaaattgatctactaaaggaagcttatccagaagagaccgagttcaaagagaatgcggcatggcaagttatctattaattaggaatagtttgttagtttccttttatctttaggaaagtgtgtttagtgtgctataaggactttatcttttccttttatctttaggaacgtttctttcttggccgacaaggacttgtatcaacccatgggtataaatatgtacacccggggtctatgtaatcatcgctacgatcaatacaattcggcgcatcgccaccctttttacttctacttttgtttttacgttcaggcggaacttggcacccgacgcggtgctgcattgtcttcgatcaacggcgcaaggataagtccaatgttccgtcggcccaggcaattatatcgtctacgtcggcgtcgttcaaggctgcatcaatacattcgacctcttggattgctctggtttggatgatatatttgcctaaccatttatcatatgtctttgttaatctagtcttagcatatcaatttagctctatcggctgcttctcgttttagggtttctgccggtatcggctaaatcgcgttgctatattagattagtttagacatctaccaccctgaaaatcagtcaacggcttgattgtctggatattatgattcttttcatacttagtgctgcatcagttaagtttgatctactaagtcatacttagaaccataatctctagcctgcttcttgattgccaataagggtttcatcggggtttcagccggtgagttatctgtatgttgcatcggctcataaggattgcatatacatataagttggatttagcccatgacaataaaggtttcactgtttaatctaatcttgtggatttcatgacattggacttccagccgatgtgtgctttaaccttcggatggatgcttatttatcatatcattatttgccgattggtttatactggattatattgttatttcattacatcatcatcagccgactgcctttttatcattatctacattggatatatagccgattgcttaaaccctatcactatcggctggtatcggcatgggctattgtcggctatcggctggaactactccatcggcttgttagccgattggctgttttgatctactatttgcatatcttgtcagttgcaggatcaaactgactggcacgcccgcatctcatcaagatttggacctgcataggagctaagcagatctcccaggccggtgtgttcgatttttttcgtgaacagtagggcgggaggtgcatcagccatgaacgcgcagaacccttcaatgccgtcggtaaataatttgccaacacgttgtcgtctgctccggcagcgtagagtaccgtggagtagacttgaa

SEQ ID NO: 48484 - DNA, 1501 bp, Oryza sativa
accgatacgagaagtgcggttatacgggggtcgtttcatgcttaacttcatggctcggtccttaattgacaggggacggtactagccttttccggataccacccaaatcctccgtccgccccagtcgaaaacagttgtttaatttcatttctcctttcacaaatcatgttatcaacatcatggcaatgtggcgctcatgtccccacatgccgcatctcaattaccttcccaaaggtaattgcccaagcatatagcatttgataaatatgagtatgcatgattctagaatagcatttctaagcaattgtcataactgactagggactcatacgtaaacatggttacgaaggcataaggggtaaacaagaaccaaggcatggcataatcacaagtaggatgttcattattgcatgcaatttatttataaacaaaataatgtcgcaattgggatcaacatgttcaaagaatagtgatgacttgccttgctcgaagctttgcgggtcttggtcctcgctcggatccgcaactccctcgggctctaaaattacgtgcgaagaaacgatttgaattcggttagaattcaaataaagatccaagtaaatccaagaagatatcgagagcggaagtcggtttcatacattatctaatttcgttcgtgaaatagagctactccgtctgtttaactctatccatccccaaactattttgtggcataaatattttattagcacaagtttttaatttaatccgcccgggcattccatccatataataggttagaaatttctatcgcgagctaaatatcggacaaaatcctaaaattatcttataatattgtacgatttaatttagtctatgactaaatgattaaatataatacacggctaaaattcctagtaattaaatctgaatttctaccgtgagtcgattacttatagagattacccaaaaattatctataattatattaaattttgcaattctacgactataattaatctataattaaattctaattattttaaattttctaaacttccttaatctcccactaatttctatttatttttccttttctttttctctcctcttttctttcttttctttttctcctctttcctttcttttctttttctctccttctttcttttctttttctccctttcctttcttttctttttctctcctccctcccggcttctttctacctctctctctcggctcttgctcacccgggcggcgacggcggtgggcgcgagggggggaggagacagctcaccggcggcggcggtggcggcgacgacggtgatggcggcgcaggacgcggcgcggcacctggtgcggtgcggcgtcaccgaggtcggcggcgcggcggctcaaatgcggtggcgcgaaggcggcggcgcggcggcacaacggcaacatggtggagtggttagaggagaggaggagggaatggagtttggagaggggagaatggtgggcttttataggggagaga

SEQ ID NO: 48485 - DNA, 1501 bp, Oryza sativa
gtgaagtcttgaatttatttatgagaaaatatggtgtcgcaatcacaaccatggaattggtttgtatgatgttttttatactgtagatgtttttcgattttaggataaattagttgaagatatttgtttattaaacatattgctaatatgactacgtcatctaattaaagatagacttatactctatagaagtcaaattttgtcctaaaatgtttgaagtttattgaatctgaccaatttaccgaatagtttatgatctcaacctaggaattttggtatataagccaacaaatcatccaagtaattggttggaactaatttatttcctttgcgtatatttgtttgtttcttttgcaatgtatttaatttcaaatactacagtaagaattcaaatttaattagtatcttcgatttttgtttactttttacaactgacagctaattatcaagagtgggttttatcatgtggttcaataagttaatttagtatttacaaagaagcctcgctagcaattaagacccggtgattattatgttgttgtcgatgggggacacccgtagaccggatatagagggtattggggtacgctggtacgaggatctacgtaatatgacatcaagctaatagaaaacatggattatattggttcaggccccttggtaggccccttggtaggtaataaccctaaatccagttgatatgggattatatgatggaatcacagattacaaagggaacaatggaactcgatgataccgacgagaccgtagtcaagttggttcgactagatcacccggcgacttggctcctgtaggctccggcttcgtaggctatggtggttgtctcggctgtgagattcgatgccttaggtccttccggtgggtcccttttataccgcaggtaaggtggtttccaagtaggactcggagacatcggaccctacacgatacagtgacgacccagtccgatccgagtaggaacctttccatctgtggactccatgatgaattttcttagcgtatacaaagaacatccgtatacgcgcagatataccatatcgatgtatagcgtatatccaagggtagagggtataccttattcgtaaccctgaaagtagcccctgacttctgcttaaatgaactcatgtaaccgatcgcgacttctgatgtcgggtttgttgtcgttctcgactggtcgatctcggcgtgaggaccgtagagacaaggagtaatcgacgacgccatgcgaagttcaacggtcgtgagtgaatttaaattgaagtccaaaaactgccgcgtgtaacggacccagaaatttccggcggccatctctctcctttccttggaattcgcatcgtcggtagtgcgtctatttaagggagttttggggatccattttggagcccgcctgttgcaaaaacttcctagcctccaagcgctcttcgtcttctccgctcccgcacaaaccctagcttgctcatcttggtccctcctccggtga

SEQ ID NO: 48486 - DNA, 1501 bp, Oryza sativa
tcggcgagccttctgttcttcagacatgttacttgtatcttgagtgagcagggaattgtatacctcaaacatctttgcttctttttgctgttctgctgccttcaaatttacgtttgaaatgtgaatctgtgcttcagtgaccttctcacgctccagcttccgatcttgcgtcactttgataattttttcaatattgtcccctaggatgacaattccttctgacatactgtccttcttgcgttttccattgcgctcggcttgtgctgcttctctaccaatgggacgcttttgttcatctggaatatcaaccacttcagccttgtttttgtccttctcaatcattgcacaccacttgggctcttttctcagtatcttccaccaatgcacaagtgcaaaaggctttccaaatgtatttgcatacatctgttgtgcctccttctccagcatgtcatcgtcatatccgcttgtattcatttgagttaccttagtccagtaatcattgaattctccaatcgatgatttgaggcgtgaccaatgaaccttcaattgatttatttcccttgtacgcttcccattcccttttctgttgaactcatcagtaacctctttccaaaacgtatcacctttcttttcattcccatgaatgggatctttagaagcattcaaccaagcactagccaatctctcttcctcatcatgagtccaatatctcaaacttctctttttagcacttgcatcattgattgcatcttcatgaatatcaatttggactgtattgttagctgcagcttggggtgttggtggtggagtagacattgtgttggtagtctgaccaacaaggtgaaaattttcaccttcttgtggctgcggcagacagttctgttggagaaaatttacgaagccttctgtaggatacaacctgaaaacataagaagcaaatccaattgaaaccgatggcagcataagaaaatcaaacatagtaagttccagaagatgatcctgacatagtaagtactgacatactaacaggttacttaagcatcatactgatgatcctgacatagtagcagtgctgacatagattttttttaataagatcctgacatagttcagtcaagcaagtactacagtatgtgtaaggaataattcagtcaagcaacaagttcagtcaagcatatatgtcaagtaacaagtttagtcaagcatacagaagaccatgtagggcaagctgttgctgtggttgcaaagaagaccatatatatcagtactaacaggttatttggttagctatgacgacagcacagagtgtagggcaagctgttgctgtggttgcaaagaagaccatgtctgcattccatacagaaggctaaaaatatataccaatgttaggatgatacccttggcatttacactcaaagcatttgttaccaatgtactgacaaggagatatttaacaagctttacgtatgtgaattacatgttgtacagtacactgtccaga

SEQ ID NO: 48487 - DNA, 1501 bp, Oryza sativa
atcttcggctttggcatactcgttggctttttcgaacatctgcttaaccatcctggggggtttacgtccgaacttgctgactaggtcctcgtggcgaatgcctttagtgaaggcggcaatgatgacgtcgtcggtgatgtcggagatcttgttgcgttgttcggagaagcgtcggatgtaatctcgaagggattctctagacttctgaacgacgttgtagagatcaaactgtgtgccggggcgttcaaaggtgctttataagttggcgatgaagtgatcacgaagttccgcccatgatccgatcgtgccacggggtagtccgtggagccaggatcgggcggagtccgctagggccacaggtagatagtttgccatggctttgctgtctcctcctgctgcgcggattgcgagtccgtagacggtgagccaagactccagattagtggtgccgtcatacttctcgattccagtcggcttaaagccggctggccaatccactcgacgcaggtcattagtgaaggcagctactccatccacgtcgtcgtcgtagcgatttgttgaatggcggtgacctcgtgctgcacggcgctggttgatcgtgtcgcgaagatcgacaggacgctggtgaggtggagagtgaggccgttcgactcggcgctccctgtgacgttcgggaggcgagtgaacagatcgttcgtcgtgacccctgctcctgcgactagatcctgtgccgatgatgctgaggcttggctgatgataatcatgagatcggaggtgagggacttggctaccagtcggagtgcgggtgcttgcggagttggctggaaccgaggcagcgatcatggtcttcgtctggttcaagatgttgacaacatgatcagcttggttgagtgcgtcttccttgaggagggtgtcgaggagagtgattgctgcaaccgcgttctgctggggggtgcgaaagaccactgttccatcgacgtcttgttgcccaatgagctctctcgctcggcgcctggattccaaggcgcgttgctgtcgatcttcagcctcctttgcaatccgttcacgatcttgttgctcgcgctgtagtcattctcgctcctgtcgctgtcgctcttcctccagtcggcgatgttcggtttcttgtcgtatgcgctcttcctccgcttctcgggcttggcgctgctcctccgtttcgttgtcagccatgaatacgccgaagaagaggggcgtgtagttatcctcatagctgtcgtcgaagttgtcgaggtcaccgtggtcgtagtggtagccgaagtcgtcgtagtcgaggatctcggttggtcgagaattgacgccgggggagctaaggtaaccatccaactcttccgtcgagactgtcccaagaggttggagtataacgccaacctctctagatctagattggatcagggccgaagccggagctcgcctagatcttcgagtaggagatgtcttggcggtgaagacggcggccaagtca

SEQ ID NO: 48488 - DNA, 472 bp, Oryza sativa
  unsure (1)..(472): unsure at all n locations
ttaatgtcatcggtggtgagccttcnccgttaattaatggcganagatgatcttattttcctatgggttatatttgattaggcatgaaccttatatattggtttggttcagctaaatgctatatgtatgtttgcttagccatgcttagaaacattagctaattaaaggggattaaatataaattatattatattattcttattaaataagggtatatttaatggtagctcacgatgataattaaaacctggttaaggtgggttgtgagcatatggttttgatggttgtgctcatggtaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccatttgcctctggttttgag

SEQ ID NO: 48489 - DNA, 1501 bp, Oryza sativa
aaaccgaatgtaaagaaagtgaatctgagttgcttgttcatgagagccattcccagttatgaaacaagtgatatgttcaaggaaaatctacagaggtcagattaaaatcacatccaacaacgaagcttcagatttggcaggataacgatcagacaataataagttcagcagtaaagtcatttgggaagacgtcaaagcatgtcaagtgggataagttggttcccttgggaaacataattcaaaggcaaaattatcgaccctcgcattgaatagaggaaatatctagcaccggagaccaggaaagctaatatgagacagtttgtggcaagttgtcaatcatggtattcttagtaagcgggatatcatagtctaaagcatagggtggtaagctggaaggaaacgccaagcgtggtattctcacgatggtaagcatggtatcctagtaatgacaagctgatatcggcgcataacatgaagtgggtaacttgtatgaggttgacgccaaagatatgaattatgagaagttctggaactgaagtcccatcttcaagtgccacaacccagtcgaagtcagctagaggtgcaaccatggaaaagtcaggtgaagagaagattccatctggaacaggagatcgagccaagcagtctagagtggagaagttttgttaggcaagtttattatagaacacggagcggaagaagtcagacaagaagagaagaccacccaacctatcttcttgctagcctcctcgaatctcggggacgagattcctgtaaggggggtggatttgtcacgtcctgataaattcatctcgaaataaaaatcattttctaaaagaaataatagaattaattaaaattcgaaaagaaattggcaaacactaaaatacgtataagaaaaattcgaatgtggcccggagaatttttgttaaattctccttggtctaaaatgagccctcaaattttacttgaattttcagagcacaggaaatatttattaagcaacaaaaacaattatcaaagtttattaaaaagaaaaacctaaaaataatcctccttcctcctttgggccaagtctggcccaaagtccttcctctctctctctctcggcccgcggccaaagtcctctcttcctccctctctttctctccctctccttctccccctccttctcttgggcctcccctttcccctcggcccagctctcttttcctcccttcccgcctgggccgcctcccggcccaagccaccccacccagccgccccagcctcccaagccgcccaccccccctcacgcgcgctgatcgcgcgaccgcgtgggtcccacgcgccgagtcgtcgtcctcctcccgcccggcctccttcctctctctctcctgtgcaaaccctagcgccaaacctccccaaaatccacgcgattcaaaccagggtttccaaaattgattagggggttttaatccctattgattcctctgtctttcccccatatttcccccttgat

SEQ ID NO: 48490 - DNA, 1501 bp, Oryza sativa
gcgtcaacctcatacaagttacccacttcatgttatgcgccgatatcagcttgtcattactaggataccatgcttaccatcgtgagaataccacgcttggcgtttccttccagcttaccaccctatgctttagactatgatatcccgcttactaagaataccatgattgacaacttgccacaaactgtctcatattagctttcctggtctccggtgctagatatttcctctattcaatgcgagggtcgataattttgcctttgaattatgtttcccaagggaaccaacttatcccacttgacatgctttgacgtcttcccaaatgactttactgctgaacttattattgtctgatcgttatcctgccaaatctgaagcttcgttgttggatgtgattttaatctgacctctgtagattttccttgaacatatcacttgtttcataactgggaatggctctcatgaacaagcaactcagattcactttctttacattcggtttactttccagtattctcttcgtgttgtcatcatttagcattcaacgtattcctttacaccttcagccttgatgtgttctttcccgatggatcgattgctaggaaagtgcgttgaacgatactagtgcaggtgcttttattctagcagcatctgatgcagagcccaaggttgaaccgagctttagattccaactgtgcgggttttcttgttgacttcttggtcatgtcacgaaagtttccatccttgtcctcatagaatcacttctacctgtggtcatctcgcttactcgcgaattcatctgctttgatgacagggtggctattgtagggtcaattgctatcgggagtcttcctcgagtgacacaaatcatggttctcgttatcctttatcaatcacctttcgacctacttcttttccctgtaaccaaacatcttttccgatctcttccattaatcacctttcgacctttctcaaccaggtactcttcactccgggtgttgaggatgcttctggggcaatgaggtccttgggcatgctgtctttcagagaaactttgaagtagtttgtcaaaagctagactgacgattgttgcctttgatccgaagaagacacgtctgaaactcttagtccaaacaaatgtctctttggttgatcagttgattttcttttctatctacaactaggttatttgattcataatagagtaggagctcacggaaatgagactctaggtctccttaatcaacaacaaaacgtacacaactcacagcacttgcaatcttaacatggatccttcataaacttgtcaaactcatgttttacctcttgttgaagatcgaaaccgatgcaactcaacccgaaagcgtcgtcaagcgttgcgccggcagcatgtcacgactcaagttctccctgagcatttggttcataatgtgcagccagatcaatcggtgataccccaagttattccttagcatttggtgcgcaacatacagccaaactt

SEQ ID NO: 48491 - DNA, 1501 bp, Oryza sativa
gttccaaccgacataaaattgccaagtacatgtgaagaacatacgagtacgaccgcaattctcgtatgggcatagacctagctgattaagttatctagcaaaggtggtacctctgtattgtggttcttcttaagtcctcgtgcaggaggcaaacttacgccgagcagggcgattgtaatatttaccgaggcgcaggtaaatatttgagataaattgtgatatcacaaactgtgtgtattgtgaaaaccttgttgagatgacgggggtctctcaactagttctctccaaaaacctcgggaacgccagaactcctttcgctgctgataacgttacgtttagagcgtatgaggactacagttcatggaacaggtaccactaatgttagtaactgaaaagctttgccatgactaagctgatgaatattagcatgtcatggattgcgggtaaagcgtacatttactacagtaaagtataaatgaatctattcgaatagccgtgctcacagatttgagcattgggactcatatggtatttggttagaaacttaattccaaactttattaaatactgttgcatttaaaacattctaggctttcttcctctatattctttgctttctgccagtaaacctagatctactcagatattaccatttcatgcattcattattgaatataatagtttgctgagtacgttgtactcacccttgcttcaacccctttttcagagtccaattgatgttcttaccgaagctgggagttcaatcatataagttagtctcattctaacttagttctcaagtatagattagataaatggtttaagtctataataaaacattagtgtttaaatccttctatagcctctgctggactagttagccacaatcttgtaaattcccctattattttatgtaataacatctcctttgaaaccttgaccaaatgtatgcaatgaagaaccagattgtttaacctgtatcaatttactgatccagggcttgatacagtctaaacatgtcggtttccgaatcattagttttgggacccgacatattatgaagaagatgatagcggttttgaccctcattgggactgagtttttcagattttgctggaatgaagttatgaggctgccatctattgaagattgccctgggtgtagtgatattacagaaagttcaagccgatcttacaattgaagcaatcggctgtggcaaacgcgggttcctattcattaaaggttgggcccagtaaaccaagatcgtgaccaagaggacgatgaggataggaaaactcaatggtatccttctggtatttttacaaaaaatcagaagagaagggttcaaaggttgaggaacatggggcgctttcggaggttgagcaagaaatcaaccatcggctgaagaaagcaaagccgaagcaggagtggcgtgttaagaatcaagctcccacagccgatgaggtgaaaagattggctaaggggaagagtgttgtgactg

SEQ ID NO: 48492 - DNA, 919 bp, Oryza sativa
  unsure (1)..(919): unsure at all n locations
attgccnattgacgtctttgagtgatccatgcgccctcgggtgcggctgatgcgtgggacccacggcgccgaccggcgtaagccgcgtgcacccggtccaccgtcgaccgtgaggctgccgcatgggccccactcccatggacccggtccgcgcgctcctctctcccggctgacgcaataaatccgattttaaattaaaatttaaatgaagaaattcacaaatatccatttaaagagcatataaacttcaaatgaccataacttggccatttgaactcagaattggaccgttcaagtctctaatttttccttaagaagccaagaacccatttttgtgctttatttcggtttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaacttattgcattatcgctttatttaaattccgcgttatcactgttttatttagccatgcctatttacctttgttatgaccttattattattgttattgttattattaccttgttcaccctagaaccaacaaaaccccaactagtggacactctactaatggtaccactagtatgatttaaggtagatgcttcgctttaattaggtaacattaggtggttttataactctagactttgggaatattcatatcacctggacactttggaatggtttggttattgtggaattggcttcacaccgctccttcttttcaaaatccccaaaatggttttaggctgggctcggcgtgcatggttttgatagtagcacctcggccatataaggaccggt

SEQ ID NO: 48493 - DNA, 1171 bp, Oryza sativa
attcctgcagcccaaaaaatctaaaaacgaaaaaaattcttccaccgcctaggaaccggtccgggtggacccggtccacgatgccccccgcaaatcctgcaaaagcctttttttaaccccaaaaatacgtgcggaccatatgatacacgggtggccaacggtcagcaatcaaccgcagccacagacgaccgggccccacacccacaccccccccccccccccccctctcctcgcgaagctcccgtgaacccgagaagtttctcggtccacgcgaccgaatatcttccgcgttgccgttgccgacgcgccaaccgtccacgcacccccgtagccaacccgaacacggaataccacttccaccagcctgtccaccccacctgtctcgctggcgcctgggccccacatggggccaaaccaaacgcgaggccgaggcggcgccgtgtccgttaaggaaagccgaagccgagttggcttggcaccgcctctcgtccacccctctcctatattaggcgacgccccgccacggtttctccccacctcgcggccccctcggttttattttttcttcttctcttcggcgtggtcgcgtcgtcgcgtttgcgtcttcccgttcccgatcccttcctccctctgcctctcgattcgattcgagtttcttcgtttttttcccctcttaataatcttcgtgttgatttggattgtcgtcgtgttcttcgccttttctgtccgcagatctccgtgcgacgctgcccgggagcctcctctatctggattcgttcgacttgattgattgattgttcggtttgcttgcgacgtgtttgatttttttcctccccggtgattcgattcgatccgatcctatccgaccccttctctggtctcgatttctgttttgtgttgttccccgtgttcgtcctctcggcgtgttcggttgttgcaggagcggatttgatccgggattttggaggttcccgtggcgtcgtgtggcgaagggggaagtcgaggtttcgaggaagaggtcagtttcccgtctacggtcgtttgatttagtcacttgggttcggtgattgatttcagatttgagtggttgattaccttcaatcgatggatggatgatcatcgggttcttatctgtccttacgcgaggtgattcgagaccctgggttgatag

SEQ ID NO: 48494 - DNA, 617 bp, Oryza sativa
attcctgcagcccaaaaaatctaaaaacgaaaaaaattcttccaccgcctaggaaccggtccgggtggacccggtccacgatgccccccgcaaatcctgcaaaagcctttttttaaccccaaaaatacgtgcggaccatatgatacacgggtggccaacggtcagcaatcaaccgcagccacagacgaccgggccccacacccacaccccccccccccccccccctctcctcgcgaagctcccgtgaacccgagaagtttctcggtccacgcgaccgaatatcttccgcgttgccgttgccgacgcgccaaccgtccacgcacccccgtagccaacccgaacacggaataccacttccaccagcctgtccaccccacctgtctcgctggcgcctgggccccacatggggccaaaccaaacgcgaggccgaggcggcgccgtgtccgttaaggaaagccgaagccgagttggcttggcaccgcctctcgtccacccctctcctatattaggcgacgccccgccacggtttctccccacctcgcggccccctcggttttattttttcttcttctcttcggcgtggtcgcgtcgtcgcgtttgcgtcttcccgttcccga

SEQ ID NO: 48495 - DNA, 1501 bp, Oryza sativa
atatccctccatttctttcctctctgtacactcgtaagcatccaaaatacaaaggtttggcctattgcgttgtcaaattgagaaattagtcaactctacaatttgaaatcagtttcggcttagttcagtcaagcatatcttcattggctattagtatactgaacgtttcggctgcctttggttttttgggatttgaggaaaattgggtaattcttaaggatttgagggatttgggtagtactattcacacctttggattggagatttgaagaagggcattggagtacaagagaattttccctttgcccatgtccataggaatttgacttttatttgcctttgagacgaccaaagcaaatcaattttatttgcctttgagacgaccaaaacaaatcaattcatgtgacttcgagtgatcacaattgagacaatcaacaagcaaatagaaactatattttatatatcaagaatccattgatttactctattcttagtgttccaaacacggaaacaccatacttcgtcttgtgttcctataatctttcgatttctgtgtatatttttacatcctgcgttcaaggcccttcgcgttaatactatccccatctacaaaaaaatatagggatttagaatggatgtagtgggatatatcagcataaaaataagcagcaattttactaaaacagtgcacatccgtatgtgtcatggtcaactaggcaacaatattaaaaggggcaaaaatgtccaagtggcagttcggacaaacaactagtgcagtacttaaatatgcaaaaaggaagctctaaaagaaagaaacccaaacaaaacaaaaccatccccacccacagtggcaagaactaggatcctcccccaactttgatctctcccaccactactactcatccatcaaatcaacgtcgctcccctcctcctctcgcggcgcggctcctttccaagattctccgatccccaaacccccaatcgccagagcaaagaagggggaacatcgccaggaaaaagatcggtggcgagagaaggcggaaagcgaaggaaagcgaggggagcaaaaggagagagagagagagtcttttcaattttcttttgtttttcttttctccctgcaagaggcagctcggcgttgctgcgaattccatccatgtcgctcgccgtcctcaggatgaggttttgatgcccgaatccggccttttctctgtctatttcagcacctcatcgattttttttggctcttgtgatgccctctgtcgtagagctccccaatcagggcttcctcacttgtgccatgtttgttgctcactcctttcttgattattagttggtagctcaccagtttttgcaggggttttggcagatcatgtagtctgcctgctcaatccctggtcagttaatctagaaacctcattgaataaacaagttcagaggttcttgattccttttgttgcaattgcaattgcaactttgttgtgcaaattgtccattgacc

SEQ ID NO: 48496 - DNA, 1501 bp, Oryza sativa
gatggggatagtattaacgcgaagggccttgaacgcaggatgtaaaaatatacacagaaatcgaaagattataggaacacaagacgaagtatggtgtttccgtgtttggaacactaagaatagagtaaatcaatggattcttgatatataaaatatagtttctatttgcttgttgattgtctcaattgtgatcactcgaagtcacatgaattgatttgttttggtcgtctcaaaggcaaataaaattgatttgctttggtcgtctcaaaggcaaataaaagtcaaattcctatggacatgggcaaagggaaaattctcttgtactccaatgcccttcttcaaatctccaatccaaaggtgtgaatagtactacccaaatccctcaaatccttaagaattacccaattttcctcaaatcccaaaaaaccaaaggcagccgaaacgttcagtatactaatagccaatgaagatatgcttgactgaactaagccgaaactgatttcaaattgtagagttgactaatttctcaatttgacaacgcaataggccaaacctttgtattttggatgcttacgagtgtacagagaggaaagaaatggagggatatgtagccgctttttacaatttagatgacagaatcaaagaatcagagggtgcacggcaacacccacgatgcagatatctggattttaagatgcagatatctggattttaatctatctcgtggcgtactggcgtcgtatcacaatatcaatactatcatatcagtgcagtcccttcaaaaatactatcagtgcacaaggccactattgtttcatcctgctgcccacaaactttgctcgtcccttgccgcacaggatcaccgttgcctgctagccgcgccaacactgcatctgaattctgaacgagtaggaaaattagagtgcagtctagctgctcaacagacacgagagttttccattgccagtgtcttcagatttgtcagctgacgctttgtccctgaaatgtagtcaatcgtggaacaactgaagggatgcgaattttttacccccaaaaaaagggttaaaaaaaaacatagtcccgcggcaataatattggaggccacacttttaactgaaaatactggctttcttgtcaaaccatacctgtcttactctgcactgccgctgccaacactttggcctggctccggaaacaacagtgtaacctgcaaaaaaatgctctgataatgcaacaccattgcaagatcgaaatcccatcaccaacaaagggtgattacttctactttgatgacaaaagtcagtttgtggttttgcagtcattgattccactgcggttccgtcagaaactcaaatccagaatttacaacacaaatcatattaacaagctacttgcagttccctccacattttttcatccgggcttgggaccggcaaaggcagtgttaaacggcaaaaaaaaaaagagagagagaaaagaagaagaaagaaaaaaaagagag

SEQ ID NO: 48497 - DNA, 1501 bp, Oryza sativa
atagtttttaggttttcactgtatttagtttacgcaacatattttcacatgttactatcgaatgaaagcacaattcagggattagggataaggagcatttgaaataggaagtataatttttttaccaacgttgagaggcccacacgtaagtgataaggggttatggtggcagattgactactatcatcattgccaatatttaccgtagtatagatgtttctccaaaatcttcactccaaataatgctctaagggtatattcttgtgtaaaagaaggcatgtttttttctgcaccttttcaattttctttctcattactcatgcgcatgcttcacgagttgctaaacgttatatttttcgccaaaattttctatataaaggttatttcaaaaattatattatcctattgtttaagttttcttaagctagacgtgttttgttggttaccaaacactgggcataccatggttcctcgttgcgttcgattcaactgtttggctgagattattggtgcaaaaaaaatttaaaaaaggtgcaggtaggattaactaaatattaaatattataaataaaaatatatatttatttgattcttaataaatttatacgtataaaacttttgcacaaaatacattgcttgtcgtttagtagtttataaatagtgctagttaagtaagctgtgacgaacagtcgaacacggctttagacggatgttccgcttactgctacagttgtgggcttgtggcttagcttgtcgcattctgttctactgttacaatcaagactgtcgtaaatcgtaacaaacgctattatgataatacatactcgatcaactttgattatcaagtaaagtttcacgatcaaaggttgagacgttaaactaacaaacttccatttctcgtgtattttggaccgggagccaacacgtcgctttaacaagcatggccagcgacagcgagcgctgcccgccggtgacaagttaactgcacaagcagcaacgcgaggcctagaatgctctcatcggacaaagacctccaaaagaaaaaagaacggacaaatcgtagcagatactccgacagcagccgctttcagtactcttccagctcgcgaccgcctatctatcatcagtccgctccccatcattcaattcattccgccaattcattctcctcctcccaaaccatcagcttatcccaaggtatgcttggattaattctgtttcttttagtgtttgtttagcttgatttgttgtggcatatgcacacaactgcttgactgcttcctgtcaactgaattcttgggtgggaattatctctggttcggatcaatttctcttctttttactttctttcaatatttttttggggctgttatcatgtcttggatgtccaattcaagtttgctcatgtaatatttgtcgtgacagttcgatggtgaatcgtgaaatttgtgctgctgcctgctactactgaattctcagattgtcacaggaatcaagcaaa

SEQ ID NO: 48498 - DNA, 1501 bp, Oryza sativa
  unsure (1)..(1501): unsure at all n locations
ctagtgcaantgtatctncataaccncccccnncccccccgtgtnttttgattgaacagatgcatctnagnccancagcnannaagcnggaagaggnggagggnnnggagacaaagaannnnatacaggttcaggccttcttattcaagaagtaataccctactcctgtccggggatgattccgccgaatgtattattgattgtatgatctgggaaaaatcacgccccgagaggcatccggacccctccttatataggggaaggggtccgctttacaaaatacagtccatatcccaaaggaacatggaattacagataaaatacaatcgtaaccgactaggatcccgggtattttcttgacatacaagtttagaatctaacccaagtcctcatgaagatattctatctttattcggtaccatgtacccagctggaatataaccgccatgtagatatggggtatccataatctccacagtagcccccgagacctttgcagtcgacgaaatagccatctcaaaacaaaaaacaataatccgagtacttcaactcttcctgcttcagcctgccgagtactggaaccaaagactgtgaagggcgaaaataaaacatggtgcatcgagtagatgcacctaattaggtgtagcccccgactatgtggttagttaaaaaactaaacataaagtcaagaaccgagtggttttacaaccaaacattatacaacaaagcactcgtggtaaacagtaaaactcccagccgactgcttcttagctttaatatatcgagaaaaaatataagaagacccgtgtgataaacgctcaaaaggccctcaaacagacttatttgacaggaatccgagtaaaaactccaaagacactccaccaaatatgataaaaagtcatggtaatcaacgagtctaatagcctaggctatgaccctcaccacaaccaaaataagcatataacatgctaagagaatgactattagcaaactagtcatctcaaatctacccaaacagcttttgcagcctaataaagcttacaaaactggcataacacctttctgccgggcacctttttatttcatcataataattccaaagaattattgaaccgcgttaaaaaggattttaacagcatcgggccacatcattgtgagcacaaattgccaaagcaaaaagtgcctaaatccctagggatcacaacgggccacgctgattgtaatattgggccaaagtactatacaggcccaagcccattagtactcccgataccctaaaaactccgaagtctaagcgtcacttcgtcttccccgccaagactttcaccatttccccactccttgctacagtacataaccgcgccgacgaagctagagttcatcaatccgcttcaatccattcccaaaatcccacgaaacttctccgcgcatccaccgctccgattccccattcccctcgagctatacctcggttcaaatcaaaccattcagctcacatcca

SEQ ID NO: 48499 - DNA, 1501 bp, Oryza sativa
ttaaaaacaataatccaattaagttgatcaacatgtcagactgtcacttatgtccagggatgaatacctcaatactatacaatcaatcaccccccgttttgcatctgatataaggataagcaaaacattatggccttgatcggcagcgatggctgctgccgcagctgccctataaggtgtaaataccatgtgaaagaagacatgcgtagcactctcatgtcacttggccatataaagttttcaactccacaattatataccctcctctcctcaacatacctgagcactgcagaggtgcacatgaatccatttagattatatatagagaaacaaaccctcttctaatcaagcgattttgaagagaaaatgtataatatatgcatacattccttcaatgtccaaactgaaaattaagaatcaacggtatcagccatagtgtcagccatggaaaagaactgagttagatcacaatatcttactgacgaaactaaatatattgaagccaattttctatcaaccactgagtgcatgcacaattgaattgtttatatattcatataatacaaaattgtaaagtgccagcccgaagaagtacatctcgacgtgtcagacacctatgtttaactgcatgtccatgcatgaaagtcaagaaactgcagtagaaagtgatgtttctaccctcacggagtgacagtaaaatcaaatgcaaatgttacaagtataataccaaaataaatactgatctgttcattttgaaagcaacaaactattagactgaagcacatgtattcacggtaagaaaaaaactaatgactaagaggtcaacttggttcacaggagaaaaaaatatgcttagagctctgactgagacacgaaggagtacctaaaaaatatgcatcatgagcttaggacttagagcctcctttgcttctttggttcgtcctaactactgaagccaacacatggatgtcagtcatgtcactgcattcacattgccatctaccaactcccaagaaactttcttcattctcatccaccaaggaatcaacctataggagcagaacctcttatgtcacctgaaaagaaaaatggaacgttcaagagtcaattattcaagctactactgatcaagggatcgcaaccggcgagcatgtatatccatctgaaccatgttgcagtgtttttgttatacataatgtaactgcagaacacatgcaagaatatgaccccaatgatccataattgtatcttcttggctgttccactgaacaatactgaattcatccataattatatcttcttggctgttccactgaacaatactgaattcattatatggaagtcctgaaaaaaagaaggaaacatgatgattggatctcttgagaaaatgacagtatgatttatgctcataacaggcatcatctatgaaaaatatataatttagcatagtcgtgacacaacgcagcatgaattctaattgcgccggacctcattcttagta

SEQ ID NO: 48500 - DNA, 1501 bp, Oryza sativa
aacactaactgtaattgtttcaaaaaacactcattataaaaatctacaactaaagcaaaatcatgtcgaccaatcgttcatgttgtacataaaaatatgtgcacaagatttagccaactaaaaatatctcttaaaagaaatttccatccactacgtctattactcacatgatgcacgcagaacaacacaccacaaaaagcatcgatcaccattctcctccttaattactttttaattaggagcagaatgagaaattagattaaatcatgacgactcatggggggtcatggctgccaaaaataaaactaaaaacaaaacagccgctagtagctaagctaagcaagcaaaagaacacaacacgggcggtcaaggtttatactgaagacgattacgcgcacgcgagattgtgggggggggggggggggggtggcttaatcagctcgctcgcgccatccgcgatctgacgattaattctctcttaatctgcgaattaaaagttgccttcaggtcgcagcttaacaaccattgaactgaaccactcgtcttcgctccactgtatactgaactacttgtttttgcagcgatgatgcatgatgagctttcaagtttcaacaccaatgtcgccatcgatcgacgatcgactggccacgacgcgacctaaatgcgatgcaatttgatgaatgcattccatgtcgtgtgagttcgacctcgacttggcggccggcaaattaagcatcctagtcaaaaaaataaaaaaagtaccggccgtacctagtcaagattaaattaaatgatgatggcagaaagaggtaagttaatgatcagtacggaaaatgaaatcttcggcaacatagtcgttgcgttttgggctgtagtagattggtgaagactattctgcatgcagagacttggtactgtttggttcaacgggaaaatttactatttgttaccatgcgctcaagtgttactttctcggattttcattttcatttgtcaccccatcatcaacaaagctttctgtggagattatggataccccatatctacacggcggttatattccagctgggtacatggtaccgaataaagatagaatatcttcatgaggacttgggttagattctaaacttgtatgtcaagaaaatacccggaatcctagtcggttacgattgtattttatctgtaattccatgttcctttgggatatggattgtattttataaagcggatcccttcccctatataaggaggggtccggatgcctctcggggcgcgatttttctcagatcatacaatcaataatacattcggcggaatcatccccggacaggagtagggtattacttcttgaataagaaggcctgaacctgtatttctttgtctccaaacctatccactttccaagcttgatagccacccccttttagtattgctgaaaccttgtttcgacagttggcgcgccaggtagggacagcgtcaagtttttgccgactaagtgcga

SEQ ID NO: 48501 - DNA, 523 bp, Oryza sativa
  unsure (1)..(523): unsure at all n locations
cgcgcgactgactgcacatcgccatgtgcncatcacaaattccagcacaaagagagggagagacgacatgcgagatggaggtcaaacgcggacgcgtccttttcggcggcgaccaccgctggccacgccatactagagctacgcgtagaggcgggaagagacgagggcgagggctatgcagaggcaagggagagctctccacctcgcactaccatcctgtgacgctagtggccacctcccttcacgcagcggagctgtaatacccccgagttttaaattaatatatctcgcggaatattagagcaaacgcgcaaaagttcaacttttaaaccattgttcgtatagacgatcgggaaccgtggatgcgtagagctcgccgagtagtgcaaaatagactataaatttatagtaatcggagtccgaacgaagtcccgaggattgaatagatgtgagccgttagatcttatttagtctctttatataaccaaccaaaaaaaacaaacgaaaaaaaaaagaaacagga

SEQ ID NO: 48502 - DNA, 1501 bp, Oryza sativa
agttcgtttttccttaatctggaattttcagagtcataatctgattttgtgctcaacatgaaagttgtagacaattttgtctagatgtccaaagttgtattatttgctagtttccattagacggtttgtgagttactcataaaacagtaatggaacagctataggttatttaatacaaatcgataaaaggtttatatgttctaggtttcgattttagtaaatatcccttgtaaccatcgttagttgaatatagtggtttatgcgtagttttgctccacaggtgtggagggttccaacgttggaggagttgagtcggagtatcgaatgagttaaggcaagtacaagacggacttatgtgatggacaaaactgagttgttttgtttggctttacttgcataattattattcaattgcttgttattactgattgtatggctatgacgttatgctacttattcgtgttttgacccatattcaaattcatgacgttattcatgtttcattattccggatgttctgtttacattatttaagaaccatgcgtagccatgggagtgcaatttggatctttattcatgatccttgagaagcgctgatcacgcttgctcggcttaccggtaatgctaagaggatattcacacctgcccgggagggaactactatcttttgacttctttggtttaaaaataaagtaaatccaacccttcatgttggtttcttaatgcataaaacatgcgtatgttttactagttcaagattgtatttgctgagtattctttactcactcttgtgtttaatttggtttttaggtacctaatgacatcgatcggcatggggcgggagtagcacccttggactacacattattattgcacacaattgaaattagttttagactatgatttttgctcagcataagttttgcatagaacttgtaaaggtcatttaaggttctgatccttatttttcacgtgggatttgtggagctaggatggtttggattgtgtggtttatatcggtattgacctttcttataactgtctgtcgtgatgtccgtatttttaggggagactctaccaaaatttctaataattttaggacttagtttttgagtgtattttggtgtggcattctatgtacgtggttacctggggtattacagttggtatcagagcgggcggtaggtccatgggaagtgactgggtaatgagatatataaatcaacataaaattttgaactagagttcctaaccaattaaaaaaaatactttctcttagggtaggaaataataagagtagaacttgggttatatataaacatctaaaagaacttgacacactggtgcacaataggaatgggagcatgggtcattcctagcatttatgtttctgctgcatatatatgtgtatgattgtgtttccttgcatgccattgtctaacctattgttaaactaataacgtgtaaatgcttgtgtttgatatagctatgccgcctagag

SEQ ID NO: 48503 - DNA, 183 bp, Oryza sativa
  unsure (1)..(183): unsure at all n locations
gtggccatgaatggcntatctantggnacagnagntcatcattcccgatctcttattgtctctatcataagtaaattggttcccggcccggaataaatcccggtctctcattgtatctatcataaatttcttactatacttgtcattcccggctcggattggattagcccggattgaatccaa

SEQ ID NO: 48504 - DNA, 308 bp, Oryza sativa
  unsure (1)..(308): unsure at all n locations
attgataatcgatttacagnagtncatcatatttaagaaccatgcgtagccatgggagtgcaatttggatctttattcatgatccttgagaagcgctgatcacgcttgctcggcttaccggtaatgctaagaggatattcacacctgcccgggagggaactactatcttttgacttctttggtttaaaaataaagtaaatccaacccttcatgttggtttcttaatgcataaatcatgcgtatgttttactagttcaagattgtacttgctgagtattctttactcactcttgtgtttaatttggttt

SEQ ID NO: 48505 - DNA, 1501 bp, Oryza sativa
tccgatggtagtaatctgtagaggaaattgtatttgttaccttaaatgatcaatgtcgaaacaagatttcggcaataataaaagggggtggctatcaagctagaaaagtggatgggtttggagacaaggaattttatacaggttcaggccttcttatttaagaagtaataccctactcctgtccggggatgattccgccgagtgtgttattgattgtatgattgggagaaaaaagaatcgtctcgagaggaacccggacccctccttatataagggaagggatctgtattacaaagtacagtccatatcctaacggaatatgggattacagataaaatacaatcgtaaccgactaggatcccgagtattttcttgacatacaagtttagaatctaacccgagtcctcataaagatattctatctatatttggtactgtatatccgactaaaatataactgtcatgcagatatggggtatccattatctccacagtagcccccgagaccttcgtagttgacgaaataaccttctcgaaacaaaaaccagtagtccgagtgcttcaattcaacttgctccagcttgccgagtagtaaaaatcagaaactgtgaagggcgaaaataaaacatggtgcatcgagtagatgcacctaattaggtgtagcccccgactatgtgaaaaactaaacatatagtcaagaaccgagtggttttatagcgaagcacgcatggtacttagtaagatacccagccgactgctcctcaactagaacatatcaaggacaaaaaatataaaaagggccgaatgataaacactcaaaaggtccaaaaatagatatatttggtaagaatccaagtaagaaactcttaaaatgatccaccaaatatgataaagatcatggtaattaataagttcattagcctaggctataacccttaccacaatcaaaataagcatataacatgctaggagaatgactactaataaaccagtcatctcaaattaacccaatagcttttgtagcctaaaaaggtttacaaaaatggtataacacctttctgtcgggcaccttttaatgtgcatcataataattccaaagaattattgaatcgcgttaaaaaggattttaacagcatcgggccgcatcatcgtgagcacatattgccaaagcaaaaagcgcctaagttcctagggatcacaacaggccacgctaattatagtattgggctgaagtactgtataggtccaggcccattagtactcccgataccctaataatgccgaagtgaaaaacggctcttcgtcttccccgccgagactctcgccattttcaacattccctgctacagtgcaaaactgcgccgggcaaactagggttcatcgatccgctccaatccaccctcaaaaacttcgcgaaatttctcctcgcatccaccgctccgattccccatccctttccagccgtatctcgaactaaatcagaccgtccagttcacattca

SEQ ID NO: 48506 - DNA, 1501 bp, Oryza sativa
tcggcgatggccctcgccgccgtgccgtcgccgccgccgcagtcggtcagcgactcgacgccgtcgaacacgtcgcggcactcccggagaaccacggcgaacccggaggcgtcgtacaccctcaggccttcctggaacagcgccgcatcctccgggccaagcctcgctgtgctctcgagaggtgtcacgccgtggacgtgctcgaacggcgacggcggcgacggagccgggaagtcctccctgaaccagccggcgagccccgccacggtgtcgaggcagtgcctcgacgtcgaggcgagcacgtggggcacctggctgaggtggccgtcgacgacgggcacggcggcggcggcgccgtccacgaggaagaaggagaccggggtgagacggtacgtcgtccctgcatcgtcggaggcgaagatgccggagtggaccagcagccgcatgaggcggcggaggaaggggagcttggccgtggggagggacagcgcggtgacgaggtcgggcagcgaggcggcgccgccgtggcggtggatggcggtggggatgccgaggtggacggcgcaccggagagtcatggaggtgaggtaggagagggtgtggcgccacagctcggcctgcgtttgcagcatctcgtcgtcggtcgggaccaacatgcttggagcctgatcggatgctgccatttctgtctgctcgacttcttctctgagcttgaacgatggaaatgattgcattacttcctatcgatcgtctgtctgactctggcgcgattacgagggttataaatagtaatcctttcggtttttaataggggacgctattggctttaggatatacttatcatttatcatattataatttttatgcaaatataaaaataaaagtggttctaaattatctttattaatgacaaaaccaaataaaaataattataattataattttctttgaaaataagatgaatagtcaaatacaagcataagaatcaatgacaacgaccatctacttaacaattagaagtagggaacatatcctatacacacaaggtttccatacatactctatgcataccaatcagcaaatatcacgaaaaattctaaaaaagattggacttttcaataggcaaattcattatctatgaaatctcatcttcaaatttattatattttacttgtagaaaagacaaaattctgacagatttttactctgaaaactgtcagatctctcacttttttaaggctaaaatataatgaatttgcatataagactttgtaatactattaaaaatacatgtcagattctctttcgagaatttttcgtgatatttgttaattggtttgtacggagtgcatataaaaaacttgtatgcataggatatgttctatgagggaaagtattgtttctggtcatggaactaacgtctcttgcctggaaataaaataattggccatgacaccatcactgctgtaaagaattgagaattgactctacttaattaatt

SEQ ID NO: 48507 - DNA, 1501 bp, Oryza sativa
atgaacgcctaggggaaattgatattaacctatgacgaaatgttttatttttttaaacttgttccatgatacaccacctatttccattttttgaaactgatacacctatttccattgatctgatctccaaaagaaagttttacagatctaggacgccaagcttgacacatctcatctcgctatttcagatcttacatgaaacttcatcacagaaaataatgaaggaccaaatttgtttattcatcgctttgatcacaccatgaacaaagaagggaaaccacagacgcatatatatcatatatgtatccaagggccacttctacggatagacctcaatgacacaccgaggtcccaatttcttcacaatcttgtagtccctgaagcctactttcatgaagagatctcgccaatcattctcgtcccgctgtcggcttttggtcaccaacatcacggccacatccataaggagttgggattccagcattggccctgaatcagaaccgactactatgtcgatgattatcactttccctctctcttcttggagcggaaccgctttcttgcattgggctaggatctttatgcagtcctcgtcgctccaatggtgcaacctaacctaaccatggataaaattgtgcaagtcaacaacacaaaaaaaaatagtgctcccttttataaatatatgatgatgttgatttttatttaacattcggttatttgtcttattaaaataatttgaataagctagcacagataaatttatgtaagtcttaatcttaatataaaatcaatcagaaaacatatatattacatattacataaatatgtgagaaaagtcaaaccttaatctaaagtcttcaaaccaaaccagccccgatctgctcttccctcagcgttttgcgctggcgtggacgctgccgcgtcgcgacacgtcagcgcgcgcgggaaaacggtggaatttcgcgagccctcgtgcctccgcgtcgtctttgaaaaatttgcagaaaagccctcgcgtttggtgatatttcgtgatagatgctaatcaaaagtttttttgtttaaaattattgcatttaagacctccaaaatattgaatattcaatacaaagaagagaaaatttggaaaataggactgcgctcggaaacatggaaactaatgggctatttagcaaaaacttttatccctaccaacccctcctccgaaaccctagccgccaccattcgctcctccctagccaacaccgacgccgctgcctcctcctcctcacgccctcctcacccccttacgccacgccgccgcatactctctcgcacctccctctcgccaccgcggggccggttccggtgtaggggaggccgtggccaccggatccggcatccacgacctccccgccggcggatctagccacccgaaggcgtgggctggtctagtataagaggctcatcggtagtgtcgatggtggtcctttctccatagcagcgagctccatggggaaag

SEQ ID NO: 48508 - DNA, 1501 bp, Oryza sativa
agttgctggcagggaagggcagcatggtgtgatgggagtgcccgcaggacagcacgcaaaggctggacgggcagcgggcgttggttcagtggtgcccatgtgatgacggaggtttgatggtggtggagaaatggtgcatcacatgcgcataggcaagtggcgggtgaaaacctagcccggtcttgacctggcccgcaacaacggtgttttcgagtgtcactttccctcttgagggtgttgtcatgccgtcccatctcctctagtgggttgtcgggtgaaaacctatctcggttctcctttgagacctcgacagacggcggtggcggtgcttttatcgcttctctccttggagacgtcatccaggaaacccccttaccgaaacctcctaatcttcttatgcaagctcgctatagattccggttctattgtgtcggtgccctagtttacgcaagttggccacgtcggagggcctagggggagagtggttccattcttctctctcaccctctctccctcaattccaaagatgtggatagagtgtagttatgtgtcggttgttagggttgggtttcgggcatcctcatcagtagttcctttactggtctagcggtggctggtccggtgctagccttctcccgggcatcctctagtattagtgttgtcggggcgtggttgatggctattttatcttcattagttttaattttatagtaatttttttactatatcaatattctatcaatattaacttcacattgtatgagtcgttaaagaaaaatatcgaacggttcctccgttctatcaatatttttttacagctgcacgcctggacgcttcctccaccctcagagcaatacaaatatattttaaagagataaataagaagagagaagagcaacgggctacagatttgtagtcagctatagcacagactctaagacgcattgtgtgtatgatagttgaaaccggatattcagatattaatagtatagtatgtataatgagctattacattgactatagattaaattggagctagtagttagctatactattaaacttgctcttaccaccaactgccacctcacgtcccatcacacacattcacactccacgaccgcgagtccacgaccacggccctcgcggcctccgccgcctcgcgccacgagcccgcctccacccacaacccccgcgacctcatcccgtccctccacgtttcctctctctccatcctccaccgtccgatccacccacccacctcggaattcgtgccgctccacccaccgctaatcccctcatccatcgttgcctccgccaccccaccccacttcacacacacactctcgctctttctctcgccggagaagccgaggacaccgcacgcgaacgccggtgggtcggccccccgccatggggcgcggcccgtcgaagaagctggcaaagcggccgcgggctgcggcgcgtggggatcaggaggagggtgacgggaaggaggtgaagg

SEQ ID NO: 48509 - DNA, 1501 bp, Oryza sativa
aaatattccactactaactaacaaggaataaataccaattaaaatgcgaaaaatacaaaatcattgccaataaatagatcttgattttagatgaatttagctgtaagtttcactagatttggacttaggatgagtgagttatgggtgtttaaagattcaaatttaatttaattcaaacaattgtgaaaacctactgtttgcatagttttcttttagtgtccgaattggttttataaaacaaaagaactctagtcactgataggtggttccaaagtatttccaattaatttgctaaatattttcccaaggggtataaaattttctaataatttgtaaatatttttccaaggggtttaaaagtctttatcattgacaagtggagcagggatcaaagtcgactgggtcaaattgactagtcaatagtctaatacccacatgtaagtgacacaaaacataaaaatatctatctatctataatcttctataataatatactaaacagtccattaacctcccaaaaccgctctcaaaatgccacgtggttccctcaaaacactctcgagttgtcacatggcgctcaaataaattattagagaaattcttaaaaattataaaaaacagaaaatctacccttaatttcagttaaatcggtgggtctactattataaaccattagattaatctatccaagaaaactaataccctaattccgcccacacatactttcgcggcgccgttgcccgtctcctctgcctcacccgcgtgcgtgtgtaatcctccctcctattttttctctatagtaattaagatttgcagcattattctgttaacatgagtaatttaaaatagtatattagatacttcatatctctcaagacgcctcacggggccaagggcatagacttccatcgttatatatagcccaatctgccagctgcaagaagtgtcttcatgcaagcatatatgcatgcgtggacatgcactacgtacaaataatttttaactttatgttgagtcgatttatttttagtttattttttaatatcctgacatttcaatcaattatttaaggtgtgtatggactatgattattgtcaaatggaaaaaaagtgcgagccatgtatcttcacgctttacattttactaattagttcctccggtttttcatagattgacgctattacttttttagatataaatttgatcatttattttattcaaatattttttttaaagtataaaaaatgtaggttatgtgaaaagttccattaacgataaaccaacttacaacaaaataaataaatgatagtcacgtaacttattaaatgaggtgaatggttaaatatattagtaaaagttaacaacggcatctattaaaaactagaaagaatataattcttaaaaaaaaataatatgcaattaggtgaaaagcccataacacaactgtcaggttacaaataaggtataccctctacccctggatatacgctatacatcgata

SEQ ID NO: 48510 - DNA, 1501 bp, Oryza sativa
cagcgtaccccaataccctctatatccggtctacgggtgtcccccatcgacaacaacataataatcaccgggtcttaattgctagcgaggcttctttgtaaatactaaattaacttattgaaccacatgataaaacccactcttgataattagctgtcagttgtaaaaagtaaacaaaaatcgaagatactaattaaatttgaattcttactgtagtatttgaaattaaatacattgcaaaagaaacaaacaaatatacgcaaaggaaataaattagttccaaccaattacttggatgatttgttggcttatataccaaaattcctaggttgagatcataaactattcggtaaattggtcagattcaataaacttcaaacattttaggacaaaatttgacttctatagagtataagtctatctttaattagatgacgtagtcatattagcaatatgtttaataaacaaatatcttcaactaatttatcctaaaatcgaaaaacatctacagtataaaaaacatcatacaaaccaattccatggttgtgattgcgacaccatattttctcataaataaattcaagacttcacgatttcacatgattttagtttacaatttatatgatgcaagggtaattagaaaaaaaaatcatttccaacgtaatcccaaataaattagaatagagtaaaaaagatatttcaataaaaatatcactcacgcatatatatttgttataaaattttgagtggtgatccgatgctctctactgatactattatatcaccagtagaaatgatctgatccattcgttatttactaatacattgattaaggctaaccttttcatttatatatttttttcgggctagattgatcaatctgtggttatttattgtgctggcatcgctcatattccatcgaaataagccaaacaagaataaaactaggtttagtgactactaaatgataattataccccttacgcactttttttatagtaatgtctctccatgtttgaactactgctatttagggtggtagtataaatagatctaaatcattcgatcaaataagatcaacggattagattactttctactatcaatagagagaatcgtagtgggtctcaaattttaaacgtgttaaacaagatgcccgcgcatgtgcacgggctaccttgttataattagattttctaaataactagtacccacgtatcaacctacagattttctatcgtatcgccataacagtgcacacgtgtacaaataaaaaacgaaatcaaactaccatatctaactgtaggccattcggccattgacaacaattttctatttccacgctgaacacgagccacagttgacagttgaatcgctgagcctcactctatttaaacccgtcactcgtacccatgctaatacaacaaacataccacagtcgcgagaagttaatcgcgatcgagatagctagctagatttcaatttttaatggcaggtcagc

SEQ ID NO: 48511 - DNA, 1501 bp, Oryza sativa
cagtatggattgcagtaatactttgttagtgaaaattcagtattcagtatgcagtatggattgcggcttgtataacagaaattgaaagcaaaagattcagtttgcaatctggacagtgtactgtacaacatgtaattcacatacgtaaagcttgttaaatatctccttgtcagtacattggtaacaaatgctttgagtgtaaatgccaagggtatcatcctaacattggtatatatttttagccttctgtatggaatgcagacatggtcttctttgcaaccacagcaacagcttgccctacactctgtgctgtcgtcatagctaaccaaataacctgttagtactgatatatatggtcttctttgcaaccacagcaacagcttgccctacatggtcttctgtatgcttgactaaacttgttacttgacatatatgcttgactgaacttgttgcttgactgaattattccttacacatactgtagtacttgcttgactgaactatgtcaggatcttattaaaaaaaatctatgtcagcactgctactatgtcaggatcatcagtatgatgcttaagtaacctgttagtatgtcagtacttactatgtcaggatcatcttctggaacttactatgtttgattttcttatgctgccatcggtttcaattggatttgcttcttatgttttcaggttgtatcctacagaaggcttcgtaaattttctccaacagaactgtctgccgcagccacaagaaggtgaaaattttcaccttgttggtcagactaccaacacaatgtctactccaccaccaacaccccaagctgcagctaacaatacagtccaaattgatattcatgaagatgcaatcaatgatgcaagtgctaaaaagagaagtttgagatattggactcatgatgaggaagagagattggctagtgcttggttgaatgcttctaaagatcccattcatgggaatgaaaagaaaggtgatacgttttggaaagaggttactgatgagttcaacagaaaagggaatgggaagcgtacaagggaaataaatcaattgaaggttcattggtcacgcctcaaatcatcgattggagaattcaatgattactggactaaggtaactcaaatgaatacaagcggatatgacgatgacatgctggagaaggaggcacaacagatgtatgcaaatacatttggaaagccttttgcacttgtgcattggtggaagatactgagaaaagagcccaagtggtgtgcaatgattgagaaggacaaaaacaaggctgaagtggttgatattccagatgaacaaaagcgtcccattggtagagaagcagcacaagccgagcgcaatggaaaacgcaagaaggacagtatgtcagaaggaattgtcatcctaggggacaatattgaaaaaattatcaaagtgacgcaagatcggaagctggagcgtgagaaggtcactgaagcacagattcacatttcaaacgtaa

SEQ ID NO: 48512 - DNA, 1501 bp, Oryza sativa
ggccatcttctttttcagcctctccaccggccacctctactagcaccttctgccggcctcccccaactccactggcctcccccaactccttatggccagcctcctccctccgagcatggaggcgaccagattcggcataggccggattgaccgcctcctccacctgccggctaccagcttctcccaacagccagccaactccaccactgcgcctcctccaactccactcccgtcggccttccccttctggatccaaggtgaaggcagccagatccgaaaccggttgaccgcccctccatatccggccacacccacaccgccacatgccgattccaactcgccgctgcctcttctcaccgcctccaccccgctgctatcgctggagcagctcgccgccgggacgccgcagctgccgctaggacgtcgtccctcatcccctgcgcaggagaggactcgtcgcttcacggctgcctaccccgccgccgccgtccttgctcgccgagccatggctcggccccgcttgctctggcgggggcgaggtggaggatggagggggaaagcggcggtggctagggttttttccgcccgcccagtcgcccgcgatgggagcgacgcaagcaggaaagacaagttttttacaacgcatggggaaagcaatcaatctttataacagtccgcagtaacacatagggaattatctagttttatttatagctaggtttagcagcgaggcctctaaattatagatccggtctggtagggagggggtcaattgatcaatatggctgatgctccgattctctagtgccagtttcatatgaattcgtgtgatactcaagatgaagtgaagtgactgctgaaatagaaagaactcgatccgtccctagaaatcacaggaccatagagataagcacagggaacagtacgtcgagtgcagaactgtcgctgcttttactcgtagatggcttcttttgggctctatcgtatcggcgtatcgccatgacggtgcacacatgtaaaaataaataaataaataaattaaaatcaactaccaaatctaactatataaacgccattaattcggccattataagagcaagtttaatagtacagccaactactagctccaaatcatctatagccaatattataatcaattcatacaatagttgcttactatactattaatatctgatcctacctgtcatacacacagtacgtcttgaagtccgtgctgcagctggctacagatttgtagcccgctgcttatctctctctttctttatctctttaaaatatgtttgtagctggcttatagcctgctattgtacctactctaagcaatatattttctatctccacgctgaacacgagccacggtagagtcactgctcacagcttcactgtatttaaaccccagatgctcacacccatgctaatataacaaacagaccacagaccagagtgaggctagtacatctcatttcaatggcaggtcagg

SEQ ID NO: 48513 - DNA, 1211 bp, Oryza sativa
catccatcctggtgaggaaccacatcctctttcccatctctctctttacccacgcacttttttttctcgaatttgcgtcaaaccgcttctgttctagaaattttccctaacccttaacactaataacagtttgatggttcccaaaaaggtttggtttttctttttttttttttaaaaaaaagaggtttgggtttgggggttcaactgaagtgaacccccatgtcccatgttagatccgccactccttcgtttgaactagtgaaagctacgccattctcttgataaaaaaaatgaaattgggggtaaagaaatgatctttaattctgttgggtgccgattccaccctgttcctgttgtaccagtccggctggacaccgcaaaaatggcaagacatgatgtagctgagagaggagggtgctgggctggcatggaaattgacgagggggctgcacgtaatttgtttgagaatacattcaaatcattttttcatgacttatcttcctgtagaattgaacatttacaaacttgaagattttccctcattctgatggactacagtataacagtagcttagtcgataacagggagcttggtgcaatatacagctgaatcttgtttggtgaactaggaacagagtactgaggtcaatatggaatgcggtgtatcggttactccccaagggtgcttccagcccttaaaaaccatgcaaatagtgatgatagattatgtgaaaaagaacagtaagatagggcatgttggcatcttctacgccacaaattttcatatccaaactgcatcaagatgtcaagaaacaaaggagattctttttagcagaacaccttcctttttgtttcttgttgtttggattgaatttagattgacgttttgtggattgttagatgccaacatgctctttactactaaattgttccagattttttattactgcacatgaggttgtagggggttattttagatgtgcccataagcacccttaaatgttcttgttgttggtgaaataccttatacatcatgtcttactctaaattacacaatctggttatgtggaaaaaagaaagtaactgatgtgttctgacctaaattttcatttttttttggcagtgcattgtgtcaaaggcattgggctatatccttttgtatttgtgtttcttggttcatattgaaggactgttgacatttttgagggaaaa

SEQ ID NO: 48514 - DNA, 1501 bp, Oryza sativa
gacgtcgtttagacatccccttgctgaaaccactcaaacgattggtgcaagcacactctagatagagttaggctttgtgttggttgtgggcgttttttgggcaatctcgtctatgttcctttgttggtctagcggcggtcggtcacgctttgcgggggccggtccggtactagccttctcctagacctgtgtgttggcgttgtcggtgtatgggttgggggatatttttttttcttttttcctggtacgaccttccagggtcttgtaatttttttcctgctctatcagtaaaacttcgcaccgtctcatgcgagtccgtcaaaaaaaagtatacaaggcattggtatagtataatggactaagcatgatgaagttatattatagttaattgaaagtttagaaaacctatgaaattttttaagattgtcggagatatgggcccgggggtatgcgaagtgaggggaatctacattcccatcctgccacgtgtccctacagcctggtcctacccccgcattccacgagtcgcaggagcggccggaggggggaggggggcctcggggtgccgcgtcatgcccctcgggcccttgcaccgctttgccccaaggccctcgcccagccgccatttggcggggggagcaagtgaggacgaggcccaggctgaacctccttttaagcgcgcagcgccccaactgctccctgtcgaatttaatgcagtggggcagacgtgcggcgtgcccgactggcgcgtgatggtcaagaatgaccggtctgtgaccggcctgacgccggtcacgtctgactagacagacaaccgtgctcccacgtcgcatctgcctccggcggagtggaggtaggtatgacccgtcccatcggagggtcattcggagggcggccaccacaagtcttcacccattaatgagggaatgacaggactgtcccccatgttaggcgagagacggcgctgggccccgctcaaggataagctgtggtttagctttcaagcaaaggcacaggtcgagttccggtcaaggtagggtgggtccccatccgagagaagagtaggtagaggcggtgcatgtggtatcccttgaggtataaaaggaggaccttgctcatcgagaaaggggatgactctcggaaaacctgagctcgaggaggagggaactaagtgtgttctccggagtttaggaacccttgtaactctcagtctaaatcccatacacaggagtagggtattatgcttcatagcggcccgaacctgtataatttggttgtgtgcgagctagctaggagccttggggacggatacgtgatttctagaggcaagctttttcccctggccgaactcactaaagggggggtctcacgatctcccgctagagaggatcactcctcgacagctggcgcgctaggtagggggaagtcgcgcgctttaaagagaagtcgttttcttctgccccaagtttccctcggccctcgacgatgatggtcgaggtcc

SEQ ID NO: 48515 - DNA, 626 bp, Oryza sativa
ccccctcccgggggatatttacaaatccgttgagaagcggttttgaggaaggcggtcacactctcttttccctgggcgcggggggggtgacccctttccccccgtttagagtaaaaaagcccccgcccagagggtgggcccatgggcggcctccaaaataacctcccctcccttttaaatgcccgcggtttcctccttcaaagtttattgtctttggccgggtgggggaccgggttccacccgccctcttccaaggtttgcccgctcttgccgggaaaaaaaaaagggagaaggggaaaaaatattaaaaaagagggaattgggaaaagaagagagaaaaaagaggaaaggtgagtttggatttacaagtgggggccaacagggttcccacaaattttttaattattttctatgtaagattgacatgtgggtccccggtttttatattttttccggtcgaattgccatgtaagcgccatgtcaatgccccgtcaaccaaagaccgagtcaattaacccacgtaggcgccacgtcagccaaaactgctctcaaaaccgctaaggaacataatttgcaccgtttttaatagttaagggacccgttgtgtctggttttctgatcgaggg

SEQ ID NO: 48516 - DNA, 633 bp, Oryza sativa
gtgagagaagaggcccatataaagagccgaggcccaccccacgaaagagcaaaatcgcttataatgagattggccgcaccagagaagccccccacatataaaattttttgagccgcgaggccgcgaaacacccttatgatggtaacccatggaggcgccacggtatttaataattaaggagaatatcgccggacgcgccgacaaagaaaataataaaataacgagagcgaggcggacccaaaaggggtgtaaaaagatatggtcccgaacgagggaacatacacaaaacggcgagggaataacgaaacagaaatagaagggtctataccctcaaaaggacgaaacaatgattgtgtccgcgagacacagagaaagaggttttgaaatacaattttacagagggaaaaaacaacctatttttccgagaaaaaaaaacaaccactgaccaaaacgggggaaaagatgaccaattttaccccgaataggcacccaggggaagaacacccgatttttaattgagcgaatagagagatgatcaagaggacaacatacttgtcaaaagatggaataaaagaaatagtgagacagcaaataaaagaacgggaaccccaaattaaggtgtacccttaaaat

SEQ ID NO: 48517 - DNA, 213 bp, Oryza sativa
ttatcgatgccatcgcgaaaccctaatctgataacaagctctgataccacttgttaggaaacgatgggcaaataaacaataaagaacaatagatcaatcacaaaagacacgagatttaatgtggaaaaaccctcccaaagcatgagagagaaaaacacaggcgccagccagcaaaatatctttactatatcggggtgaggtttcaacgccgca

SEQ ID NO: 48518 - DNA, 1501 bp, Oryza sativa
gcttagtaattcctgtaggaaaaagcaggaaatcacctggtgtatatatattctttacccattataaaaatctaagatgttttcccaagaattttgtatgccgtccctatccgtgtcgagctcgcatccatgtcgttcatccatcaaactcaacaccatgtattttcttccgattcccttcttccatgcgcacatccagattgtgaagagatcgcagggttcccgcaggaagcaaaataagtctgatattgcttctgatccgtttgtggctgacccagaacctttaaggtttgaggaaaatgaacgagtatgcccggttgctggccaaaaaccttcaaaatttgaggaacacgaccaaacatcttgtagacataagagatgaagctgcaaacaaaatcaagccataaaggcttttcaccacaacagaagatgagaatttcataaaaaaacatacaatcataaccaaaccaagaaagcagagcacacaccagcatctttgcaaaccactgcctacatatgccggaggataggggagcactgccaccctcgccgtctatggaggctgctgccattgccgtctagggaggacaggggagtgtcgtcgcccttgtgcatagggagggatgagaagggccgggggagcactgctgctctgcaccgagggcaattacccatgatctttccttcatcgcatccaacggccagctccttgtcacgattattgttgtcgttgtaggttctctgctcagatctgcctctgacttgcaatgcttcacccttggaggacgacgcatcagactgatccaaaccttttcatcttctccctgttttggagtgcctcataaacttttacaagggttagttcatcacagcttaatagtatggtgtcacaaaaatttgcataagaactaggcagtgagcataacagtagaagacctaaatcttcatcatcaaactgtacctccatcgacactaggtcggcaacgatttccttgaagaccgatatgtggttcaacacagaaccactctcctgcaacttgtgcgtgaacaatttcatcttcatatgcatcttactggttagatccttagacatgcagatcgattctagtttaagtcaaagttctccaacagttttttcctgcaacacttcttgcaaaatatcattagacagatgaagttggatcagcgacagagccttacaatctttccgcttctcctcagtggtccattcatccttcttcctcttcccgaagctttccaacgcttcatcatgatccgaagattacgctagaacagcccgcatcttaacttgccacagcgagaatctcgtcttatagtctagcagcagtagatcatactttatcgatgccatcgcgaaaccctaatctgataacaagctctgataccacttgttaggaaacgatgggcaaataaacaataaagaacaatagatcaatcacaaaagacacgagatttaatgtggaaaaaccctcccaaagca

SEQ ID NO: 48519 - DNA, 564 bp, Oryza sativa
  unsure (1)..(564): unsure at all n locations
ccccctgcaaagcgcgtcgaggggaaatgatcaaggttctaacccgcgcagggttccgggtttaacgcataaaaaaattttttttaaggctatggaagccnacgtgattcccaccatatatgaacttttattgggttttgtaaggggaaatacggtcaacctctcattggcaggaataaaagcaactaagtttgatggtatgtaaaactagattatcagataagttctttaaagtaaaattttgagattatgcacccccaatttttggttttggatatatagatttagttatgatcaattcttatttacatgagcattaggctttaatagtgcttaagctgggtccatccggtctatgtatacttccgtgcggcaaagccgcagttattttctagtgcaacctgattgaaggtggatgaatacaagtgtatgtgttttaattctcaatagcaaatccagcaagtggagtaataatacatgcatattgccatgtcggtatacgtgctaaattaatgcatcaattggctttactcctctctgctgatctggttcatctctaatagg

SEQ ID NO: 48520 - DNA, 1501 bp, Oryza sativa
gatttggacagtcgtccgccgcgttgccccgcgcgtggccgccgcttgccgccagcgtgcgcgtggtccctcgtctgccgccgtcgccccgcgcatggccgccgcttgccgtcgtcgccctatgcccgctagccgccgccgcccctcgccagccgctatcacccctcacttgccgccgtcgcccggtgcccgccgccttcctcctccgccgcttgcccctcgcccgcttctcctcacttcctccccgcttctcctgcgccgcttctcgagagttcgagtgaatggtgaataagaagataagggaaaggtgaaaaaagaaaaattaatataaatggatggtagttgaagtatactattaaaatataagaggataagatatagaggatgtaatatggatgatctgttggagttgagagaaatataaaggagtaatcttttttaatgaccatctaaataggcatatggaggatcgaatatggatgagctgctgaggatgctcttaaaaaaacaaaattgggcaaacaacaggccgagattaagcctaccgctaattttacatgggcaataactacgaataagttcatttcagctccctcatcttgacgtcgagtttgaatcatgtccttctaaaaccagtgcaaacacggtccctagacgattttaactgacgtaacatcaacatgtctggtttgacttggtcctcatcccactggacattgacatgacactaaaagcaaaattataaaagtttaagcaaaatatgtggggccatatatcatcagtcaaataaaaagataaaaaacccacatgtcagtgggagatcccacctccttcacctccggccagcgtgcctccatgcatcgccttctccctccatagatgtgggcggtgggcagcaagagaggagttggacaacggtgaccagcaggagagggtgcgccttctgcaccttgcactcgccagagaacgagatgggggctgcatcaatcacctcagcgaaccgttgcgtgaatttctcaagccattttttgaaccatatattttatgagatggggatccatttttttagccatatacccacataaatgtgtccttcacatatttgttttattattttctcactggatttgcactggctttaaatgttgggggacgttcaatacccagtttagtggttgagggatacaaattaaactcgaccctatctcgagggatataaagtgaacttattccccaaaaatttcgtcttccaactgacgagccgaagttaggctgatcatccagaatggacctaattaacgaccaccatcagcagaaaatgggccgtatttggaccatgactttaaagaggcccaccatatagaacgaaattaggcccataaccttgctaattattaatgggttttggcccactctatttccagtttagagagcccaaattaggacaagccagcgtctctctctttctcgtctctccaatggcggcggcggcggcgtcgtc

SEQ ID NO: 48521 - DNA, 1032 bp, Oryza sativa
  unsure (1)..(1032): unsure at all n locations
atgcaaaaaacaacccccaagttaaggcggtgtttcatagccggtggggtccatcatgtgaagacgtcgaaggtcgcgtcggtcgaagaactaactgtacagtgtggcgcggtagaagtatggagaggcgccaattggggaaacaagagattacactcggggatttctttttataggcagagaagggcgcaaacgggtggggtgtccccttatttgtccggcnacgtgggggtgtaaataaagagggaagaggccaacnacgtgggcacaagttggggacgaagtgggggtgcgaaaaaggacggaaaaccgcggcggcgtgggcagtttcggcggtaggtgggccccacctgtcggtgacccgggaagagaaggaaggcggcttgggccggcccagcaagaaggatgggggcgcgggagagagatgggccgacggtccatcaagagaaaaaaaggaaggaaaagaaaaaagaaaaaggaaaaggattttcctgggattaaaattgcaccttgatgattttaaatggttaaaaattatttatagggctctgaaaattccgctaaaaatcatgttaatgcattgcgacatgtggaacccaagaaaaatcccacgatgccaattccaattattaattgcatttattaattagggaattagctctaggttaattcaaaccatttcttcggatgatttatttaacaaattttaaggaaagaagaaggggaaaacttgagagcgtgacatcatcacgcataagtacactagtgacatgtttttgggttggtacaatcctctacactgccaaagcaatttctagcaaaatatatatatataaaaaaaaggttagatatgagagcaagaacttctgtatcgaattttataaagaggagtgagacctccagtcgtttctcattaatcatattgctcaattgttcaactgctttggtttcattaataaaagaaagagaaaaaaccattgtgtgaagcttaagagccgcttctaatctgcccttgtctaacacattcattta

SEQ ID NO: 48522 - DNA, 619 bp, Oryza sativa
  unsure (1)..(619): unsure at all n locations
gtgtgaaaccttgacnatgactgaacactggcacanagcnncataatgtgtttgaccattcgtcttactcaaaaaaattaagtagttatttattcttttcatatcatttgattcgttgttaaatatactttcatgtacacatatagttttatatatttcacaaatttttttaataagacgaatggtcaaacatatgctaaaaagtcaacggtgtcaaacatttcgaaatggagggagtattatatactgaaatgttcgaactatttgaccatggttattcgaaataactgaattagcaaacaatttaattataccacctgcttcgacaggtaaaacggattgcagtgctaaactctagttctagacgcctggattaaacatatagcatagtttagaccaaatacttcaacaatgagtaagggggggaaccaggagcagaccagcgaggagggcgaggtggaggttgaggcgggcggtggaaaaggcccagttgcccgcgtgcccatcggtggacttgaagtagcaggtggcggcgacggcgcggggcggcaagtaccagagcccgcagcggaggttggcgaccagcggcagcgccggccacagcgccgcgatctccgcc

SEQ ID NO: 48523 - DNA, 1501 bp, Oryza sativa
aaattaaatacattgatttagggcatgtttggttgacacgccgaaccccatgcctgagaaaaattgaagcctgaaggtggcctgagaattcatgggttcttcttgatcaggccatcttacgcttatgtgtttggttggaagcctgagcctcataagtcaaaaaatatggtttatgaacgagaaagcatataatactcaataaagaattgcgtttccttaacccatcttatatgaattatacgaagaacagagaggggcaccaagtgagctcgccggcagggaagttcggcctcagaagtaccaacaaccatcaaaatggaataaacagagcaattcgactctaatggtggttgtttgcacttcgtggagcagccgatgatgggcatgcttgtagtatcgaacaccgcaggtcttgtggtagcaataaacgtgtaaagttttgatgaaattagattgtgggttttgattagggatgttttggctgcaaggaattggtgctcggtggccggacttgagaggaagaaggtggtgctcggtagctgaaacccacaattaatgtggggaaaatgcttaggagatagggagcagtgcacacatagaaggaatttttgtttgttttcctgtcggcgacgaattgaaagggttttgcgagcaacttgaagctcattctagtgattttttatctgagtgaaactaacgatgcttgatgttggaatctcctgaaaatgaagatgaaaatagggttggtaataatatgtgactaattaagttttaattattacaaacttaaaaaatggattaatctgatattttaaagcaactttcatatataaatttttcgcacgaaacgcaccgtttagcagtttgaaaaacgtgtcacgagtatccaaaatttatgcttgcagaagaaacgaacagggccgtcacgcctgacgacctgagtcaggtgacgtttttcactcgcctgagtcgtggaggaacccatgatagcaactaaacaacccccaggccttagcctttagtgactacagaagaatttgctttcatttatactttagtcggatatacagtaccaaatatagatagaatatttttatgaggactcgggttagattctaaacttgtatgtcaagaaaataccagggatcctagtcggttacgattgtattttatctgtaatcccatattccgttaggatatggactgtactttgtaatacggatccctttccctatataaggaggggtcagggttcctctcgggacgattcttttttctcccaatcatacaatcaataacacactcggtggaatcatccccggacaggagtagggtattacttcttaaataagaaggcctgaacctgtataaaattccttgtctccaaacccatccactttcctagcttgatagccacccccttttattattgccgaaatcttgtttcgacagttggtgcgccaggtaggggtagcgtcaagttctcgccgactaagtgcga

SEQ ID NO: 48524 - DNA, 726 bp, Oryza sativa
  unsure (1)..(726): unsure at all n locations
cgggccttgaatggcatatcagatcgtacagnagctcatcaaggagaagaagaagagaagagagaagagagaagagagaagagaaggagaagagaagagaagagaagggaatgaaatgtgcagctgacatgtgggccccacatacttttttatttttttttgactaggatgccacatcagcaaaaccacccatatatactacctagggacgttgagtaaacggttttgtatagtttaggggtgaagatttctggttttgtggttaaggacgttaaaaatctcgctattaaattgagggacctctggtgaacttattccttccgtaaaaaggaccttgatgactaagtgggctccgattctagggccatacccaaaacccagcccaagattcgttttctgcgttgtgatttagcccataaagaccacaggcagacaggctcccactaccactaacgagaagctaccctcgagtccgacggagaaggggagggctaccgccttctgcgccgccgccgccgccgccgcggcaggttggccgcctccgatcgagtcccgctggggtgaggtgagctcagcactgtacttcttgtgcagtatttttggtttcctagatttgcccggttctcgcttggctcaaactcgttctatccctagcttgccccggcgcccgccgcttgttcgacaaaatggctgaccggaagaagtgcaaggcggcggcggtcgcca

SEQ ID NO: 48525 - DNA, 1501 bp, Oryza sativa
ttgaagggcatggagaagtatttttggcttagagttcccctgagttggaaaccagcacccccaacgacgcatggtttgctcttatttggctggggcttgaggaagaagatgcggtggaacaaggcgaaatgaggcctaatgcccagaaaagcttcgcaggcatgaataaaattggcaatatgcactatggagtttgaattcagatgatgcaagctaatcccgtagaagtttagaattccccggaaaaatcttgaggttggaagagaaaatctgccatagaagaaatgagcgaataccacgatctcatgtgtatctggggtcgggaatgcctcaccaaatgccggtcgccacccgatgatctcttttgctggaagaacgacgtgcgccaccatctccttcagattgtcttccgttacatcggagggcgcccactgactttcgaagctttctctttcctctgccatgaatgtgaactggacggtctgatttagttcgagatacggctggaaagggatggggaatcggagcggtggatgcgaggagaaatttcgcgaagtttttgagggtggattggagcggatcgatgaaccctagtttgcccggcgcagttttgcactgtagcagggaatgttgaaaatggcgagagtctcggcggggaagacgaagagccgtttttcacttcggcattattagggtatcgggagtactaatgggcctggacctatacagtacttcagcccaatactataattagcgtggcctgttgtgatccctaggaacttaggcgctttttgctttggcaatatgtgctcacgatgatgcggcccgatgctgttaaaatcctttttaacgcgattcaataattctttggaattattatgatgcacattaaaaggtgcccgacagaaaggtgttataccatttttgtaaacctttttaggctacaaaagctattgggttaatttgagatgactggtttattagtagtcattctcctagcatgttatatgcttattttgattgtggtaagggttatagcctaggctaatgaacttattaattaccatgatctttatcatatttggtggatcattttaagagtttcttacttggattcttaccaaatatatctatttttggaccttttgagtgtttatcattcggccctttttatattttttgtccttgatatgttctagttgaggagcagtcggctgggtatcttactaagtaccatgcgtgcttcgctataaaaccactcggttcttgactatatgtttagtttttcacatagtcgggggctacacctaattaggtgcatctactcgatgcaccatgttttattttcgcccttcacagtttctgatttttactactcggcaagctggagcaagttgaattgaagcactcggactactggtttttgtttcgagaaggttatttcgtcaactacgaaggtctcgggggctactgtggagataatggataccccatatctgca

SEQ ID NO: 48526 - DNA, 1501 bp, Oryza sativa
attcttacctgtgatatttatctgcaaaatggatgacatcggtaaaaatatcatgagatcctaccacccactgtgacgtactatgttgtcatttatgtatttcagtttaagatttgcaatttcacgtatgatagatttttgcacttctatctttcgatttttcatccatatgaagctgcattaagattcatgtttccatatccaacttttagttacacccaattatagaacacttatatttggttatggagcacttagttacaatgaatttccactcagttgcagagcacgaaattaaattttataactgtttttgtctctagatttacaatttttgacctgttcctttttttcttatttcattcaaaactagttgtatccattagttgaaaattctgtagatttgaagctttaaatttatcgaacaattaataggtaatcccgtataaataagattatcgcacgcaatgatgtagtagtattgtgcttgcacgaagaagttttgatcctcccgcagtactagaggatccatacaatgagaaattggtacaccgccaacagggtgaagtttcatcagtaataatcaaaacacttttatgtctacccactcccctagcttgcatcccaaccctcattggagagtctacatatagtaatgcaagtagaaaattaattaagtagagtcaattctcaattctttacagcagtgatggtgtcatggccaattattttatttccaggcaagagacgttagttccatgaccagaaacaatactttccctcatagaacatatcctatgcatacaagttttttatatgcactccgtacaaaccaattaacaaatatcacgaaaaattctcgaaagagaatctgacatgtatttttaatagtattacaaagtcttatatgcaaattcattatattttagccttaaaaaagtgagagatctgacagttttcagagtaaaaatctgtcagaattttgtcttttctacaagtaaaatataataaatttgaagatgagatttcatagataatgaatttgcctattgaaaagtccaatcttttttagaatttttcgtgatatttgctgattggtatgcatagagtatgtatggaaaccttgtgtgtataggatatgttccctacttctaattgttaagtagatggtcgttgtcattgattcttatgcttgtatttgactattcatcttattttcaaagaaaattataattataattatttttatttggttttgtcattaataaagataatttagaaccacttttatttttatatttgcataaaaattataatatgataaatgataagtatatcctaaagccaatagcgtcccctattaaaaaccgaaaggattactatttataaccctcgtaatcgcgccagagtcagacagacgatcgataggaagtaatgcaatcatttccatcgttcaagctcagagaagaagtcgagcagacagaaatggcagcatccgatc

SEQ ID NO: 48527 - DNA, 1501 bp, Oryza sativa
tggaaatgggctgaacaaataacttgtactatataaaataaagagtaaagtccatcaccggtccctaaacttgtaccgctatgtcatcctggtccctaaactcgcaaatcgatcgttcaggtcctcaaacttgttcgactgtgtcatcccagtccctaaacttgcagatcacttgtttaggtcctccaacttgctcagttgtgtcaccccggtccctaaacttggatttgaatatcatctgggtcaaataggacggtctaaagactttatatttaaaaataattcataaccttttcacgtgaactctaatgaagataaactttatatcaaacttgtagtcctcgacacgatctacaactttgtagttgaattttttttattttaagtcattttttgtcccaaaatgtaattttaaaattaaaatttcaaaatctataaacatgcaacaatattttgggaccataaacagttttaattcaaaaacttttcaactacaaagttgtaggtcgcatcgagggctacaattttgatataaagtttgtcttcattagagttcacatgaaaaagttatgaattattttttgatataaagtttttagaccgcctatttagggaccggggtgacacaactgaacaagttggaggacctaaacgagtgatctgcaagtttaggtaccgggatgacagtcaaactagtttgaggacctgagcggttgatttgcgagtttagggaccgggatgacacagcggtacaagtttagggaccggtgatggactttactctaaaataaatgtgtagtttgtttcaaaagaggaaaaaatgtctcgcaaggaaccgtgccactgtcctagtcatcatataaactacatcatgctattatttcaacttaacttgtagaaaagcaaggataggtaagcaaagcttttgctttaaggtcacaacgggcagattgattaactgcatacttgttttaccagagagaaccaacagctaataatagaggttatatcttaaaaacttcatatagctagcttgtcttaaaaataattactaacttttcctcaaaattaagagatagtgtacagaaattgtgcaaccatgtaggattcaaacgccaaatacaaagtactttacaaaccttcgaatgatattttcaattttaccttgaattaagggaggccgaggtaaaaaatagtactcaatagtttgggggggggggggggaacataggttccagatgaagggctataaatcttttgcagattgccattgttcccttttcttcaggctgctctttgtcctaagatgcaatacaacaaacatgtggagtgcagggtaagtgatagggaaatgatttactgccaagagaagggagaagagtgcataactgtcaggctagcaacagattttattacaaatagactctacaaccccatcaataaacactccatatattaacgggcatatttaagaaaaaagaacattggaaaatccatttgt

SEQ ID NO: 48528 - DNA, 1501 bp, Oryza sativa
tgcagcatcattttttttttctagatggaagggtccgattaaatttttaaatggaagtgcagtatcacatttggaagagtggcaaacatgattagtgcctctgccaacttcaagaatcagatttaacaccgctaaatactttgcatcaaacatacgcagctggaccactcgtcggctggccctgcatgcacctctgcaattgtactgttagatgaactcaccatccattcccaggaccagagtgggcagctataccaccatgttgatgtggagtgaaaacatttagatcaaactgacagacaacagttaggtgctaatgcatctaagaactattttagccccaacttaattgcttcaaaaaattagtcactcactgtattattcgaacataaaagatttacacaaaacactaaaaccagaacttcagtcctatctttcaactgtattaccagcatagaacaaataaaatgtagtatgtacactgctagtaaatggataagaggagcactttagatcaaactgacaggcaacagttaggtgctaatgcatctaagaactattttagccccaacttaattgcttcaaaaaatgagttactcaccgtattagtcaaacataaaagattgacacaaaacgctaaaaccatatcttcagtcctatatttcaactgtattaccagcatagaatgaataaaatgtagcatgtacactgctagtaaatggataagaggagcactaaaaccagaacttcagtcctatatttgaactgtattacaagcacagaatgaataaaatgtagtatgtacactgctagtaaatgaattagatcttaaacggtgtaatctaagatctaaccaaaaaggacaagatatttattaaacaaaagtgaacaattaaactaagtattcaagtttggaatagagaaattcaagtgaaggagaagttctccatttttgcggcctacaacaaaatgataggacagatggccacaaagtaaaaaaaacactcaatatgttcagattatgaaaaagtacatacagtctgagtatttggaaccaaaaatctattggatgttccgttttgatagcacggacttacccctctaaatttacagcacatcatgcccaagcatctgtaatatatgtcataaatattaaacatcactttgatggagaccgaactttgaattctgcacaagaaaggatgaaatgcatctaagcttgctgttatgggaaaaaagcatataaattttgaagccagctatcctaagggaaaaactaatgcgagttctcataagcatatactgtcaattaaggtatgttcttctatttaactaaagcgtggagatgtatagttctcgtaagtactcagtagaaaaagattgttttactaaaatgaccaaggttatattttctttgttagatcaaagaagataaaaagcaagagattgcgaacatatgacaaattagctaccacatcgatggagttgttaagcaaagcaa

SEQ ID NO: 48529 - DNA, 1501 bp, Oryza sativa
actaagaatgcaaggcgaccccccaatttgaatgttcctaagtgcaaaaaggaccgaaggtgattagactaggtttttcactttcgaaattgagtttcagaaaaaccgtactattaagaggggtttcaagtgtggttctagggtatacacagtgctcttagtcatatccatgagtcaaaagatttttggaatcatttttgaaaaatgattttctccccaggacagagagggctacccgaaggttctggccggaacttccgggcgttgtttcaaagcaaaaaatttcctaagtgctgcccggaagttcctggcacttttgcccggaacctcctggcaggtttcccgttcaaacttgtaagtaacggctagatgacgtcacctagccgttatatatatggatttcgtccccaggtcaccctttggccattccactttagttcattcatgttctagggttttctagtcactcccaagcttcctttgtttcctccactcaaatttagagcctatcttgtgagattgagagaatagatgagagcgtaggagtgttttgagatggcttgaagattagggttgattgagcactttggataccttgtgggctgtcacttgggcttattactcttggagatcttctcctagatggttaggtgtcgcccgtgagcttccaaagatcttatggatgtcccgggaaagtttgtgaaggttttcctcacctccgcaaggaaacgaggtaagtgagtaaagattcttgtgctgagttttcagaggttgtcctaggtagagcaacttgcacttgtggtcttttctagaaggaattttgagttggatcttggtggtcactcaattctagaaaatgatctagaagtgttgagttgaaggctgtggacctcttctgggatctttgcataagtgaggcaaggggttaatcgagacccggctctttggagcaccttaacggagagtaggatccgtgcgatccgaacttcgggaaaaaattgtctttgtctctcttgtgcatgttcgttgtttgaatctgctgatatcttgtgatcttcatcttgtgcatatgtgtgcctgaacttcctagctaggacctgttttttttctcagttttcaaattatctctgctgcccggaagttcctggctcaagaactccggaagttccgggctactcatcctgcccggaagttccggtgttcatcaccaggaggtttcgggccctgtcaatttaaccgctgcgattgttgagaaaatttcaggaaagcctattcatccccccccccctctaggctacatctctgcacgttcaattggtatcagagcaaggtgctcttgattcaagtttcaccgcttggagtgatccacgatgtcgcatctagagggaaccggggggttggatgacaagggagacgcttctagcaccaaggatactggacccaagggagctactattcactttgattacggcaaacttaatgttcctcctcataactttgt

SEQ ID NO: 48530 - DNA, 1501 bp, Oryza sativa
acttttgcagcctagactggatttgcctacctatgtacagagtattccagaatgctaacaattgttcaatcttttcttcacaggaagttgagcacaaatgactcaatgaatgaagaacttcagatagatattgagtacatctaaaaagagatagatattgggtatgcttacaagacagtttgttataaaagggatattctgaaggccaatgaatgcaatagattaatcttactagccaatagatggtgaactttaattgtgcttaatttaagcactaacatgtctacacaagctgagattcccactgtactctaatggatggcatattctaattgcatgccatttagcaatccgttgaagaaattagagtgcaaaaactaagcaaccgaccaacaccaagctatgttcatcgagcaaaccaaccattggatcttccataccattcaggcatttcatcgaacaacagatcaacagctcacaacgagagtgcagtacagaacgtagaggtaacaaacaacatggtaggcatttggtcgaacacctcacctacgttcgcgagatgctcgatgagcaccgtgtacgtcttgcagctgggccgcagtccctcggccaccatctcctggaacacctccctggcctccgcaggcctcccggcgtcgaacaggatcttcacgcacgccgtgtagctcacgagggtgggccgacacttccccttccgcgcgcgcatctcctcccacacccgcatcgcggcgtcgacgtccccggcgtgcgccagccagtgcatgaccgtggtgaaggtggcggcgtcggggtccacccccgcgcggagcatctcggcgaggaggcgcatcatggccggcacgcggccggcctcgccgaggaggtggagcatggaggtgtaggtgaagcggtcgtggcggaacccgccgcctgcgccggcggcgaggcggaagaagaggaaggccttgtggagaggcgggtgcgccttgaggacgcgcgcgacggtgtgggagtcccaggcgaggcccgggagggagaggaggagcggccgcgccgccgaccaggggtggccgcggaggatggcgtcgacgcggcggacgacgtcgcgggtgtaggtcggggtgggcggctcggcggcgggggcctcgcggcgaggtctcggccggcggcggggtctgggtgggaggaagtggcggctgcggcggagcattttgtgccgcggcgatgaaccgctcgctatggagggttgcgcactagctttatgcgacttatttagggggggttttttttctcgtttttattggaaattttcttataagcacttaaataattgcatagcctatcctacctttgataacataacagtagcaaaaatacgtaaaatacacgtgtgctctaaaaaaaataaatgtgaggaaaataaatagaagagccagttaagttgtgaaaaaaaaaagtttaagaagacatgcatggtttctactcctataatacaggatga

SEQ ID NO: 48531 - DNA, 711 bp, Oryza sativa
atataaacgtgtgtaagaatccccccacagaagggaattttctttttaaaacctggtggtggccctgtcggggttccgggataaaccgtttgtgtacccaaggaaaaggccaattttcccgtgtttggttaaggaaaaaaagcttccccaaaaaagtcggttttgtgaagcaccacttcctccgtcgggataatggggtcaagttcaatctctctccaacaaagtaagattgggttgcaatcggtgagtccagccagctcaacaacgcgcttggcgtagcggtctgtcaaagcgtgatcccgaagtcgtcctggtgcacctcgatccccaggtagaaggagaggccccagatcactcatctggaaggtggcctttatctcctccttgaacgctgcgacctccgcatccttggtgccggtgatcaccaagtcgtcgacgtagacacccaccagcaaggcttttccaccattgccccgtcggtagatggccgtctcgtacgggctttgctcgaagcccatccccttgagcgtggaatccaacttggcattccacaccctcggtgcctgccgcaagccatagagggccttgtgcaggcgtagcactttgccctccttgccggggatcacaaatcccggcggctggtgcacgtagaccttctccttcaagtcgccgttctgaaacgtcgacttgacgtccatgtgatggacgccc

SEQ ID NO: 48532 - DNA, 261 bp, Oryza sativa
  unsure (1)..(261): unsure at all n locations
tgtttttttctagtcccctttgagccaggtccctaaaacagtgttatttagcgggcagatttgggggtgttgtttgattaagaaccttaccttcaaaaaagagatgccacctaagcctttttactacagaatgttttccaagatggaaaactgtaaatatatttggtccatgcatgacacttagaagattattcttgatatgtgccttcttcctttagagccatgggnaaccttcaagttacactcttggccaagagaaaa

SEQ ID NO: 48533 - DNA, 513 bp, Oryza sativa
  unsure (1)..(513): unsure at all n locations
tgtttcagctctaaaacctgcaaaagtgtgttatatttttgtaaaacaccgtattatgggccgtgggcttttttccccccaatatttaattcccatgtgcctcagattccaaagaccaaaagaatttcttttaacaaacccctttctttggggtttcgggttggttggattgaattaaaattaacgttttgggaattgtaagatccacaatgcttctttactattaaatggtccaagttttttaattcctgcacatgaggttgaagggggttattttagatgtgccaataagcacccttaaatgttctgttggttggtgaaataccttatacatcatgtcttactctaanttacacaatcgggttatgtgaaaaaaagaaagttactgatgtgttctgacataaattttcattttttttgncagtgcattgtgtcaaaggcattgggcaatatccttttgaatntgtgtttcttggttcatattgaaggactgttgacatttttgaggaaaaa

SEQ ID NO: 48534 - DNA, 1501 bp, Oryza sativa
ggtcaaccgggagcctccaataactctctatttaagttgagatactccacttttaattctcaaggtggtattattatctttaacatttattatgggcccttgagattttaatagaaataaatcgggcctaacccatttattctaacagaaagcacttgtttttttaaaaaaaaaattcaatctactcgatctattggaaagcacttgtttttctaaatttcgatctactcgatctgctgcttcctcatgcttctgagttattcctcttttatcgattttgatccagaaagcacttgtttttcttaatttcaatctactcgtagctttcttgtgctcctgaggtattcgatctggtcctatgaatcggaacttcaactaagtgttattgtcattgctgtaatttctgaagctactatagttgtatgtgctagcactgatgatgcgtcggtgatagaaaagataatctcaagtcgttgctattaattaacatcagttgaaatcaaacatttctgatcaagaaatcaataggttatattttactactacattcttttactttgtttggcatgttatatgtgtaatcaggatatgatcttcttttttatggatcgactcattgtacccaccaaaacccccgtttgacaccgttaatttacaacctaggtgggtcgcatgagacgagtctacgtcggaccgtcccggtgcacgcccacccctatccccgagtacctgactggaaaaaagttccaagacgttccgtcttgacatgtagctaagtattacctccttgcacaaatgtttgacgtcggttagttcgattttgagctaaccaacgtcaaacaaaaaagaatggagctgggagtagcacggatgcagtgattcgccaccaaatcttgagcagcttgcagcgttcttcctttgggcagctacacacacatcggtcttcctgtcttctgtatcagtgctgcgtgcttgtctagtacctgcatcctgtaggaaggaccagggagactaagcatcgttgcagtgactaacttcaccgctctatgaaattcttgaaattttgtggttgtgcatggtgccttctcattccacagggtattgaagcttttctttaattaattggcatatgatttgtgacttaagaagctaatcccaacaccagacactgttaaaacctttggctaacttaacttcatgtttattttgtaatgttcttactatggctgtgttgtatcctggtaagtttcaaatatatactgccggaaactttattttagtacaattgattgtctgatttttttccccttttcttcaagacatggaacatcttaacctcacgcttcttggtctacactatgctgcatggaaagcagtatgtggatcattattccttcatctgaggcataaattaattaaccaaagtttgatatgcaatgcaattgaattgatcgaattgaactaacatctcaaggaataattaagtctacactccgcagac

SEQ ID NO: 48535 - DNA, 1501 bp, Oryza sativa
tatacttatgaaaccaaacaaagcagaagtgacgttgcttaccatatatatttcttgtggtggatcatcttcgagtacaggagcttcgtcattaatatataggaacttgtggtggttcctcttcgggtacaggagcttcatcaccaatcctctttgcttttgcttcatggttccgaaataacgatgcaatatatctgctcatcttcatgttttaccaatcctacaaactatggcatacattcactaatcaacattcaacaaccacaatttacaaagtgcatactcaatcattctcagattcaggaatcacaaatcgatttatgaagcaggagtggacactggacagaggaactgaggaagatttcattacctaaagtagagcagccgatgagccgagcaggaggctggacggtagcggagagccgaagacgggcacgggcagacgggagatggccggcggcggctctgcggcaagccggcaaccggccgacgtccggcagcgaggcgacagctagcgacatgaggagcgaaggaggactggaggagtcgtgctgtcgtcacctcgtcggccagacagccccaaactcggcgcggcgccggcgtggatggcggtcggcggacccacgggcgtcggcggcggtgtggctcggcactgggctgcgccggcgttgacggcggacggcgaacgcggacccacggccatcggcgcggcgcaggcggcggtcagtggcgacgtggagcgggcatcgggcacgaagggagtagcggctggaggtggaagcgctccagcctccaggctcccccaactcaaccctaactcttcgtgggctgttactattggatttgggccaaaacggctggctgggcctaattttttctgaggggtgggggtctctgggccaaattctagggtagtcccgagcccaccgggactaccccttggctacgcccctgccttcagctacatcacatcaaccacaaatcattgcattacctagtgcaatcaacactagatctgcatcaaatcaagttcaaaaataaaataaaaattaactaaccattaatgaaaccaccagatacgcactgtaaacacctaaacaaaagtcccaaatcacaaatatagcaaatacttgcaaaaaaaaaaacgagagtaacaaaaataacagaaatcgacaatgaacaaaagcaataacaaatggcacactcacatggctttgatcagcgatgcatggcttcctcatgccgtcgtttatgcagaggttgctgtcttcacggccgcactaccactcgcggcactgctcctagaacgtgttcaaatctagaatgaaaccatccgcctctgcctccacctcctcgtactctcatcatggatgttgcggtggctactgatgccgacaacaaacgaaggggaaggaagaaggaagcaaaacatgaaagaatcaacaagggaataagtactcaccagagaatctccgttgacaacgagctcctcaccatcgaa

SEQ ID NO: 48536 - DNA, 1501 bp, Oryza sativa
cggatgtgcatgcgatgtcatgcgttggcggcctacgtgggcgcggcagcgggcggcgcagagcgggctcgcctttctccccctctgcccaacgcgctcgtcgcgccgccgccgcgcggaggaggtggcagcggtgctctggccggtgtgagggcaggggcaaaatcgtactctcaccagtgtttctctctccaagttcataggaaatattaaaataaggcctcgagtgtccaggagctaattacacgttttttcgatgtcctgtagcaaattttgcctttcttttattaaccttgatgggtcccactcatagcacttctgatgatgcctatacattacaaaaattttcaccagatgctatccgatccgtgctgtggggcccgccatatgagccccttcctgcactatacattacagatgctcttagagcaaggtcaataatataacctgctgtcagctccaacaaatagccatgtcatctatagtaaaaagtgtagctaatgtgtacaatagaaatagtatagcactaatattttattatcttaatggacccaccatcttctctaatctgcctctttctccctcccctccttcccttttagtgggtctgttttcttggagcgcgtgggtagccggcgcttatttagtcgcttgctctcgttctctctcttccgttttctcctcgagcaaatcgttagagctgacgtgtagtttttatcgccggttctggagccctattgtacctgcttttaggcgatcagacagtcatggtatgaagatttaaaagtcatattcgtcagcgcacaacgaaccgacgatgccgcaagggaggaggctgccgcttcctcacggtggctgcggcgcactaggtcgaggtagggctcggtttcctcgcatcttgcaacatgttttgtccatcttatttagtactcctttcgatgatccagtatgaaaatcatccaaagctttcaagacgtccctgaggattacgaccattgggcgcccggatcaagacgtcttcaaaacaggctttaccaaaggcatcgcgccgccgtgccaccggccacgccgccacacggcgttgccgagagccgcgactaccgcgcgtgctgctatgcaccgccgccggccgcgccccgcacggcgccgccacccgccactgtgatcaccgcgagccgccgccagtgtgatcactctaacattggtcattcatatgtgagcccatagactataggattcacatgttagcctctcaaagtctatttatggtatcatcctgtattataggagtagaaaccatgcatgtcttcttaaacttttttttttcacaacttaactggctcttctatttattttcctcacatttattttttttagagcacacgtgtattttacgtatttttgctactgttatgttatcaaaggtaggataggctatgcaattatttaagtgcttataagaaaatttccaataaaaacgagaaaaaaaaccccccctaaa

SEQ ID NO: 48537 - DNA, 255 bp, Oryza sativa
accccccccccccgaggggtcaggccacgtgggtgatcgcggctgcccaagcctctagtcatgatactcccggtcccatgtcaccgacagtagcccccggcgttatgccagggcgatcgcccccctcgaaggaagcgctcgggcgtgacgccactccttaggcctggtgacaggtggggccggtctctacaggcgggcagaaacccagcggtcgcaaatcgcgcacatcagcaacggaaaaccgactgtctataa

SEQ ID NO: 48538 - DNA, 1501 bp, Oryza sativa
ctctttattatagagtaggagtacagtcatgttgggctgcggacagatcccgagctcacaactgcattacaaaagggaagcggaagccaagacttatgggaaataagtgtttaatgcaggcttcaaggaaaggctgttgttttttttttgcaattgattttatttgaactcttttctaaaacaactaggtgagtgcttctcaaacgacacggatgagacagtgcgactcatccggtcggagtatgtgcaatgtatcagtcttttgaattgatcaagattggcacccagccaacagctttcaaacggccacccgggcctggctgatcccatcagccgcagattttccaaacatcaatcccgaaccacatcagcaaatttcacaaagcagtagtcaaacaaaactacgctaggaatcacctcacatccgcccatgaccgtgggcacggctgttcgaacagtttaataacctctgcagagggggtacactttacccacacgacattactaacccggatcatccagcccgtgcagaacggccacgactagagaccttaaggctttcatgacaaggcatttcgagagccgacacaggttcaccatatgctgacgagaggggtcccagaccaacaacaggttaggtcccagaccatactgtgccaggaagcccaggggtcctccccgacaccaccccggcgaatccacttgtctctcagcatcaaggctcccctgtttagctaattactcagccagggatgtcccattccacccatgtggtcgtacttgtcttatgttcggatgaaattccaaggaaacggtccttaagtgcaaaagcgggaaaccgtacacccgatacgttccccggtccgcgattttggaaattcatttaggttcgcaagcaccgacccaggtgtcgggttttccaagtcttttgtaaaacccaagttttacccaagatgtttctcaaattttaagtttgaaggcgaccgtcgatactcgtgcagagtgcacgattaccgaggcgcaactaggtggttacaagggaacatggtataacaattacaatggaagggtcaaatgcaacaagttaggtaggtccgccaatctgccttgcagacgggacaagtagattaagtgcgatcctagcaatgcataatatttttcaagcaacataattaagttcaaatataggctcaagatgttcaaaggtggcttgccttgctcgatatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaaattttagaagttgaacggagtcaaacggacttacggttgggaagatattgaatttctaagattattggatttttggtctaaaggaaaaggatttatttaaatcctttttgaaaaagaaaagaaaagaaa

SEQ ID NO: 48539 - DNA, 1501 bp, Oryza sativa
cggcgatgagcgctcattcgcatgtgctaccactgtgcaagtgttgtttttgtattagttacatgaaagttatatatggattatattatagttgcatgcaagcttatgttataaggctgtattcggtgggaagggctagaaacccttcctacgggcacgttaaaccaagcagtagattaatgcgtgcttaattaagtattattttgtcggtgacatgggaccgggagtatcatgactagaggcttgggcagccgcgatcacccacgtggcctgaccccctcgggggggggggggtcgggcccgagggtgatgtggccacacctccctttgtctccccgaggggtcggactgctcccgtttcgaccccgagggccggggcgccccgaccccctgtgggtttgccgccacgtatatgggttaggtgagcacagcggggctcacctaaccgcatttattgcgggttggacgagcgcgtcacgccgcatgtaatgcagcgcagcgcgctcgcttatccggtccgtgaccgggcgcagcgtgtgaccggtcacagaccggtcagatcgcaggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagggagaaaaaaaaggagagaggggagctcgtagaaaggacgaggggaaaaatagtagggagagggtctctagagttcaaaggctcttgctcttcagctctttgtaactccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaa

SEQ ID NO: 48540 - DNA, 1501 bp, Oryza sativa
tccctcttttcttctccagtgtgtgaaatctttctcgtcggcgtcgacgtatccgtttccacgagcccaacgacgaatccactcctcttgccaacgacgacgagctgtagagcaggatgagctgccggtccaaacgacaagtagctccgcggccgccgccgtcgtggtcgccgccgccgccgccgtcgggatctgcgactgcctctaggtgcttcgatgctgcctcgtctgccttctttcaggccagtactgcaatggctcctcctctaggaggccaaccacgtactgtaccgtacactcaaacctgatggggattgtagtggctctgccttgcttgcttcctggatgttggagtagaacaataagctgatgatgctctcaactcctttgaccttgcatcctcagattggtaagaaaccaatttgcttgtgtgttgtttgtgcaacaaacaagcaaattcctttttgttgagactatttaaattgtagaattaataatggttatcacacataggagacaggggtgtctgtctcgctcaaaacatgatttttggctcctgatatttcagtggtatggatatacatccacctggtggtttcctaagcatgttacaaactggccaacagccattagtcccacctcatgttttgttcccagcaacatggccacctatgccacctatggcaccagcaactaattcaggcactacgcatgctagatcaaggtcaaaagccaaacctgtcatcaacttagatgatggtgacaatgttaggactgctaagcgtcttacatgggcatcagatgaggacttgcggttggtgagtaaaattttagacaacttgcagggatttgtaccatcattctaaaactttactaatacataatgctaaatgtaggtgagtgcatggctgtaccactctaatgatccgatcaatggaaatggcaagaagaatgagagctaccggggagatgtagttgaattatacaacaacactacacctattaacccggaaaagggaagtaaagcatctcaaagatcaatggcaaaggattaagagatgggtgggatttttctgcgcctcctggaagaaggctgcattagtttatactagtggatattcagatgatcagttgagagactttgctaatcagttttatgtgaatgactatcctaacgaaggtccattcacagttttgcactattggaaggttcttcatgatgaacccaagtggcatgctgttttggaggagcttgaaaagccacacaagcggagcttggatgatggaagtgacacactatcacaaaaagatatcggagaaaaggagcgtccaatggggaggaatgaagctaagaaacaacgcaatggcaaaggcaaaggtaaaggcaaggatgatgatgacagtttacatgaagatatgaagaagtacatggatgttcaagctgcagctagcaaacgacatgaagagtttttagggactcagcaccgtatttcagatgcaa

SEQ ID NO: 48541 - DNA, 448 bp, Oryza sativa
  unsure (1)..(448): unsure at all n locations
aacctctaaccatacccntntctctaccgcncccgtccgntnntnnntgnntnggtgtcttttcgccttggnttcccttacccaacccnncnnnnnnnnnnnnnnnccaccatgaccacctgaatggaacncncactacatattacaagncgntttgattattttttctaatcaaaattccttaaatccgacccaaaggataaaaattttttttcctattttcaacataaaaccagcatattatcaatatattcaagactagagttaatgaaactaatttagtattttttttatgttgctgaacttttcacaaattttatcaaacttgataaagtttgactgaaaaaaaaaataaaaccacttatacagtataaaattaagggagtaaaataatcgatggctagagggagtaaaataattgtatgctgactcttaccttctccctaga

SEQ ID NO: 48542 - DNA, 1501 bp, Oryza sativa
ttcttcctatccgatagaaatttttagatgaaatgatatccagatatccttggacgggcaataataatgtcttcatcgtcgcaactttcttggtgttgtcggtttggaggatacgttttttgagtgcgatgtaggccggcgatgattggtcttgaatagaggttggttcctaaatttgtgctatgctatctccttcctagcggtgtggtctttttccccctttctttcaggactatataggtcttgtttggatttagggactaaattttagtccttgtcacatcggatatttgaacactaattagaagtattaaacgtagactaatgacaaacccattccataaccctagactaattcgtgagacaaatctataattaatctatgattagcctatgtgatgattcagtaaatatgtgctaattatggattaattaggcttaaaaaaattgtcttgtttattagctctcatttatataattagttttgttattagtctatgtttaatacttttaattagtgtctaaacatataataatttataatttagtccttgaatctaaacacgacttataggtagtctaatattttttcatgctacgaagtaccttgatatggaactttgtacagtgcgttttattccaaagagaaagatgactataaagtagtaaaatcaaacatgtgcttgaaacttgctttttcacaagttcatccattatcccgaactagaatctgctcgagcgaaagcaatctatcctcctagagtcaaacatgtcataatccctgtcctcctcagttcgtatccaagaatgcgatgccaatctccaggacaaaggggaaggcgaggacggatgatcccgagatgccaccaccgttgtcgccgtgtttacgtatattattacttcgtcgggaaaaaaaaatagtaagaccccgacagaataattaactatctgtcacttttataagtggtgttaaattatttatcaccagaccatatgctatagatcctatatgtaatagacagcgagtgaaaaataattaattaccatcttttaaaagtgacgagaagtttaatgtcctagccccgacgcaacacaatcacataaaaaaaatttccagggggtctgggtgtaaaaagaaaaggtggaattatgtgggagacgcaggggcgtggatgcaaaaaggtgggtgcgtgtcctcgaatccagcgccgcgctcgcagcttcccttctccccgtcgcagcgggggtgatgactcagcacccccatccccacccccccaaatctcctctctctcctctcctctcctctcctcgcgtataaagccggcggccgcttctccgtcaagctccccccctccatgacgcctcgctcctccgccgccgcctccgcctccgcctccgccgccgccgcggcacagcgtcggaaaccctagcctgcgcgggggcggccggaggacagggaggttgtttgtttgtttgtgtgtatcatacggatacggcg

SEQ ID NO: 48543 - DNA, 297 bp, Oryza sativa
cctgtgttagcagtatagtggctcagttgtggcactagtcaacagcaaggggcaggaagaaggaaaaacaaaaaaaagacaaatgggcaagtggcctctttgcaaacatataagaaacaacagatactgagtttgaccatcttcgatcttatttaaaagtatctcaacaggatcagggtatcagaaataatagcttatgctacaagcctaagattcaagtgatcaattatatcaagatgtggggactgtagttggcacatatgttgcaaaacaggacaagaaaacaagatgggcagt

SEQ ID NO: 48544 - DNA, 819 bp, Oryza sativa
  unsure (1)..(819): unsure at all n locations
taataaaaggcagcccaataagacaccaangaaaaataaagaatgggccgaaggnaatataaagacgaggggtggcgccaacccaccccccaatagtaatataccaatatttggctatctctagagaaagagaccttccactaatatgggggggtttacaccctcccaggggtcagaaaataaaaaatttcggagaaaaaagatgggagcgaggtctctcnnatcttagggggccccccctctcactcccgcgggggnnnaaacccctaccnnnnnnnnnnngnngnnnnnnnnnnnnnngcctctcaanaaanaatatnnnagttaggagncagtcggtgcttagggcgtgaacncngagggnannctaataggatgggggagcagttgnagcacactatcttcgtggatgggtttcgctgttgctctagcgcagcacatatagagnaggctagaagaattgggnaaactgataaagaagnagnagnaggggtcctcacctccctctcttttagctagcgtgatggattgtaagggttagctgctaaggtctcggtaccgtccctcactttgaggtttgaggctgctgcaactggtcgttggataaattgccaccgcgaaaaaggttagagaagctaccgattctttgggtagattgcttttcagatagattgtggtatatcctactacttcagattgcttgccgacgacgccaaaacggcagcctttttagctgacctaatgttgcaaattttagttaagttttttcaaggtcttgctgctggctgcttctactgaacaattgttttttcattccta

SEQ ID NO: 48545 - DNA, 290 bp, Oryza sativa
ggagcatgaagcaatattagacccgactggacactactatatttcgtttcatatcataagttgtattagacttttctaatttaaacttcttcagctttgttcttgattatagaaaaaaaacaacaaatatttttcacataaaacaaaaacatgaaaatattcttttacgaggtcttttacagtgcttggaaggtacctgaggtacctccttaataaattgttatccaccgttaatcttcaaagggtaatttaggaacaaaattttttacactgcacaaatccattcacca

SEQ ID NO: 48546 - DNA, 231 bp, Oryza sativa
cgtatgaacttatgatgtttggatgctaattattagcagtcaagcatttttttagtaagagaagtagattgtatgctattgcctgtaaatataggaaattaaatctgatgcatataacctttttttatgggaatttgtgcatatgaccttactgagtagacataaaatatttaatgcaacaatcttaagcattcactgaacataatgctattgtaattttcttcctccagg

SEQ ID NO: 48547 - DNA, 1501 bp, Oryza sativa
ggtggcgagctgatagctccactgagcgcgccggagaagaactctctcgtctcgtcccgaccgccggccgccctgctcaccgaccggtcgtcacgcaacgcagcagccaccggcggcgaatccgtttccgggcttctttggtttagtgccctactaaagtattaaagtattggtagtgcgaaaacttaggtatgttttggcactatcaatattttggtagggtagcattttagatgaatggatttgtattgataccaattggagaccaaattttatattatagttaagaaagttctagaattatgccggcagacagcgacggcgaaagcgatccggagaaaccgctggcaaaagatactgttatcactgtaaccgtcaacgacgatgacgacgcattccccctcctccctcccggctcctgctgcccgcaggctcgcctcgcgacctcagagcaagtttaatagctaactactgtctctaaatcatctataacaaatcaaatagtccacttataaaataggtaactataaaaatatactacaccattaatacccggtctcacttgtcatacacacataacgttttggagtccgtgttgcagctgactataaatttgtagcccgctttcttctctcttcttttagaaaatgaaaatgggttatatctccggcttctctcataagacacacaatcataaatttaatagtaataaaaatgtaagataaaagtaaatcaagatgagaaataaggaggtgggataattctctcccttaatttttttcttgatatgtggttatagctgacttatagtgctattgtactgctctcgcgccgccgcttctgctccatccttccagcgaaatcccatgcgaaaaccgaagacggcaaagcgtctagctagcttgtcgcggggcagcaggtgggggaggggaagtaggagagcgtgtgaaaccaagcaccgcacgggcaggagcgcgacgacgcttgatagccaggtagctcgtgaaccaagcccaagtagggatggcaatgggtcaggtcgggtacgggtagagcaaaaccatgcccgatccaatgcctaacattgcccacccgaaccctacccactagagttagcgggcaaaattccgtgcttgtacccatgcccgacgggtacccaatagatctcgcatgaataataacttgaaagatatgtaatttaacaaagagaaataaaatcaataatttaccaaattatcggttattgacaataatttgaattacatcacaacttagtatcagttagcatcacaaatgaaccaaaagaaatggtataagaattaagaaatgagtcaaaattagctaatacatatgtatcgggtcgggcatgtgttacctacgggtaaaaaatgaaacccgccagttgcccatgacgtcttcgggtctcgggcggacgtgcccatgggtaaaaagtcacacccacgtccatgtccatcgggtcgggtatccacagatacccgaa

SEQ ID NO: 48548 - DNA, 1501 bp, Oryza sativa
acctgctcctaaaagtagttaattactgctaattacatggattagttgggtaaaagcggggttagcggggggcggaatataaaaatgccgcctgcctcggagcccctccaccggctttgaccagtgccgcgccctctcctctctgtcgcctcgccaccaccatagctaatcctcctcctccgtttattttacttttctcccctcttcgcctctcctcgctgctgttatatccgctttcctctcctcctcctcctatcccccctctcctcctgctcctcggcctcctcccctagatgccagccgcggcctgaccctcaccgctggggagcccccctcccattcttcgcttcccccgcggttgcgctcccggagcggcgttccagcggccacaggtgcggtctctttgcttcccctctgctgctgttgttgtgtgcggtttgcttggttataggtggattttttggggttatttcatgggtggttactgatgtttttttttccgttgctgcctggatctttctcatttggattatcatctgctgctttcccaaagcgcgctgctgtttttttttgtttttttaaatatttttgtttgtgtttgcgctcttgcatttataaattttcgccgaatggcaggctaggactttggatataaggtcgggggtttgaaaaccctcgaatttcataatttcccccaccaccgtttcagaagttcgtttggattctgtgaatgctcacaatgctgtatattagtaagaggtgagataatgccgtgaaggttttgggaattctgctttcacggccatggaagctgcaaccgcgggttcatttatgatcgcggagcggtgaaaatttccagtaaatgttttgggggtggtgcagtgcttggttgttggggtcaatgacttagctgcaatagattgcttatttaagttggacttttgacccggaattgttaatttggtttggtttggtgagaattcgactactagattccgtctctggatatggaagtagttgcagacgcgcgcaatttctgtgaagttgcattggaaaccaaactaaatggagtggtgtgtttgaacgtccattgttgcgtctgcggaccaatgcatcacaccacctggctcctataagccttcgtctcagcttgtctcttgatagatcagtgaactgattgtgggaatgaggcagttttagtagtttagctgtctcttcttctccagtaatggtttggaagttcagaatacattgagaggtgttgtacttaaggagagatatcatagttatttttttttttttttttttttttgctgatgcaaggttcgacgccttttgcaccttctgttgtactgcatttagctttagcagatgcaatacatgacaactttttattgttgccgacgactaactgctatattgtgatggggcagctacttttgtgctatgtgctaactcaggatcctatttgaaattctgtagcagctttccctcattgtac

SEQ ID NO: 48549 - DNA, 1501 bp, Oryza sativa
catcattttgtactcagttcacatctgcaatctgctttttttgtgtatgagtttatagtactgaaatttctttcggcgactggaataggacaatgatcttcagacaagggtagtactactctgaagcattgatgacagctccaggtatcgttatgtttcttgaatcgtcagaagaattggtgcaccggacacggtttacttcagtttcttggtcgtcagtcctcgccatggtgcccggtggcggtgggtaagctgctctctttgaccggatcgcgagctaatcagctaactgtaactatctgaatctgatgttaccgtgagcgcgcggtggcctaatccaatgtaccggcagtgaatcatatgactcgattattcaaccgaaatctcgcacagtttgttttgtccttggacactgtcactttttccctctctttttgctcgccatggctgtaaaggtatctatctgggcatgccaaggtccccgtccttagattgccatgattggatcggatggatccagcctaacctgatcggatattatcgatcaggaagatcagatcaggtaatacggatgattaagattttctaacttctctatgataaagttacaaatgttaagttagagaatttgcttccgatcatgaagaaagctacagaaactaaacactggtcacaagcaactatgcgacgcggattgtcacgttgcgtcgttgatcgatcaaaaattaaaatttcggtcgtcacggcaatttaacatgtctgctgttgactcacaaatcacacggctagttacatggcgtcaggtagtggaggtagtagtcaggtagtcgagaagctgcatcctcggcggcggcgccggcgggcacggcgcggccggctcctcgccccggcggcgccctccgccccacgcgccgccgatgccgagccagcagagcagccgcttcaacgcctccagcagccaggacctccgcgccggcgcacgtcccgctcccggtttctcctcctccttggcacgtcggacggcagcgccccgcggggctttctgcttgtcctgcggcgcgacgacggcgagacggacgggctcggctcggagtagctccggcgcaggacggcccggtcgagctgggcctcgatggccagccgctcgtactcgtcgagcagcgtgctggggcggaacgcgccgccgccgccaccgttcaggtcgaggctgaggctgagccgccccagcctggtggcgccggcgtcttcttcctcgactatctccatggcaatgccgccgccgtctagctgtcgcgccggctccattgacattgatcagtagtgttaggcagtggtgctataacgccattgttgccgttcgaaaagttgcgagttgtgggagtttgacgtggatagtgaggcaagcatcgccgcgtcgacgagctttatgagtttcgtttattgcactcaaaacattgttcaggtctggacctgtctcttttgttgaactttcatagtatat

SEQ ID NO: 48550 - DNA, 1501 bp, Oryza sativa
tagggctcttccgacgacgagaggcgaacgcgaaggtggcgacgggtagaggagacaccggggagccttttaaaggggctcggaggcggcggcaaaggcccacggctgtggcaacggcaaaggaaagctcaggcttggagagaggaaagccgatccgattcgaactcgaatcaaactcattccaaaccgatttagccgaagtttccaaaggagaaaaggtagaggagatcccgaggatcatttcccctcttttgattcggccggagaaggaaaggagcggccggattggaaagcggcggcggcggcgacgaaactagggtttcggccggaggaggacgacgatcccgacaggtgggacccacctgtcagcgaccgaacgcgcgcgcgcgcggctgcggactgggccggctgggccgaggagagagagaaaggttttgggccgactttcggcccaaagccaaaagaagactttttaaaacctttttcaatttaaattatttcttaaatgcaattccatttattaaaaatactttcttagctcaaataaatcccagaaaaatctaggaattatagaattaagcaaagtatttaatgaaattttatctggccccattttatattggaatttattaattaaacttagatcttctcttcaagacttttaaaataaattctagaaattccaattaaacaacaatttatatattttgaattttcagggtgtgacaactactctgtctctcaacaagtggtactagtgagctctctgagcggcgatggcggggtcgagcggcggtggctggcggcggagcacagccggccaggcggagaggcggccggcgcgccgacgctcggatccggcctccgcgtcgtgagcggtggcggcgggcggggtggtcgagcagtggcggcggccggcggggcagcccgggcggtgaggcagatcccgcggcgacttcgccggcggcacgaggggccacgacgccgggcggagaggcagggggcggtcgagcggcgggacggagaggcagccttccaccacggcgtggcacccggcggagaggcggccgggcggatctcggcgccgacgagcggacgacttggagcggcgccggcgtcgggcggcggcggctctctctctcctgtgatttttattcccaacacgctctctctctctcctctcctctcctctgcatttgacaggcttttcagccaagaacgggtgaccaactttggtcactcggtcctcgcttggctacacacatagatgacatggcactgaaaatggcattgcttcctttgaggctgaacgccacctaggagcattgtaaatgccctaacgttacatcaacaagctcctccgtgcaggcagcttcctcgcatgagctactcaacctccactccaccattggaatacgaggaaccccaggtaagaaaaaggcactaggcgccatattgtgtgcgcatgacagaaataacatcaccaccaccatatcataat

SEQ ID NO: 48551 - DNA, 1501 bp, Oryza sativa
tggcataatagggtttcatttgcaaaagcagcatttagcaaacatttgagaatttagtaaaacagttaagtattaaacaatattaatccaacgctatacaacataccctgttgtataggcccaaccattctgaacaaccaccccggctgcacagttctatctccaaaccaggaatataccattccaaaccaggagctaatcacattattaccagttatagcatcatttattatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacagtatccctcatacaacataatccactgcagcacaccttcctggatcataatcacccccttataaacaaggcatggactccccagcgacccccgtgggcttatctccgccacttctcagtctggtgccccgcaatgaactatgctatacaaaagataaagccgttgcccatgctggcttgtggttggcacgattaatgtttcacaaccgaaactcgtgaaccggtccttaattgtcatgagcacgaccatcaaaatcatgtgctcataacccaccattatcaggttttagttggcacattaattaattaactaatcacgattgaccatcgtgaactatcaataagccatcatgaaataatagtgagtcattagttatcccataagtgtgctaatgtttctaagcagggctaagcaattatttctaatatctagttgaaccaatataaataaagctcaactagtcaaattataataacccaaggtatcaaggaataaggtaaacaagaacaaaagggctataacaaacaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaaacaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttgaagattaaatcggattaaaacacttaaatcggtttaaattgaattatgacgcaataatgaattatttttgaaaaggaaaaggaggattattgcgtcagcgggctagggtttcggtggaccgggtgcacgggcgacggttcacgcgaacggacggccgagatcaacccatccaaatcggacggccaagatcgatcggtccacgaccggctcacagcgaacggccccga

SEQ ID NO: 48552 - DNA, 1501 bp, Oryza sativa
agtttcggttgtgaaacattaatcgtgccaaccacaagccagcatgggcaacggctttatcttttgtatagcatagttcattgcggggcaccagactgagaagtggcggagataagcccacgggggtcgctggggagtccatgccttgtttataagggggtgattatgatccaggaaggtgtgctgcagtggattatgttgtatgagggatactgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccataataaatgatgctataactggtaataatgtgattagctcctggtttggaatggtatattcctggtttggagatagaactgtgcagccggggtggttgttcagaatggttgggcctatacaacagggtatgttgtatagcgttggattaatattgtttaatacttaactgttttactaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatcttattttccgctgcttagatttttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttacccatagaagccttctaaaaatattggaaaagtagaactgttctcctccctttctcttttaattaaaccaaactaatggcacatgcacttcataaatctcttttaatggttctcattcaaaatttattccagtgttattagtactgtacatctattactgtactaatggcttatttatcagcaaaagttttacaatgttgttttatttaatcttgttgcaataaaataaatttagcatgacgattttataacttgattttatttcttttggaacctgttattcaaaagtacaaaacttgtgaccttgttttcaactatttcaactcatcttgcaagcttggtttactttatttacttactttttatcttgattttctaactttattcaaattaatccaaaaacttgtgctgttaattggatagatgtcttaactccctcctttcacttgtctttaga

SEQ ID NO: 48553 - DNA, 218 bp, Oryza sativa
gtggcgcggtggctgccccctaccaagctagagggaggaggccaccctcgcttggggtcgagctgccccgaccccctccacatatcagcccacgtgtacagggttaggtgggcgcgcctaatgcccacctaactgcatttaaagcagtctatgcaaccgcgccaggccgcatttaatgcggcgtgctgcgcatctgaccggttgaatgaccgatggga

SEQ ID NO: 48554 - DNA, 339 bp, Oryza sativa
  unsure (1)..(339): unsure at all n locations
tggtccnnnntttagttcacatcttcaaatcattattttgtaacaaacaacataagaaatgccgaaaattattctcaattgacctaaaaaaatatctactagaactgctagcacacgtttgacaaacctcaatcagaagaaagaagacaacannnnnnnnnnnnnnnnnnnnnnnnnnnncnnncgnnnnnnnntnnnnttttttttttttttttttttntttttttntttttttttttttttttttttgtttttttttttttttttttttttttnttntttnntttttttttttttttttttttttttttttttnttttttttttttttnntgttnnt

SEQ ID NO: 48555 - DNA, 1501 bp, Oryza sativa
tttcaaattcaaatgctgcgtttgttcattcgtgaggtccatgctccacctgtttgtaatcttgtttaggaataagttgtcgtcccttaacttggtttgattgacatttctaatttcaaatatcagaaatcttcaactctaaactatacaaaatcgtacaattagagtcccatggtagtatagaccccatttcctcctatttttgtttacgtggcagatatctgagcccacatgtcaacatgctgagtcacccatgccgtttcaacgtgctctcgttggctgtttggcaggatgtcctcctacgcctgcagcgcgtccactgacatcgattgatagagacaccgacgctgtgatgatggtgtgcatgaactgcatctccctcagctcatcaaggtcaaatcaaatcattcacgtcgtaacgagcgggctagagccggattgcaccattcacgctgtaacgagagggctagtgctgggccgtcactctacctctagggccatcaccactacgctcaaggccatgccgccacatgcatccaagccgcctaagccggcgtgccattgttgcgccttgagggcaggccactgctacgcgttgggcccgcccagacgcgactgtgcctcaatgctatccgattctacgtgtcggggccaaccaaccgatgcgctgttgctccatctaaaggctgcaccgtggctcgaccatgaggctggggctgcccagccaccactccggcttgagatggcgaacttggcgctagcggtggagtcatcatcaacctctatgcaaacgctgctgccgtcaggagctagcaaacaggcaacgagagagctcactccgttgacacggcattggtgataacatgctgataagtgggcccaaatatctaccacgtaagtgaaaacaaggaaaaatatgatctatactgctatggacctaaggtgcatggttttatacagtttagggtatagacttctggtatttgggagtatggatgtcgatcaaactcgacataaagttgagagttggccggtggacttatccctcctgtttataccaccgtgttgttgtgacccatggtcagcccggcccaataaacacacgaaggcccaatagcccaaacaatctaaaaccctagaaatccaatatacaaaggtagtgtgctcctgcctccgcgtggtttccatccccgcgcgcgccgcccctctccgctgccggcctccgctcctcctccggcgccgtcgccgtcccatcggcctccgcttgccgcccgctccgcgctattcaccccggccggcaggtgagcatcggtttccctctccccgttttccccccatggtttgggtttctccgaggcaaggggaaccgcgtgcgtgtttgttcttgccgttcggagtcgccgttgatgccgccgcgagtatatagacataatcactgagatgcatgtaatgaagtatctggagcgagcgaatggataaaccctaatctctcccggctcct

SEQ ID NO: 48556 - DNA, 1501 bp, Oryza sativa
acgtagtacgatttatttggtacgagaaacagagtgagttcttctatattgccatttcattgatcaatgatacatacttgtaaaaagagagagaggtaaaggtatcgggaggtaccacacactttatagtgtaaaatttggtaagtgtgaaatttggtatctccagatacttaaaaaaaaatacgtaccttgagatcttttttaagggactataaaatttctctttaaaaaaagaagagggtcatccatcccaaaccccaaatttgagggataatttgtgatatggatgaactcatttaaataatataaatggtctaatccctaaagggaatcaacaagggtagctgtatttatccatcaaaaatgatgatgggatttgagaatcagagtagtcgaataaagccggtttgctaggcttttccagatggaccacgcgtacggttcgctttcttctacgccccctagcgttggcctaaccaaatcatgagtccattttcttcttctcgatcttcaagatccaggcaaagctgtcattgcaccttgctaattcgtacgttgaacatgtccttgcatgcacgtactctatctgatcgtaatattatgcatatacaaggtgactttgcagtggtgtttttgtgcgcgtgcacgtcctctatataattgatatttttaaatgtttataacaagatgtttgttcaattttttttaaaaaatatactataccattaataactgctcaaatatttagttaaaaacatatgtgagacttatgagattttaatttataaacttttataatacaaagttagtgatcaaatttcaaaagtctaattgaatctaaccctaaacataaaaagatgaccagaaggagaaaataatcatatatagtattttaggtccgaaaatttggttttccggaagtatctttaatcgggaacacatacctgtcttctttatgaaaagaactagcatattacccttgtgttgcaatgaatctattaccgcattattaccataattttgtacatatattacatcttaatttttacatatatttgttactaatatagactctttgcccatattatccttttcccttacaaaaaaaaagggagttgatgaagggggttgacatgcatgtgagccctgtagccccatagtacttttccttttcaacaaaagtaagaagttgatgggatggatggtggcatattcactactcgctactaccacactttttaagggaaaatttgaaccatgccacacaaattttgcaaaatttgtgatatgccaccctgacccatatgtcattgactcatgtgggtcctacatgtcattgagatacggaaatagatataaatgttttagaaaagcgtggagttaaaattctaatatgttactacaaacaataaacatacaacttaagggcccctttgaatcgcagggtagaaaaaacggaggaataggaaaacacaggattctgacaggaattgaagtgtaa

SEQ ID NO: 48557 - DNA, 602 bp, Oryza sativa
  unsure (1)..(602): unsure at all n locations
ggaggaagagggggggatatgaaatatggattagggggggggagatgagaaagatggtggagnaaatggtattaagggaggagaaagttttatggggtgggagtagagnaggatgatttaatagtggaaggtgtgttagattaggaagaggtatgtatgggggggtaaaaaaggggataatgatgggtnagaaaaatatttgttattaaaatgttttttaaataaagttttattantatattgttannanaaaaaaantgnttanannttnnnnnnnnnnnnnnacaacgggctctaaagagagggtagcggcagtcccattagttctttttttttcattgttttttagcaagagtttaatccttaattttctcccaaatcaagtgggatacatatcccaattcaaacctcaaatcaaagtaacatcccaaaacattcacattacaaatcttaagttgcttatacacacaaatcaatagcatcccaaatcttaaaaaaattacacacaaaccaaatacatcacagattatacatctcaggtcatgcaccaaatcataaaattaaacatcttagtgaatcacaaattgtaaaaaaaaaaaaaa

SEQ ID NO: 48558 - DNA, 1501 bp, Oryza sativa
gaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcatttatcgtcaaaatctgatcttttaaaatgttgcttttcttttgtttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcctgagtggacttcgctggcagtcactgcgggtggagattccttccccgccgcttgccagaacgccgctctcctcgccatcggcactcttcaccagcgctacccggacgagttgcagcactcgccctaccgctaccacccccgtcgcggaggagccagcgaccacgccaccttccgagacgccagctcggaggatgacgctaccgtcgtgcatctggcacgcatggtggaggcgtacgacgcggctcgtatcgacttccatcagatggtgcgtcgtggcatggtggagaacaacctgaagatcctggagctgcgccaagagaatctgcagctcaagaaggacctcgacgcgttggaggcgcagctgcatcagctcaaggtcgcccagggagagatctgccgccccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcctgcgcgtgtgtttttcttcgttttttttcttgagttgtgtggggcatggttacaccggtgtgtggtgtaactatgtcggagcctgtcttattttgtttgcctaagcaacttgaaccttaatgaaccaatttaatagcagtgataaatttaagaataatggtagtcgtgggtggttagttttaatcgtcagctctccttctctgtttgctggttctgtgtggggttttcaga

SEQ ID NO: 48559 - DNA, 1501 bp, Oryza sativa; identical to SEQ ID NO: 48538

SEQ ID NO: 48560 - DNA, 1501 bp, Oryza sativa
aaaattatggctatgaatctggacaagagaagatgcatgcgtatctaaattcgtaaccataatctcgttacatttaaaaacaaaacgagtagtcgcgatggttaattatctgagcattttgacatgagcagggttgtcgattaattaatccatgggttaaggtatatgatatatctagcctgcaggcacggggttgagaaattaatttaaaccttgggaagttggtgttgttgatcttcttttgaccgtacttcctccactggtacccatcgtcgtaaggagaggctgtcaataatctcctgtggatcaatgcacgggatgaatcagataaactcgtactcaattcctatagcatatttaacccagctgatcttgtactaattgattagctagctactagttctgcggctggaagctagctagctaggcatttatttatgcttccagtataactgtatagcacgtgcagaataactcactttcgcgggacgttgtcctctctcgccgcgcgcggtggtggtggcgagacggctgagtcggccggcggcgtctcgtccggttgtggcggcgaggcggacggggaggcgctggccatgatggagaggcagacggtgaaggcgcgggagacctccccgaggatgaatgtagcggtggcctcggcctgcccctgcccgcgcagcgcccgcagcgcctccgcccgcagccgcgccgtcagctcgtgcccgcgcgtcagctccctcaccaccgcctcgtgctcctcccccgctccaccacccaacctgctaatgccaccgctcccgctaattccactgccgctgccgccgctcgcggcagcagcgaggcgggattgcgcctgcatggttcgtgttgttcgcttcgtttgaattcagttgggttggaagcgtcagcgatggatggttggtggcgcggcagaagtagaggagggcgagcgggtgttgggcgggctcgctgttatataggtggggagagcagctagctagcgaagcgaggtggatgggccggaggggatgagaaggctcgtgggaggtgcaccagctcagcccgtgcgggaaaacgctttaacgcggaatggtggacttatctacgaccgtacagcgagtcctttcttaatgctagcaagcgctacgtgagcgagtagagacaaagggaattttgcatccaagcactttggactccaacataatcgcaagtatgtgccttcagcttgagtttccagagaatgtttgtttttcaggggcaattgcattatttcatgtctgctgcaataattactgggcttagaaaataaggactagatatacaacttccatagaaaactcatccaaaaatttacaaatgtaacttaggatttgttctcttccaaacttctattttctgattttccacgcgcacgctttttaaactgctgaatggtaatttttgtaaaagtattctaaacgaagttactttaaaagattatattaatagaatttaaaagttt

SEQ ID NO: 48561 - DNA, 750 bp, Oryza sativa
cagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagggagaaaaaaaaggagagaggggagctcgtagaaaggacgaggggaaaaatagtagggagagggtctctagagttcaaaggctcttgctcttcagctctttgtaactccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaa

SEQ ID NO: 48562 - DNA, 518 bp, Oryza sativa
ccttaccatgaacttggtgtctccttaagggcaagttttatggtagaggtgactaccatatccaatttcatacatgacatacataattaaattaagaggtgatatgtataataggctatctctatcacataattcccaatatctctaacactctcacatgtttattgaagtttgtgtaggggctgccccttgcatgagaggtgactatttctctctcatccttcttctctcctccacctcactatttagtcttttgtgtcatcttgggatttatgtttgaatgtccatagtacttgccctaagttatctacagatactccgatacttcgatcagtttgatgagtaaaattttagcacgacacttcgaaaagttcatcaccgagaagttggctactctaaaaaaaagttagcatctggtacagtgagctcgaatctgaatcattttggagcgaccttgaccggagcgaatctgtgtggtacacttgcggttgtttttcggtcaatcccaatcccctgca

SEQ ID NO: 48563 - DNA, 1501 bp, Oryza sativa
tgtcattgctgcaaacagtctacccagtgtgactgtgtgagcgatacatcatacaccccatcacttttagcaagactgaggtccgaggaactaatttggttaaacaatagcagaattgcagaaaccaacaccccaacattttgatgaaagacagaaagacacgggcaaatgatcagacatagcaactactacttttcttagttgcttgaatggtgctccacttgcattgacccgatttccggcgacgcgttgcattgcagtccagatgccggttcttccagagccttctgctcgtcctcgccaacccagccgctgtggccttcaccgaagacgcccggtgcccgtggccaggagggaggcagagggcacacgcctcgtgctcaccttacctgacccagccgccaccgccgtcaccaacagtgcccgtagtcaggagggaggcgtgcggaggggaacacaggggaggcggcgacgacggtagcaggcgagagagtgtcaggtgtccacctgttccacctgacgatgatgtcgctgaagaagaagaagagaagctggctgaagaagaggaggaaaagcttactgaagatgatggagaagaagagcagataactgaagagggcgagctggtggcacgcgaggaggatactcagactaaggaagatgacacacagaagacacgtccagcaaggcccaagaagcccaacccaaagtaccatggcgcaaagtgggtggcgtgacaactggcgtgcgtgagttgtacccgtgagagagagttgcgtgtgggagttggcttgtatcgttaaatactgaaacgaacatgaagaacaacggctttggcaatttggaggcgaaggcggcggaggctcaattctgttgaattggagcaatacaaccaatataattgccataatcctgtgctatttgagtgaattcgagagaacctaacaatctggtatcagagcctcatccccgttgtgctagttctaccgaattctgctgcaaaatcctgagggaggattgggatttttcttcggattaatcccgcgaaaaggcaacttgcctcccctaggttagcggaatttggtctagccctaacaccgagactcggagatggcgcaggatagcagcaagctggatctgctgctgaaaatggtggaggagaacgagaagaagcgcgtggtggcggatgagcgcactagggcggagtatctggagctcaagaagatggtggaatctagaattccagccgtggagaggaaggtcgaggatatcggagaagctttccaggcgatgaataccaaagtggatctgatcgagagcactcttcagcggcaaatcaagactgagaagacatcgggtggcaatgggaagattgggaccgcttcggggccatcatctccaaagttctccggtacgcccgattccaatctctttccccatgcccactattcccttgatcttggccataagcaattggatgttgatcttggagctgtggggt

SEQ ID NO: 48564 - DNA, 1501 bp, Oryza sativa
gcacgagagaaaggaaagcacgggaggggaaaaggtgcgtggacgcctacgcaaagccacgagtggcgaggctccgacctccacaacgtggagctgtgcccctttcccctcggtcaggccgaagaatgggtgatcagttttggctccgtgttctttacggggcaacgctgacagaggacgtgacgtcggatattccgttcctagcgctcaacgacacgtccgcgcattatgaatgatctaataacatttggtgatcttgagaaacgacgtgaactgtgacggcgttaggtgagtgagccatggtggtggtgctgcagcgtgcaagcgcgcggcagtacacgcacggtggacggtgtgcgagtgcgtggaaatcctgtggcctgcaaggcttcattgtccagtcctcttcatatttctggctagagttgttggtcctctagagcactcgcaatggtaaaggaatgtgctttttataaaacatgtacatctcagcaatagattagattaatagtaaaccacctcaatagtatgtctatatgggtatctatagctctctaatgcattgcctcgtttttctctatagactatctctaagttagtagatagctttgctctctttcttcatttaatctctttcaagtaggaaaatatgctgatatagatatcttgtagagagcctatagataaccatcgtgggtgctcttagggtgtgtttgaggagaaagggattggggagattgggaagatacgcgaaacgaggtgagccattagcatatgattaattgagtattaactattttaaacttcaaaaatggattaatatgattttttaaagcaattttcctatataattttttttaaaaaaaaacacactgtttagtagtttgggaagcgtgcgcgcggaaaacgagatgcttttctctctcaatcccccagatcgcccaagaacgaacgaagccttagagctcatagtgagctcgtatagctcactatgagctccaaaatatctatagtcaatgtaatagctaatttatacaataattgcttactatactattagtacctggtcccatctgtcatacacacattatgtcttggagtccgtactgcagccagctgcagatctgtagcccgctgcttttctctctctttttttatctttttaaaatatgtttatagctggcttatagcctactattgtacctgctcttaggtgatactaccatggtaaaaaagcaaaaaaagggtttgttggtggctgggtaggtgggatgggagttggattttgacttgtgtcagtattttcttcgtcctaaaatattactcactgtccgaatttgttatgctaaaaaatattctatcgatcagtaccattttatgaccaagatagtaatttttccgttttatattataaattgtttaacattttagttaagctttttagagtttaacaaagtttatagaaaaatatagtaatattttcaacaaaacaaatatatta

SEQ ID NO: 48565 - DNA, 1501 bp, Oryza sativa
catactattgaggtggtttactattaatctaatctattgctgagatgtacatgttttataaaaagcacattcctttaccattgcgagtgctctagaggaccaacaactctagccagaaatatgaagaggactggacaatgaagccttgcaggccacaggatttccacgcactcgcacaccgtccaccgtgcgtgtactgccgcgcgcttgcacgctgcagcaccaccaccatggctcactcacctaacgccgtcacagttcacgtcgtttctcaagatcaccaaatgttattagatcattcataatgcgcggacgtgtcgttgagcgctaggaacggaatatccgacgtcacgtcctctgtcagcgttgccccgtaaagaacacggagccaaaactgatcacccattcttcggcctgaccgaggggaaaggggcacagctccacgttgtggaggtcggagcctcgccactcgtggctttgcgtaggcgtccacgcaccttttcccctcccgtgctttcctttctctcgtgcaagagcggtggaaaggagaacgagaacggcaggctggcaacacaagatggcagtggaagcgagaacaagcatcgggagagaagaggagcctactagggtctgtctgccgtcgcccacccgcccgccgccgaggccactcaaccacgttgccggcaagccgccaaaccggtgtcgatttctccgccaaatccgccgccaaggccactcaaccacgaaagttggccaggagaggagggccgccggttggggagatgatgaggagcgctggccgtgggaggagacggggttgccgggtgcaccgccccttcgatccgtgtcggtcaagctcgccgaccacgccacccggagctcgctagccgcctgcctctcgccgaccacgcttggactggtgtcgacattggtggagagaggaggggagggggagaggggcgccgccggcgagatagccgaagccggactgccggtgtagggagaggaaaagggagagaggggggaggtgaggggggattttatatatttgtttttttagatttttggggtgttcagtgtgaattttggacctctacacaaattacgaaaaatattagaactaaaacaaaaaatttagggactgaagtataaaaattaaagtcacttctaaagccacttacactgtgacactgtgaaggattaagattttagaccagtgatcttaatttatgtggcactctgagctcctcaaatgagagggacgcatgaatggccttagcaaccaaccaatcctccgccaccaaactcccctacctacccacagccgtcaactcttcaacggcgactcccctatataacacgcacagtcgcgtcgcgtcgcgtcgctcctccagcaacaacgaaccaacggctgagagtagagtacgtgaagttaagtgaagtgaagagacgctttgcattgcagttgccaccgcttcccacgcggccgtcgtcgtcgcca

SEQ ID NO: 48566 - DNA, 1501 bp, Oryza sativa
aatatgtaaatacctgtgcacttctgatgtatttttaaaccacttattctaagttattttcagtttatttttcaaaatatttaattatcactgtaatgaacgcagttaatccgatcataaatcaatctctagcatggtccgatcaaaagtttagaccttactaaatttttagataacaaaccaaacataatctaaacattataaccataccacaatatgataactctcgggaaaaaatatttattaaaaagtttaccaaaatgtagtaaggtctcaataaaaatgtatatcaaccttccctagtcctttagtattatcaaattttagcaagttttatttgccataaactaaacatgcccaataatttatcaagacaaattgagttttctagtaaaattgtacttttaccaagctcaagagggggagaaggttacattgcaaattgcagtacacacaaacacatacttgaatgtttgacgtttaggataagattcaatcaaaattttaaattttgataatttcttgaatgttcaaatgttcaggaaaaaaagaaataatatatgtggatttgcttcaaactgtaccatatcataatatcataaatctgtatgttagaaatttaaaggtttaatcacatgttttttttctagacattaaatatttctgacaaaaaatactccacgataagtaatcgagagtggcagggacctaagagcaaaggaaatagtggactaaaagtcaattataaaattattatatgaaggagagagataaaggaaaatattgagtgtgggctctcaatgcaagatatgctgtaaaataaaatgcattaaattcatggtgagagaaaagaaaaaggagaaaaatgaaactaaccttataaataacttattatacatgttagctctaatgtgaagttatagttagtgttagctctagtattaaacttgctctaaacaaggttttccctaactcttgcactacctttggtatgcagtagcactgggatagaaaagtttccaatttaataagggcctcagactcagagaccttcatatgcaccctgcacagcaagtttctttgatcaattttttacatcagggtgcctctatatgtgatacacacgtgcatggtaaagtgcaaactttgcaatttgacatgtcaaaacacccacacataatcacttctttgcatgcatgagctgccagcctgtccgtccaataatcatcagaggtaaaataaaatcatcagccaacaaagggcaaaaacgcaaattatttttctccccccgtcttcctcgcctttcctgcaggtaggcccccgccaccgagccctctgttacctccccccttctcctccgcttcacccgacgcctcctcctgcccgcccggatctacctcggcgccgcgtcggcgggcggaacccaccggcggccgcgcggggaggaggcgatcgaaaaaacccgaggggggaatcgcgccgggataatcctagggcagaa

SEQ ID NO: 48567 - DNA, 1501 bp, Oryza sativa
aacgcgtcgcccatgatcccggcgtacgacggcgggccgctgtcccagcccgtgtaccgcagcatgaattccacggaggcgtcggacagcgcggcgacggtggcgatgaggaggagcgcggggagcacaccgagcacccgcattgccgccgggattgacatgattccggcgccgatgatgctcgtcgacacgttgaacaccgcgccggagaccgacgccccatgcccgccgccagagaactccggcagcagcggctcctccacctcgccggcggcggcgccggtgcacttgcccgtgctcgccggcggcgtcattttcggtggggatttcaggcgtgtggatggcgctcgttggcaccacctaaattagtaccacttgaacctatgcttccttaatccggtgaaaattacgcccatatccttacgcgctaatgatgatcgctgtagaagcagcagctggtaacggggcctaatatggtaattccgcgtgggaggcgtactacgcgacagaaaggactgatgtgattacagagcggagagaggaagctagtgtttcaggtgctgtacttggacgggaacacggccccgattcctgattttgcgatgatacaatgaagcgggaccctttttagcagcggcgtgctgatttgctatgcccaacgattggccagtcggccagcctaacggatccataccactggcttgcttgctggaatctagcaacatgacaggcgccggacacaatatccgccgttgaatccatggatccatggggtcgacgtagatgtttgcttttcctttctaaactctccaaagtgagaagacaaacttattttttttacaccgagatgacaaacctggtaaatctaccgcatccctttctccacaaactacgcaccccctttctccacaaactacagcatggacgaacaatttgcctactgagggcccctttgatttggaaaaaaaaatatagcaattttagaggattttaatcctatagaaaaattttctatgaagtcctttgaaacaaatgattgaattctatccaatcctttgaaattcctatggaatggataatcctatagagattttagaggaaatttagcaagagttttaacctcttgctaactttcctttgagtctatctctctcatccaattcctgtgtttttcctgtggttcaatcaaacggtaattcctgtgtttgcaatcctctgttttatacttacattcctatcaaaatcatacgtttttcttattcctacgttttctcaatcctatgattaaaggggccctaagtgggtcaattaagaccaattgggctttacaattcggcaagagaacaagcctgagagttcgcctgcttgggcctttatttaggctgagtggtttacatggagttgggcctacttctagacccatggtaaactaatctacccctggaaagtagtactactactagtgaaaacctttccgtcttcctcccgttcgcctctcctt

SEQ ID NO: 48568 - DNA, 1501 bp, Oryza sativa
atatataaatataaatagaagttaagagttgtatatgaaatataagtctatatgaataaagtctaagagttatatatgaaatttatgttatagaaatagaacctaagaattgtatataaaattcaaatatacttctacatataataatacttatgtataaataaaatgtaagagttgtctatgaaatttagaccttataaaaacaaaagttaagagtcgtatataaaatccaaatatacttctacatttctatggtacctatagaaataaaatatcagcattgtatattaaatctaactccacgttaattacctagtgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccctttaggaagtctgcgccacgtatatgggataagtgagcacagctgtgctcacctaacagcatttattgcagtctggtcaagcgtgtcgcgctgcatgcagtgcagcacggcgcgtccctttatccggtctgtgaccagtcacagaccggtcagatcacgggttaggtggcgactggcggtctgacgcacgccatgccccatcccgtcaagacgaaagcctctaggcactcgtctcaagccggcgttaagcgtgttatctcttagagatgacacgttagacccggtcgatatatgccaggcttcatcctaaccattacaggcaagatgttgtgtgaagaagggcaaacatgcacgttgccaagattacacgcggtggacaagaatgaccgatttgtgatcggtctgacactgatcatatcgtcagcgcacagccatgttcccacgacgcgctcacccccggcggaagtggaggtaggtgtgggctgtcccatcggagcgtcattcggacagcaaccgtgctgatctccgcccgttcaagagaaaaagaacagtccagtttggaaagagaagggtgcatgtggtatccccttgaagtataaaaggaggaccttgcccatagaggtggggggatttttttggttctttcccagattaggagcttagaacgggggagaagacagctcacacttgtagctcattcatacacagatccaccaaaacacaggagtagggtattacgcttctgagcggcccgaacctgtatagatcgccggtgtctcgtgttttctggctggcagacgatatttccacatacagagagagcgagagcttgagatttcaccctaagcccccggccgaactggcaaaggggggcctgcgcggtctcccggtgaggagccacgagctccgtcatctggcgcgccaggtagggggctcagcgtgtgctttctgagctctcagactcttccgtgtgccccaagtttttcttgttcagcctaa

SEQ ID NO: 48569 - DNA, 1501 bp, Oryza sativa
gcagccggcagtgtctctccatgacgataggttccgtggattttttcaacaaaaaaaaaggagaaaaaagaaaccttccgaatacgccggtaggttgacggagatggaagaaacggagaaagactagagagggtttggcctgaaggcacgcgcagccccgcagctctgctctccaacaatatactccgccggccgcggatctcgtcggccgacgaggcgacgtggcgtcggacttgcggcctcgagggtttccccagtggagagccaaaccgcaaaggagaggcgaacgggaggaagacggaaaggttttcactagtagtagtactactttccaggggtagattagtttaccatgggtctagaagtaggcccaactccatgtaaaccactcagcctaaataaaggcccaagcaggcgaactctcaggcttgttctcttgccgaattgtaaagcccaattggtcttaattgacccacttagggcccctttaatcataggattgagaaaacgtaggaataagaaaaacgtatgattttgataggaatgtaagtataaaacagaggattgcaaacacaggaattaccgtttgattgaaccacaggaaaaacacaggaattggatgagagagatagactcaaaggaaagttagcaagaggttaaaactcttgctaaatttcctctaaaatctctataggattatccattccataggaatttcaaaggattggatagaattcaatcatttgtttcaaaggacttcatagaaaatttttctataggattaaaatcctctaaaattgctatatttttttttccaaatcaaaggggccctcagtaggcaaattgttcgtccatgctgtagtttgtggagaaagggggtgcgtagtttgtggagaaagggatgcggtagatttaccaggtttgtcatctcggtgtaaaaaaaataagtttgtcttctcactttggagagtttagaaaggaaaagcaaacatctacgtcgaccccatggatccatggattcaacggcggatattgtgtccggcgcctgtcatgttgctagattccagcaagcaagccagtggtatggatccgttaggctggccgactggccaatcgttgggcatagcaaatcagcacgccgctgctaaaaagggtcccgcttcattgtatcatcgcaaaatcaggaatcggggccgtgttcccgtccaagtacagcacctgaaacactagcttcctctctccgctctgtaatcacatcagtcctttctgtcgcgtagtacgcctcccacgcggaattaccatattaggccccgttaccagctgctgcttctacagcgatcatcattagcgcgtaaggatatgggcgtaattttcaccggattaaggaagcataggttcaagtggtactaatttaggtggtgccaacgagcgccatccacacgcctgaaatccccaccgaaaatgacgccgccggcgagcacgggcaagtgcaccggcgccg

SEQ ID NO: 48570 - DNA, 1501 bp, Oryza sativa
gcaagaagaaagaacatgaataatggatcaaagtagagttgcctgcttgaattatggagtgtgaaatctgcttaatgcaactcattcacgtgtttgaatctcggcagtacgttccacatgctgactgttttttttttttttgagacatgctgacagtattgcattttaggcgaatgcaaggccggacttatgtccatgttctgaggctgaaagtatagaaaggcccatctcaacttttcaagcagtcttggcctgctacggcattacggcccataaggcctaaagctcagccatcagattcagcaagcacttttatagaccgacaaatagctgtcacagctctatcagtgtcctccaaaagcaacaactccgacttgaaaggtcagactccatacatctattccgagtcctgcctcgtaagaactttcgcattgcaattgataatgttgcgttgctaaaattgttcattatcattagcgatcttttgaatctgctgctgtcaacaagtggttggacgcacgcaacatctgtagtttatacgacgcccatgacgagatgtacggtgtaccaaaccccaagcaagtggctccaggtggaaacctcccatccaaccactccaaatatactaacaacttttagtctcacgattttatcctaaaatataacaattttcttaccaacattctcttccatatccaccattcacttttttcacttatcttcacaactcatctaataacaaatctccatcactcacttctacctactttcttaataatcatatccaattctaaaacttcttatattctaggacaaagaagtacttggggacctttgaaattataatgcaaatagtagcattggcctgctcatttgtgctcaacagtatctaatatatttttaaccttattttaaaattaatttagctttatttcacgttctaactttggctttagaagtatataagtttttccttaaaattgttttcgttagatgggatacgtgtctttgcttaaaaaccacagccccaaaataccttccaagcaggcccacagagtaccgagggtaatttgtacttcgcaaagtgcatcatatcggagctaaccactatttatggataaaaatatattatactccagccaaatatacatacttgctcccaaagtatcattggtgagtgattttatagtcggaaggaagattttttttaatatagaatctggtactctctgtagctcacgtatcacgacatatcaaaaattacttaaataaaaatgcggattgtctcacgtaactttacttgggattaggtaaaaatagaattaaatttggtatacaaatttcatacatctctatctctatctcttctctctactattataaaaattatgtttttgccggtattttagtacgtcatccgtatttgagtcggtttttatgtttgttcgcttttagaaatacaaatctgtatttaagtcagattttaaattcgtttgcttgt

SEQ ID NO: 48571 - DNA, 1501 bp, Oryza sativa
tgaactccactccgtacaggagccacagaactcacgctctcctgtgccgtgcgtctgatctcaccatgaccttatgacaacggtaattcaattcagcttcaggctgaaggcggtctatagcatgaatgcgagtgctagattcagatgctgcagacatggctagaaatcattacacgatttcattgcctcggatcgcctctacgcggccgggattatcaccgtttcctttcccgcggggccatgttgatctggtcttcggtttttaatggcgtcgaggtgagctgaaagtaaccgcagcagcgagcgcggccagacacggaggagcagccggcgagggaggagttaactagccgtgacgtcactgctcccggcaaatggcagcggtggcgtggcgacaattcatggcgagagagcggcctgatcgtgaccgccggagggcggagggcggccggtgagtggtggtgaaccgtgcttgtgcagatccagagaacagtgacaccgttggttcaatgtattgaaagacatggcgcggaaattgaaccgaatggcgggaagagcttttagtcgacagctgactagctgagctgatcagatctgaattgtgtatgggaaatggtatctcttgctgcactgtcagaaagtgctgctgcaagctgaacatcagaaattgaatccgattaggattactatttgtaggatctctcttctgaagttaaatccgattaggagtactgctcagttcatgtttaagtgtttcatgcatattcggattaggacaccggaatgatcaggccaagaaaccttggcctatatatgcaaagcattcgaaagcattaccagttggggagctagcttgtaagatttgttgccgaatacttcagaaaacagtagggctagctaatctggccctaattatttgttgccgaataccaagtgtttgatttcgaattagcttgtaatgccgggcaaaatcacagtgacgtctacgagaggggcaggcaagtcagcaacggccagctccggtgagccctgcaattgatccgtcgtggctgcaaggtggccatgacaagctccgataattccggaccaggaattagatacagccattgatgccattcattgctccccggttaatagcaaacaatagcaacagatgtcatgatgtaccagtactgaatatcttgcaagcaacccgcagtctgaaatctcagcctccgtttctgaattctggtcacacctgctgagagttacgtcttgggccatagcacttgtgccctcagttgggctggttgctgtttaggctaaaacttatggcctaattgctgatctactaattagtccatactggctaacaacaaaccacataagctagctttgcagccacagtcatctccatcggacaatttattgccggttaattaaccgccggaattgcataaatacctagcagacagaggccattacagctcaagcaagtgcgcaccaccaccagcaacaatgt

SEQ ID NO: 48572 - DNA, 1501 bp, Oryza sativa
atctgtgtatgaatgagctacaagtgtgagctgtcttctcccccgttctaagctcctaatctgggaaagaaccaaaaaaatccccccacctctatgggcaaggtcctccttttatacttcaaggggataccacatgcacccttctctttccaaactggactgttctttttctcttgaacgggcggagatcagcacggttgctgtccgaatgacgctccgatgggacagcccacacctacctccacttccgccgggggtgagcgcgtcgtgggaacatggctgtgcgctgacgatatgatcagtgtcagaccgatcacaaatcggtcattcttgtccaccgcgtgtaatcttggcaacgtgcatgtttgcccttcttcacacaacatcttgcctgtaatggttaggatgaagcctggcatatatcgaccgggtctaacgtgtcatctctaagagataacacgcttaacgccggcttgagacgagtgcctagaggctttcgtcttgacgggatggggcatggcgtgcgtcagaccgccagtcgccacctaacccgtgatctgaccggtctgtgactggtcacagaccggataaagggacgcgccgtgctgcactgcatgcagcgcgacacgcttgaccagactgcaataaatgctgttaggtgagcacagctgtgctcacttatcccatatacgtggcgcagacttcctaaagggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttgtgccagagcaatttcccttcccaagggaagcggtcaggtgtgacgccactcctaaagcctggtgacaggtgggaccggtctccgtaattgggcaaaatacccaacggtctcaatccatgcacatcggtattgataactttggttgtccataatgggcggtctattcagactgccacaccacttgagcagcgcgcgaatctgggtgagcagatttgtctcgctcggagatacggtaacgccgcttcggtcggcgagcgtaattaacgcgcgcacgatacaatccgtttcgattgccacaaccgcatatccacttcaagcgccgtaagcgggcgaatgggattagtggaagcgtgggcacgggaaacgggggagcgagatagcgagatacgagggagcgaggtagtgggcacgagaaacgaggagccaggcccagcgatggcaagggtataaaagcatcgagaaaaggatttgctcccttcctttcgccattgttcctcttgccttcgctgcctgagctctaactctttctctgctacgccctactttcgccacacgcgctcgttcccaatcatctcttcctccaccgcca

SEQ ID NO: 48573 - DNA, 1501 bp, Oryza sativa
ggaatgcacttcaggaggattccattagccgcgcgccgatagagggtgtcacgaccggaaatcacccaacaggcgttcctgacgtgcgtgtattattccttgtcccaggaggcaaggtacaccaaaagttgatacaattcagagtttaacaagcggaagcgtaaatataattattacatgggcaacgaaggcccagcacactcaaagacaacgaaaaacagcggaagactagggcgacgaccacaggcacttgacggcaggcacgagctagacaccgaagccttcatcttcagggaactcctcatctgggcttgggaaaattaagcaagactgagtacaaccaccgtactcaacaagacacacccacaaatgcaaaataaatgcaagggagtacaagggaattataacataaggggttagagttgcagtaaacagcatttaaaggaatttagttgctcaaagctagttgtaaacacgatcctagaactaaacaatgttattaatcaaggccgtgaacccacacgaacctgccttaacccaaggcctatgatgattcagaccgaactggcaacccgaccctgggtcccagctcgtcctaagccaacccaggccaaccattccacattttagttgttgagcaaattttaagaattataacactgacttgggtacattgctaggcttgcccatatccgagggctcggctattcgaatagatttactctgatcagaggtgtacatctttacccacaagacacatcttcctcacgtgtaaccacgtgccacataccaccacggtatacagacgaaagacgtgacatagtttccaacccatcctagccttagacaagagtaccgacccaattccgcctacggccgggacccccgggacaggcagacggaactgagcccctggcattgggcaccaaccctccgccgtatgacatctcgactaccgggccgcagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatggtgtccaaatgatatgagaatttcccaagtctagagttgtaaaaccacctaatgttgcctaattaacttgcgaagcatctacctagaattatactagtggtactatgagtagagagtgtccactagttggggttttgtttgtctagggtgaacaaggtaataataataacaataacaataataatatggtcataacaaaggtaaataggcatggctaaataaaacagtgataacgcggg

SEQ ID NO: 48574 - DNA, 1501 bp, Oryza sativa
tgctggaaagtagtgctagttaagctttcaatttatcccttccctgtggtttgctcttatcttgttttgcctaaccattcaaacatgtcattaatcagttccaatcttttcttctggtatcaggataattctccagccatgtaaattttatttgttcatgctagtggacgaattgccatctatcatatgatcacatacacctttttctttttccgtacatgcaaattgcagcatatattccggttgaggtgtggcaatcataaaagccacctccttgaccttgaatgcaacaacatatacctatttggcttgttttaagatgagtcatctcctaaagcattttggatttacaggacttgatgaacacatgacctgaaaggggaaaaactggtccaaactccaaaaagagttacctgactgctaatgcatcgtgtggaggcaagttctggcaatattgtaccgaacactcatgcaagtgtgacaagatcagtgcatcaaggttacctgtcaagcaagatcctccttgaaatgcttattgtgcacttttatttttgtagagagagaggcttcatatacagatatacttactgctgcagtacttcctttctttgtctgcatcttctccttcttctttatgtgtagaattagtatagacattcttactcttttgtcagcagaatatagtgttctgtacttattatagaagtctcagtgatcagtcaccatgcaacaaaagaaatagaaatactgcatatagtttcagttttacttcccactcgattttaacatgaggaagcattgtcttgcctgaaacaaagttttctaattacttaatcactctgtatgtacagtcagttgggccttagttttgattcaataattgatattgttctctagtggttgttttctactgaattgtccatagtaagaaatgcgaatcgctaaacagaaaaaggtattatactataggtagtcttatgataccacatctggtggacgacaacaacttgactttgcatataaataggcagtcccaggatgatctttccgcagcactccattcatttatctggttctgttatatatctctcaacgtaacctgattaagttggtggttatggagcatttcacaagaggagtggtgctcgggatgccttccatccaaagatgccattcactgtcatgtcaaatggtgatgcttctgcatattcatactcctctttgatttatagaacagaagcaggaaacgaggcatagttttggctaaggctactataaccatattcaactgaagtttttgtattacttattgtgtttagcatggttagagattctgacaaattctgagaaaggtttgattttgtcgttatcagggccaggtgcctataaatttctgcatcatgacgttgcatctctcttttaacatggttttacgccccttctgtgttgaatacttaattttgtgctgtgaccgtgataaattacttaattttcaaacagg

SEQ ID NO: 48575 - DNA, 552 bp, Oryza sativa
tttgctccaggcctacagctgaccagcatcattgctccagcatttgctgcaattcataggtaaaggtgttcaatcagtaaatgggtcaacaactgtacgaagaaacaccaattcagataagtaacctatatgcataaccccacgatcaactgctaaaaccacaaacccagatccccacaaagacacatgtatgacaagaactgatccatcaaacagatcttaatctttagggtgcacattccctcactagggcggcaattaacccaactgcagaaacgacgggctacacttaacacctcgcacagaacactccagtggaatcaacaatcaaacaagcatgttgatctaagggaaaggcactaagcttcaaaagcaaaccggcttgcaatgtccagaactccagatcccatggaagcaagcaactcacccaacaaacaggaagcaagccaaacagggaagacaggagaggaggttagcaggtggttactaatggtggcttcgccgtcaggggaactggaccatctcccttggtgtcgaggtaggcgcggagga

SEQ ID NO: 48576 - DNA, 643 bp, Oryza sativa
taatttggaaccatgccattataattttttaaagtttgagatatgccatcggtatctcaatgacatgtaggatccacatgagtcaatgacatgtggaccaggatggtatatctcaaattttgcaaaattataatggcatggttataattttccctaaaaagggtgaggttcggagagtttgttcaaatcaggattttcttaacgtagatatgttcttcactatctcgtccactgtccactaccttatatactagcttaaatttataaggttttattatagttagaagcagggtgtccattgtctcttacatatattatttagcgtgtacacatgattatataaatataaagtattgatgtcctttaataacggttccggtttagacgatgtgttttaagcttttggaaatctccaaaactattttgtccataactacactcaatttctagtggtgtagatcttggaatcaaagattcaaaccctttccaaaaatattaaacatccttccagttcttaaaagtcgtataatactagttatccgacctgatggacaatgcaggcaaccacgatcctggtggatcatttctcaatatagtctgtttaagtataacgtggattagattaccaaccgtatagttaaaa

SEQ ID NO: 48577 - DNA, 472 bp, Oryza sativa
gcaaattgcctcttagatcaggagttttatagtgtagagacattttatagaggcattttaaaaaatgtctagaaaacttttactctacagacactttagaaatattttcagcatattttattagattttatattgtagaggtattctttcggcactttaaactgtgcctgatatataaaggcattttcttaagactttgtaaggcacttcttagaataaaagtatgtaataaatgattaaatataagtaactcaagacaacaacatataagtaatgacttggggttgagttggttagtgccttgaagataagaatgaattgtgcaattgatcatgagttcaaggattgtcgaaaaacaagggaaaatattttatttttttacattggtttcatatggttgtgacacaatttaatgtctctataaaatgcctctaccatcttatagacattttgtaaaatgcctcttcgtttg

SEQ ID NO: 48578 - DNA, 1501 bp, Oryza sativa
cgtatatataaaaccttacaaactccatgcacaataaaatagcaaattgagaaagaatcatttgaccaggttgcatggaaatctgacaagtctgaagtttagagattgtatctcatcttgcactttctgttgaataaacaagaatcctttcacaaaagcaatgttgctacctgtccggaacagaaaataggaagtaaagggcagcaaaactgtacagcaatgttgacaaatcctcctcttgatttcacaaaagcaatttatcaaagacaaataaaatggatctctgtaattatgtgcatgatttgcctcacaaaattagtttatgaactgtagcagatatgatgctgccctgggaagtgctatgttcccaatgtatcagtaatacaagaaataaacaatttataggactgagaggcaaacatctgaattgtgatccatatagagactcctgtacagctcttgaatcatggagctgaaaaaacacattattcatttgaaaacaccaaaatacacacaattctctccaatagcaatttactctggtcagtgttcctctgcaactgaagccatataaaaacttgtcaccatgccatgaatcagaggaatgtaaatatcccttatcctaaagctggcatcaatatttacataatgctatacctcacctatatacatggcaaggtcttttgagctgtattttatagctcaacagtacagcaaaaccaaatgctggaaccaaatgcacagaagcttcgggttttttcccttatacaaagcaagttactgaaaatttataaacacattttgaatatatgtgatgatactctttgactttttagatgccttgctagcagacatcttaacagccaggaaaatacccctatgctcacctcacaatcataactttcctatagaacggaaataaaaaataggtacttttacatgaaaaacaaaccgaaattcactctaaaatgcatggcagatttcaggaaaataatgcagtcagtagaaccatcaactcgtaaaactcatgaaatctttggaggtactctccatggttgcgctatgtatgtgtgtgacctaaattagtttcatcttacaccttcagccaaccttgagcttggacaagtccaagttcagctttttaattgccctttttaggataagtcctagatcatatattttttaccctttttaggattcgggtaaaaaatggtttactgaacttatgaaatttagctgcaacttaagaggattgaaaagacattgtgaaggcatctattttcacttatttatttatttattagaaggtagataaggaaactgcaaatatcaaaatacacgagcctaaatattttgatccgaaaatgtataccgatctgaaaccaatcttttcgtaattaaaaaagagtgaattacatattgggctaggttttcttacatgaattgcacaatggactaagtcttagcaaataatttcactttataccggctattgttacca

SEQ ID NO: 48579 - DNA, 1501 bp, Oryza sativa
ggggccatccatgtcatctgtatcttcatcttgtagtttttccagggctagggcctcccagtttattgtgcagttcctccgttcccttgctcccagattaattgaggtgagatgcgcatggaggtgttctgctttgtcctcatgagtgtgaatggtgttgctgccacgctgcagacagtggataaaattctttcttctgcgagcattgactttgatgtgaaaaagttttgtgtttgcatccccttctttgagccatctaactcgcgaggcttgttttttccttgccttttccactgccgccaccccaaaattctggctttatttgagatcttttctaaaacggtgctcctgtgccgacaaggtccttacttcctgtgctatatccaacatgtatattagctcctgcaccattgtgaattgcattcttgactgcccaaaatttgtggacttcttcctttttgttgctcattcgaatgaattcagttatgcaccaagttgagtattgttgattccaatgattcgggatggaatgccgttgattttgtgactctttttttgttagatttattatctttgatggatttaaagcatcagatctaattgagctaagcctctctgattttttaaataaaaaatcatgcagttcatgacgttctcaatcggcaccgataagtgagaaccctctctcatcagtgcctctttcatggtgctggccgggaattaatctggcactagccggcaccaatatggtgttgtgtagtagtaacactggcataatactagtagccgtcggtgatgacggctttcttctcgactcgacctgtgtgtcgtgtgcttcgaagcgcagcattaaatctagcctgatgcggcgcgcggctgcctacaatggtataaaaggggaaagtgaaatcatccctcgaggggatatcctctcgtttcgtgcatgtcacctaaatagtcataaaaaaatatgaaaaaaaaattagaaacatatattaatatgaaatatatcactccacaaacatgcaagtttaaatttaacttctataagttgtaacaaaaataacaaatatagttgcgaatgtgcgataactattttcagtttaatttgtaatttttgttgcaacttatagaagttgaatttggtcttgtatttttgtggagtgatatatttcgtattaatctacgttgtcattttttttttcaaatgttttgataactattttgcaacgaggtgaggtgatgtcccctcgagggatgaaaatccccatccgtataaaaggaaattattcatggttaatgtggtagttttatcttctccatattctcctgcaaatttaagggtaaacatatcttaattaacttccatctgccatatatgcgcaccgacttatatacagtaataatttgtacgtacgtttaacgacccttgcggcgtacgtctagcacgatctacgtaccctggttgcattgcgatccaatcaagaagtatcgatctcat

SEQ ID NO: 48580 - DNA, 1501 bp, Oryza sativa
tgagatattgatatataaaagcaacactggctgatgtgtactagggttcccaatcttctgaaaggttctgataaccaacgatttgagcggagtcgcgacacaaattgatccggcttcttgaacaaacatgctcttgagccccgcaatcgcagcaccacgtctcctctggttatcacccgtgtcgaaacgcggatgacctcaccgagaagactaatccctatttaccaatcgaagaacacaaacaagaacaaggtagaatacaaccaaaattgcaggtgaaagattaagcttacaagttggggtcttacaaaccgatctagcggcgaaactgttctcgacagaataatctaagcgaaacccgactctaaacaatgatggctactgattaagtatgattagggacgtcctagggttggcctagggtgcacaaccccttgggctaagcccacgacacaactaaaaggcccaaaacctaaatcagattcggactggatgagatacgtggcttgttttgtagattcctggcagcttggtaggaattttgacatgggaccaaaaccatttgatagtagattccataagctttccaacaagtacacatgagccccaaaattccttctaaatcagcggctaggtctgtttgaagttgatgctgtcagaaggcccgaatccgaatccaaaatatgtagaattttatcccttgtcttctatggaccaaaagtgacatggtgaggtagaagtaaacttggagaaggtcttgatttagtccccaatcaacttcttttccttcgcccaagcaagtacctctgcaaacgaaaacacacaaaactcattgtgtagcaacatttgttcaaatatataataagtaaatctaatatagaacatatgcacatttggttgattaatacataaggtagtcatggttatatctaagctagtcgtgtcctcatcactggcttcgaccaatagtataactaatgttctccaaacgatgataaccctgatgtatacaggagtagctatatttatggcgtcatatttttcataaaaaaaatagttaaatcatttttacactaaattacattcactcttacattgcaattacaccgtacttaccatgaaactcttatatatttacattgtaattttcaaatcttacatgtaaattttaaaatttacattgtaattttcctcgtctctaaatctaaaccatattcacaattggactaaaccatattcacaattttcaaacacatgtatatatatacaaaatcgagaaaaataatgtatattttaaaatttaattccacaattttagcagttccgtatacttttttattaatagccatccacggttgttgcgagctgcctttgtgcctacccaaaaattcaacacgaaacccaatagccaatagacccaattggcaatacggcacacgaaaaccatccgtagctatcaaccgacgcgacaccacactcacccccatctcctacgtccaat

SEQ ID NO: 48581 - DNA, 710 bp, Oryza sativa
cccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatatccacctcatgcgccgcaagcgggcgaatgggattagtgggagcgtgggcgcgagaaacgagggggcgaaatagtgggcgcgagaagcgaggagccgggcacagcgttggcaagagtataaaggcactgaggaagggatctgtttccttcctttcgccattattccccttgtcttgcgccctaactccttctttcctgtgccctaccttcgccacacgcgctcgctcttaatcttctcttcctccggcgcca

SEQ ID NO: 48582 - DNA, 182 bp, Oryza sativa
acactaccaaaatatatatacttaagtgccaaatgttaaagtgtgtggttctctgtaacttggaccacaaaactatacgtatatttttgtgaaatttactcattttttaaaggatgattaaatattatatggcataaagctaacaaataggttaaaaacttatccaaacaacgcatcctatc

SEQ ID NO: 48583 - DNA, 241 bp, Oryza sativa
cattatatcatttaggaaagatagaaaaagaaagtcgcctccacctccctccctcatatgcacatagcattacccaccacttcctctctggctctagctctatgctcttcactagtcataagctatcaaagtgaaagagaaacaatcaatatttgcacctgcaatgtctaatctaactttgctctattataataaaaaaaaagtaagatgcatattcctatattttgttatataagaaaca

SEQ ID NO: 48584 - DNA, 431 bp, Oryza sativa
atagtatagaatagatagatgatgtttattatgaacaatcttatattggcaatgttaatgaacgtcatcaaagcttatatgtaaacctaacaatcttggcatattaccacaagtccacaaccaacttttgattttagccactccaaaggtacattattttatatctccattttgattgacttaatttattaatctctatatgcttttttacatagtaagcttattctaggcccatagatcaacaattctttatggccttggatctttttattgattttccatccgtgtttatttcttcattatgatagaaggctataatatctatggtctttcttacccaatactattgtgtgattcattcaagcattttggaacttactgatagtgatagcgggcattctgatattaaaatatttattcctaatttcagg

SEQ ID NO: 48585 - DNA, 278 bp, Oryza sativa
ccagaacctgcgtcacattaacagatgatgaagtgaaaaaataggactcagtaaagagaggaaatggggaggggatggcactgagcgaggtgctcatggagagggagaggataggagggtgtggcgatggctgctgactccgtccgggcgatcggatccagtggagggggaggccaaggccgatgaatcaaatggtcggagagggtgagggaggcagtggcgtggcagggatgaaagaggagaaagggcggcagcggcggctctcgttcctctctagg

SEQ ID NO: 48586 - DNA, 1501 bp, Oryza sativa
aaaataggactcagtaaagagaggaaatggggaggggatggcactgagcgaggtgctcatggagagggagaggataggagggtgtggcgatggctgctgactccgtccgggcgatcggatccagtggagggggaggccaaggccgatgaatcaaatggtcggagagggtgagggaggcagtggcgtggcagggatgaaagaggagaaagggcggcagcggcggctctcgttcctctctagggcactggatccgccggcgaggagaatggggtcatcggatccggtggccccagcctcctcattgggagatccggcgggaaagaagcggcaatggcggcacggcgagatggctggttgagggagtagtggcgccgatggcggcacggcgagatggctgagggagtggaggggttgagggaatggaggaggagggagttgcggcggcgacgacgcacgcgaggaaggaggagggctaggatgcggcgcgatgggaggaggagggagaggcggcgcgcgtggggaggagaggacgggtggctagggtttgtacgagttggggaaatccacaccgtccgttagagatccaacgatcccacgggtgcggaagggccgccacaggggggagcatggacggccaaatcaaccctatctcaagatcggacggtggacattgcgaggaccagcgcttaattaaccaaaagtatggggtatattttgtaaaagacggctgaggtggcacgctaatcttcagccattcccacggcgtttaagtaaactaatatgttgcttcagaatgcttacaatcaaaactcaaactagcttcaatcactgcctcaaacatgtaaaaacaataagatttaatatataaaaatggtatcagtatattaacttagcattacaaatactactctctaaatgaaagttttgctgttgtggaccactttttgataaaatggatctaaacaccagtagcaaaaagtaggcaagttggcatttgtcatttgggagtccatcgcagcaaatttggacaaaaaagcgtcgggccccatgcatgagagaggcagcagcaattaatggtaaaactttaccattcatctaaacaccaactagcaaaactttaatgccaaatcttttgccaccaaaacttttgccaaaaaattttgccacaacaaattgatctaaacatgcccatagttgttgagaaacgtccgagggtctccggctagcttcacaaattggtgtgctagtcggtctgggttcgaagccttacatcttctatttatttgatattagatcattccataatattccttgtacattagagattgtattgatgtgctaacgccatgtttagttccaaagtttttctttaaacttccaactttttcatcacatcaaaactttcctatacacgcaaagttctaacatttccgtcacatcattccaatttcaaccaaactttcaattttagtatgaactaaacacagcctaaaacaaagta

SEQ ID NO: 48587 - DNA, 1279 bp, Oryza sativa
tccgatgaattggtcacaaatttctcatagcaaacacttgatatatataggactaaaaaggaagtaactaatgacacctagatagatgagaactagcatgatttaggactaattagtaaatactattatattattttgatgtataaagtgacagttgtttgtagctggtaataatttggatgatcctacagatttaggaaacatgaatgtagtcaattaatgactatagctacaacattcaaacccttcctaaattgaatcttttcaaatcccaccagatatttcatcaaaatcaaaattaagagactaacaagtttatcaagatgtgtgcacatagttagtgccagtatgcttaactttgaatggaacctctctacaaatagaatgaaaaagcagagcaaggactcgaagatgcatttatatttattttatctttgctcttgagtctaagaaaatcaaactatcaaagggatctaaatggttgcctgtgtcaatctgaagtgctatgagttcatatttttagaagagagaaatattttcacaacacttgcatgaactcaggtgtcaatggtaaggtttgcccggaacttcatggcattttggctcgaacttcgggcgactatttttctagccaggtgttaagtgttagcatgacctttaaaatagttaatagcccattctaacttaatatcccattgcaaagcacgagtaactaaaagaaaaacccacatattatcccatttgaaagtgagaaaaaaccacgggctttgaaagtgataaaaccatgtgtggatccaccatccatcaaccttgagcggtcactctcatacgatagaaattgaatgttttccgatgaattggttatacatttttcatagcaaacacttgatatatataagactaaaaaggaagtaactaatgacaccttagataggtgagaactagcatgatttaggactaattagtaaatactattatattattttgacgtataaaatgacagttgtttgtagctggtactaatttggatgatcctacagatttagtgaaacataaatgtagtcatttaatgactacagctacaacattcaaaccattcctaaacagaatcttttcaaatcccaccagatatttcatcaaatcaaaattaaatcaaaccggccaaaattcaaccaaatcgcctgcttccgcccgtccaaattttcaaattccagatcggttaaaacccaataaatcaatccatccccttgctaagccccgttcacactccacaccccat

SEQ ID NO: 48588 - DNA, 291 bp, Oryza sativa
ccgctggtcatccgagccagattcggtggtgttcttgtcgaaggatgtgctttggagatcatgaaaatgatttccgcaagcccagtacctgagatgtcctggttttccgaaattgattggaataatctgttgtcagtgtataactttggaaacacggtgattattcactagtcttgtgtttctgtttcgcctgacaaaacccggacaaaacagctaatctggtgttgttgctccatagtccacataaaacacaaaccttggcatgttcagagtatttcttgccacttcagt

SEQ ID NO: 48589 - DNA, 305 bp, Oryza sativa
tgtttaacgggcccaacgcgcataaacccttttttcccgaatcgttcctttcttttccctttgcacgctcgaatcgattccttttcctgcatttcgttccgccgcccctttcgtataaatctcgccgtgatcctctccatctcccgcatcgtgctcgcccgtaccggcgctggcatgtcatccgcctcccgtgccacacggaggcaggatgagggtgtggcgcttcccctcccgtcgcccccatggcggctcgtgcgctgcttcccccttcctctcccatgctaaaggttgttcgcccctttagg

SEQ ID NO: 48590 - DNA, 404 bp, Oryza sativa
gttttagtaggaatattcaggaggtaagtacgtgtacagagacataaatcgagaaaatattttttaaatagtttccttagatattgatcttctatttacagaaaaggaacccagaaatctttttttttttgttttttacaatctgctggaaagtccaaacagcatatatgttcccagaaaaaaaaaagagaaagaagcagagagagcagcaaggctgaagcccaaacatatttttttctacggcccggtgcgttgacaaatctgactaaaacagaagaggcccaaactattaatagttgggctgaagtcgcgaaggcctggcccatcaactatccttctcgcttccccaaaataataaaaaaataataaaataataataataatgcttccctcctcttcgcagc

SEQ ID NO: 48591 - DNA, 937 bp, Oryza sativa
ggttaattagcaaataagtttacataatgatattaggagataaacccagaaaatgaatggtactaattaatttgaatgccaactttaatttctggaaaaacatttaaaaaaaaggcatctatcgagtcacttaaacacttctggtcattctctatagcaaaacgtactaaaaatatctctgaattccagacaaaaaaattacatctagatctatcagggttcacataaattgatctatatctatcaacacgtaatcctctatactacatgggaaatgaagcttgttgttgttgctgttgctactaccactataggatctaataggtaatcctgggaccaccaaaaaaaaatcctatcccaatgtatatttacatatgtgaaatatatttttgcaaaaagaaaaaaacactgtcttattaatatattatgatgcaatcaatttatatttctaaccttattatatttagggtattttaaaaaatatataagttggatcacccatataaaaattctagatacgccaactactattatgggagtgaacattatttgtttgctcacctaaaatagttgatttctctccatgtctagaataaatataagtcaaagttgaaaagttacattttggtttagaattggaaaaatcttacagatatgaaagaatatcgaaattgaatatatactagaaaaaaaactccaaagaaaattaatccaatcgatataccaataattaatttaatattacttctagtcaatgtagtgtgcatttctaaaataaaaaatagccgcgcctagtttttgtaacaaaccaagtaccaaaatattacacgagtgcaaaagcaccttattcacacgtacggcatatgtacacgtgtatcacacgatcgattgaaaaccgaatgtgattaatcaagcatcattttaagtttttaacgca

SEQ ID NO: 48592 - DNA, 300 bp, Oryza sativa
atagttgtagggtatctcaaactacctaaatagttgaggagtaatttagatttttcttttaaaaaaagagtgaagccaaatcctaagtgtgaatgctataacagaacaaaagtctgaataagttatcaagtactcaagattccgaaattccataaacagtcgatgtgcacggtttatatattattatatctctcattttgcaaatttaagttgtaagtccgtatttcgagctacagtcccagaattagggccccttttttttttgaaacacagtacaaacgcaggcgctcacaacgtgcg

SEQ ID NO: 48593 - DNA, 950 bp, Oryza sativa
cttgctatactaaaaattcaaaggcttggcagcccatgcatatggaacaacggaaataatgccgtgagaatatatattccagggagccaggatgaaggagctagggaatcgtaagtcaaggcttaattataagctagatgttttaattgatatctccattagaacaggtacagagcaggctataagctagctgcaaatatattttaagaagataaataaggaaagagaagagcagcgagctacagatttgtagccagctgtagtacggatttcaagacacacgatgtgtatgataagtggaccagatattaatagtgtagtatgtaactattgtatgaatgagctattaggttggttatagatgaattgaagctagtagatgcctatactattaagtcgccctcatgctaatttaagacggtgccgacctcttaaaatcgtatggacttagggctcatctatatatgctactgcatgcctgccgtgttctctacactaagacaaattcttcattctatatacacacacacacgaacatagtcacacacatgaaagcatatatctcgagacgtggtaaatccccctccacgaaaaagatatggcatatatacattataattagaaaatagtttgtcccattcattatctgaaataaaacaattaaatcactgtgtgcccgggccagtgatgatatgacatgacactgccagtatatgtaccatattctctttcatagctattttactatggtgtctattaacaggagtatatatgtattaatatttgtacctcaaatagtagtagtagtatatatggtctctattaacaggagtacatatgtattaatatttgtacctcaaatagtagtagtagtagtagaactaagtatcttaattttttaactatcaaaaactgagtaattgtttatactgatagtagattactactaa

SEQ ID NO: 48594 - DNA, 834 bp, Oryza sativa
aattagaaatattaatcatagactaatgacaaacatattccataaccctggactaattcgcgagatgtatctgttgagcctaattaatccatgattagcctatgtgatgttacggtaagcatgtactaattatggattaattaggcttaaaatgtctcgcgaattagctcttatttatgcaattatagttttattataagtttacgtttaatacttctaattagtctcaaacattgatgttacaggcctaaaatttaggtggtgtttggattcagggattaaactgtagtccctgtcacgtcggatgtttggacactaatttgaagtattaaacatagattacttataaaactaattacataaatgagagataattcatgagataaattttttaaacctaattaatccataattagagaatgtttacggtagcatcagataagctaatcatgtattaattaggctcaatagatttgtcttgtgaattagttcgggttatgaaatactagtaggttttatcattagtatatatatatattttgagcgaatcattagtacatattcaatacttctaattagtgtcagggaatttttttttttagcacctcccgtctcctcattcctcaatggtcatcctcctcccaacccacacggtccagtcctcctcctcgcgtagacgcggcggccgaggaacaagtccgtcacgcgaaccttccagaacctcacacgtcacgcaacctcctcctctttattacgactactaccaccccctctctcctctccgttccaccgccggattcagattcggagagagctactcctcgtcgttagcca

SEQ ID NO: 48595 - DNA, 296 bp, Oryza sativa
tcaaaagattcgcctcgcaatttacacgcaaactgggcaatgggttttttttcatatttaatgtcctatacatgtgtttaaagaatttgatatgatgtttttgaccaaaattttttggatctaaacaaggtcttattatacttgtgtttcaaactttcaataatgttttatgtacgtattgaaagctggatgagtacacaaggaattatacttgttctggtagcccggcgcccgggcctgcttctactgcgatataaatgattccggttaaatgacaacgatcgtttcatcgaagg

SEQ ID NO: 48596 - DNA, 181 bp, Oryza sativa
ctgtgtcagctcaaggtcgcccagggagaggtctgccgtcccaagcgccgccgcgtctgccgcagccagaagatcactgcccgcaagagcacctccaggcctgagcttgttcgttagtccctggcgtggacctgcttcgtggaaacccctcgtgccgagcccgcgcccgtggttcctcagg

SEQ ID NO: 48597 - DNA, 167 bp, Oryza sativa
tctgaaaagttcaacaagaagatgaggtgctggctttgattttattgctggtgttccttcctttctgcctgtaccccaaccaccccgctctcctcgaggcgcagcagccattcgcctaaaaggaaaccagtactaacctcgggatggtgatggccgcgaccgcctga

SEQ ID NO: 48598 - DNA, 1501 bp, Oryza sativa
gtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcggtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcaaaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgaaggttcacacacatgtaagcgtttggaattttggatagaaattccgggcgtgacaagttggtatcagagctcccttgacccttaggttatgccaaatggttatccatagaagccctctaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaagcttggtttactttatttacttacctttttactttgattttcaaactttattcaaattaatccaaaaacttgtgctattaattggatagatgtcttaactccctcctttcacctgtctttaga

SEQ ID NO: 48599 - DNA, 1501 bp, Oryza sativa
gaaccgaaatccccaactttgtgctctaccggtgagaccgccgttgtgaggccggtcagaccggacaactttgtaacggctagaaaactagccgttacagggcaatcattgagcccactcaacctggccggtctgaccgcagtgtagtggccggtcagaccgtccacggctcggtcagaccgccgtctgctcggtctgaccggttgcggctctggcggctctgtatcgccaccaaaaaccagaccagtgcaacagaccaatggggccggtcagaccggccttgccacgccggtcagaccggctaacagacccggtcagactggcctaaggcccacggtcagaccgcatgtcacttttcagctcaacctaccgttagtaaaacggcgatatctcttgactcgggtctcggaatttggcgttcttggactctatggaaagcttattcaaagggccatccaacccatgaaaaatccatccaagaaacacaacttaagtcaaggataaagggctcacactccaaaggatatccaccggacatacccacaagatgtcactcactcctattggacatgcccacttctctcttggtttaggacttgagaaaactcatcacacttggttagacaagcccacaaaatgcacctgcatgcatatgaactaatatggcacaagatcatccacaagctcgcttcatagacccctcttgatagtacagcgcctatctagtaaatccggactacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtctatcctttgtcaatactttattctcatcacaagtttgacttcattcttgccaacatgacgatgtccttggcttggtgaccactaacccatggtgtcattcattagcctcatcgtagtgggacctattccttttcacacctcaaaggagaatattagtctcaacaaatcggttgtcatccttcacttgatgaccaaccggttgcatatgaaagatatggatatgtttgttgagtattcattaacatcacaagtgtcatatactcgtatgcaatctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagagcaacataaaacatataccttcatgatctccatgttctcaatgtaaatgagactaaataagataacattcgagtaaacattagtctcacacttatatatcaataacatggaaatcatatatatgaacctatcaaaaagta

SEQ ID NO: 48600 - DNA, 479 bp, Oryza sativa
tgacctattctttgttatggccctttcgtacttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagg

SEQ ID NO: 48601 - DNA, 1260 bp, Oryza sativa
cactaaccagccaacaaactataatatccccatgtactgtgcttccatcaaaacataaatacccccaaaatagtaacttaacattcagtgtcgatgcaaaaatcacctattataagtaaacagcagaagatctcgaaattatctttttagtagataaagcaaacatttttctgagttcactagccaaataccaagtgcaaaaaatatttaaaatatatcataaattttaaacttgaaaaaggtatacttaattcctataaaaaatcatatttaatccctaacaattcataaaagcgtagaagcaaaagaaaacatttagattacagtttatgcttgaagaaaccaaaccatgacaagccagttttgaaacctggtttctaaaataagttaatagcatgagctcagagctgatacataagcaatttaacaggttggctgttgcaatattgcatgtctgtaattctacagggtgcactacagtcttgaagaagcgaaagtacacactgtcaaaccaagttttacagtcttcaatgctctcttgaaatccataatagccctaatagcccatatcccggaattttaaattgcattgcacacatgtctttcgcttcattgtccaatgaccagagtagctacagttcttgatggaaagccagaaggcaacaaactataaatctccaactcaaatacaaaatctaagctattataatctgtgaaccaagacaggttttcttttggggggtggggagggggctgcttgttgacagattcaatttcgactcttaatattttgatgaacgaccaagaacttcataacagtttaaacagtgtgattctgttctagatagcatggcctttcttctatctcccctcctgttttcaagcacctatgtgtccttgttcacttgctatcacttattctgactggatatccacataacacggagtatatcacttttaccaactagaaaggtcaggtccactgttgcgacagctatgacataagtcgctcgatgattatcacaggaaaaaaaactgaatttcacatttgcagtaattagtatctggaaaaatatgccatgtaacacatgtcatcaagaattgtatgatcaatctaattactccagcttcagcctgagaaacacatctgatagggagcacacagtggtagaacagggtcgagatgggagtgtgacgcacctgagagcggcctcctcccgggcgtggatggcggcgaggtcgagcacgcagccggccggg

SEQ ID NO: 48602 - DNA, 713 bp, Oryza sativa
aaattcgtaaatattcatttaaagtgcatataaacttcaaatggccataacttggccatttgaactcggaattggaccgttcaagtctctaatttttccttaagaagtcaagaacccatttttgtgctttgttcctgcttgttatatggagtttattagagtaaaagcccttttcttttccgttggtcgtgtagacgctgcagctttggaagatccgctcttcgtggaggttgaagccgacgtttgggaaagcgagaaaggcaagtcacatcattctttgaacatattggatcccactttgtgaaattactttgatttaaattattgcattatcgctttatttaaattcccgcgttatcactgttttatttagccatgcctatttacctttgttatgaccttattattgttgttattgttattattaccttgttcaccctagaataaacaaaaccccaactagtgggcactctattcatggttccactagcaagaatttaggtagatgcttcgctgattaattaggcaacattaggtggttttataactctagactttgggaatattcatatcacctggacatattggaatggttggattattgtggaattggatgcacacctccccctctattcaaaactctcaaaatggttttaggctaggcttggggtgcatggttttgatagtagcccctcggccacataaggaccggt

SEQ ID NO: 48603 - DNA, 1501 bp, Oryza sativa
ttgcatctcttgtatatttatttgtatgcatatatttagggggagcaaatcctatacatttattgtgcatgttctagatccatgttgttcacctattatttatatcggatctttgcacttgagattgcatacgagtatatgacacttgtgatgttaatgaatactcaacaaacatatccatatctttcatatgcaaccggttggtcatcaagtgaaggatgacaaccgatttgttgagactaatattctcctttgaggtgtgaaaaggaataggtcccactacgatgaggctaatgaatgacaccatgggttagtggtcaccaagccaaggacatcgtcatgttggcaagaatgaagtcaaacttgtgatgagaataaagtattgacaaaggatagacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagtccggatttactagataggcgctgtactatcaagaggggtctatgaagcgagcttgtggatgatcttgtgccatattagttcatatgcatgcaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggtaggttgagctgaaaagtgacatgcggtctgaccgtgggccttaggccagtctgaccgggtctgttagccggtctgaccggcgtggcaaggccggtctgaccggccccattggtctgttgcactggtctggtttttggtggcgatacagagccgccagagccgcaaccggtcagaccgagcagacggcggtctgaccgagccgtggacggtctgaccggccactacactgcggtcagaccggccaggttgagtgggctcaatgattgccctgtaacggctagttttctagccgttacaaagttgtccggtctgaccggcctcacaacggcggtctcaccggtagagcacaaagttggggatttcggttccaacggctagttttggtggttgggggtatatatacccactccccagcagcaagagtaaggttttggcactccattgcattatcttgaacccttgcaagagctctcacacccttgtgcacttagtttatctagtgaggtgttatagagtgagttaagtcaatgctgaaaaagaaactacgttgaaaatatctcaaaatcaatctcaaaattaagtttga

SEQ ID NO: 48604 - DNA, 558 bp, Oryza sativa
gctgcttccaggtgtggtagaatggtctcttcacgaattgatactttgttttgactgggttctgttaggtgattattgtcagcatttcgaaatttattttctgtttgttttggagaaaataaaacccatgtgagtttgacatgtcagttctgtttattattttccgatttgtcagatcttggttgtgccattgtacaatttgctcctgcttttagttaaagaatacaacacagtgatattttctgtacttaaggcaagcagacgctggcttcatgtttttcacagcaataaattttctttctttttgtttgattttattctgttagtgtcaaattgttttctgtcaatgtggcttactctaatttgttcgcaacaaattgcttttgacaaatcttgtaaagcttctctacatcatggaactatgttatatgttttgccagttttccacctgttgtcctcgcatgttgcattattagcacaactttttggtatatatgtgaaaatgtaatgaaacactgtttgttttaaacgtaaatttgtatgcatataacaagttat

SEQ ID NO: 48605 - DNA, 1501 bp, Oryza sativa
ggcgacgcaactttgcgtacaggtcgaaagcatacttgcctcctcttttcacctctcttcccttggaacgagacacgggaaagcgcgaaaaaaaaaaagagtatactcatccattttccattctcgctcctctgccctaccccaatgccccatactactatgccacaataattcactcacaataatactaatgctagtactactcacatggagtagccacatttctctcctatagcctgattgaagaagcttaagcaactgattagtagccgctccgagaatctgaaaaagcttcgtttcttagtttttggcttgtgatttgttttctgattttataattatagcttttcagaatgtaaaaaaattaaactgtttaagaatgctttcgatcctgagataagctgtaccagctaaaacttccgaaacatgcctcttagtctcccctcctgtcccaacggaaaagaaggtactacctccgttaaaaaaaaaaaacaaaccctggtttccgtgtccaacgttgaccatccgttttatttgaaaaaattataaaaaaattaaaaagacaagtcacgcataaaatattaatcatgttttatcatctaacaacaatgaaaatacaaattataaaaaaattttaaagttggatacagaaaactagggtttggcttttttttactcacttctttaggtacggagagagtactgctaaagagagacgagagtcccactcatctcttcactgtgagaaccactgtgctacgccatcgtactcgtaggagtgatctgcaataagaaatctttttcttcacgcacaatccatgaccaactcgtcctttccctactgcccaaactcaaaacccacaaatgcacagcaaaccatgctgcgcaaaacggcaccgtaccaaaaagctcaggcgaatcaaatccacaccacaacccccctgaatcaaatgtgaattatcccaaccttccctttacccgcaaaatttgacgcgctgagagagagagagagagatgagactggggagattcgcacggctcgaacacgcacacacgcaaaacaacacgggcataaatgcggttttggagcgctgcggggtgtgcgtgaactgtcctcccacaaggcgaagagagaagggggaaaaaaaagagagaagaaaaacgatgcgtggtgtggtgcggtggtgggggtgagaagagaacaaaacaaccgctccctgctgcgcccctcctgccacccgctgcggcaagcgcttttttgaccgcttctgccgtctccctcctcacacggcacccggctcgcgtctctcctcccccctactactctgatccaccgggtagtactagacgcgctactactgccgctgtactgctctgccaccacttctccactccactccactctcctctactaccaccgccgctctcgtctcgtctcgtctcgactcgactcgcattgcgcctgtgctgtgctgtggtggtggccgcgcggggggcgaga

SEQ ID NO: 48606 - DNA, 513 bp, Oryza sativa
  unsure (1)..(513): unsure at all n locations
ctgttgcagatttgtcatggcctgttgttcttttgataccctccgatagtcaaatgcgtgatgcatcggaatgtctttttatcgtttgatggatgggaagtatnctacctnnncgtttgctgtgtatcttnngcccactgatnncagaacgagagagattttcgcggaaacgaaacaagatagaattggagtttgataaagaaatggtacttcccatgtgaaatcatgtggactgcccttgtcagtttatcgcgccaaatctttgtgccatacgaccatatcacacatggactactagtacttcacaaatatgcaaagatcttcagctgagccgcctccatctgatagcaatagcctaaaacgatcgccttcagcgaaggaagaaatttcgtcatgttactcccagaattttgcgttcccgtctttctgacgcacgcaaccaaggaggaaaccggcaaatctacaggaaacaacaagcagatgggggctaaccgagagaggatgatgcagcga

SEQ ID NO: 48607 - DNA, 289 bp, Oryza sativa
ggtgctcgccgtatctgagagttccagagcgcaagcgcgaccatcgttcatacacagaggtggtgatggacaagcgccctccaaattcggccggagtggcaagtcaacaagcgaagggtgacggatccgattagaggtggagattaggggaaccgtgatgcgcgcgaagaggatgagcttcgacgccaacttctcgctcaaaatccaacggggaatctaggtgcaagatctcaagggcgtcaaggtggcgaggcagatcgtggtgcgagagcggcggatcgaggtgagg

SEQ ID NO: 48608 - DNA, 162 bp, Oryza sativa
cagcatcacaggaaacaaacatacactatgctgcctctgttgcaagatcgcaacttgcaaaggaagatgtccctgcgtaacatgccatcaccatgtcgtacacatgggcatagcaaaccccaataccccatcctatgtttcctgaatcctgactggtgcagt

SEQ ID NO: 48609 - DNA, 520 bp, Oryza sativa
ccccccccccccccccccccccgcgcgccgtgcccgggcgggttggcctcctgctcgtaatccgcaccgcgacacgctcgctcgctcgcgttagctgctcgtagcctcgtagctctgcccatgcgctgcctgttacgtactccctccttcaaaaaaaaaaaaaaaaaacctgttttctgtgtctaacgtttgaccgtccttcttattttaaaaaattataaaaaaataaaaagataagtcacacataaaatagtaatcatgttttatcatctaacaacaatgaaaatacgaataataaaaaaaattcatataagacggacagtcaaaattgaacacggaaacttagggtttgccttttttaaaacggagggagtagggataaaaacgtattggaaatttttcggttatcaaacttgtttttgaaaaaaaaagggaaaatgttcgttgttgagttgttatcatattcaataatatgaggttttctatttctattccagttaagaaaagtatgaaaataaaa
